United States Patent 11,098,302 (IDENTIFICATION OF POLYNUCLEOTIDES ASSOCIATED WITH A SAMPLE) - sequence listing, part 22

SEQ ID NO: 72293 - DNA, 1039 bp, Homo sapiens
  misc_feature: GYAE6OF02JNCVE.21.26.C04.1.454.CMB.1.raw
tcagtcgtcgctcgcacgaccggtgctcgatttagtctagcgactttgggtttggggggaagaggaagactgacggtcctgctgcctgaccatcccttcatgggtcttgtccccagatcaccttgaaggagtctggtcccacgctggtgaaacccacagagaccctcacgctgacctgcctaccttctcttgggttttcactcagtaccactgcaggttgggtggtgggcgtggtactccgtccgaccgggacccccccgggaaacgggcccccgggaggtcgggtccgtttagaccaccgttacgtaactttttagttagggtaaattggattacggtaaacttaaacccgaacttaacccgaacgtaccccctaagttcccgttaaccggttaggaacgggtaaccccggtaacgggtaccctacccccgtaacccctaccggaaaccggtaaaccgggtaaacccccgaaccccggtaaaacccccaaaaaaacccgggttggggttaacccggggtttaacccctaaaaccgttaacccgtaaccgggtaaaaccccctaaaacggtaacccggttaacccgggggaaaccccctaacggtaaacggggtaaaaccctaacccgaaacccgcccccttaaaacggtaacctttaaacccggttaaccgtacggttaaccgtaccggtaaaccggtaaaccgggggtacgggttacggggttacccgggttacgggggttacgggttacgggggtaaacccgtttaaccggggtaccggggggtaacccggtaaccggggtaccgggttacccggtaccggttcccgaacccgttacccgggttcctaacccggtccggtaccccgtacccgtaaccgtaaaccccgggggtaccctaaccggttacccgtttacccccgttcccggttaccggtccccggtacccgtaccgttaccccggtacccggttaccgggacccgttacccggaacccccgttaccggaaccggtacccgtaccggtaacccgacccggg

SEQ ID NO: 72294 - DNA, 767 bp, Homo sapiens
  misc_feature: GYAE6OF02F3CT8.21.26.C04.1.454.CMB.1.raw
  modified_base (334)..(334): a, c, t, g, unknown or other
  misc_feature (334)..(334): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactcgcagtgggtgtgggctggactccgtcacggccccccggaaaggccccggagtggcttgcactctatttacttggatgatagactaaccactacacgcctatctctggacggacacggctccacccncgaacgaacgaccgaccgaaccaaaaccgaggttcgtacctaaccacttacgaacctaacacgtaccggaccccagtacggacctaacgacgtacccaactaactaaccttacgtacgttcgacaaccgggacgggtaggttcggtcgggttagggtccgggtacggggtaaccgttacggtccgggggtaccggtacggggtaaccgttcccggttaccgggttacccgacccggtttcccgtaccccgtacggtacccgaccccgttaccccgaacccggtaaccggccccgttaaccgttccccgggttccccgttacccccggtcccggggtcccgttacccggtcccgtacccggtacccgggtaacggtcccggaccccgttacccggtaccggttaaccgggaccacccggtacccgtacccgggg

SEQ ID NO: 72295 - DNA, 791 bp, Homo sapiens
  misc_feature: GYAE6OF02IH8HE.21.26.C04.1.454.CMB.1.raw
tcagtcgtcgctcgcacgaccggtgctcgatttagtctagcgactttgggttggggggaagaggaagactgacggtcctgctgctgaccatcccttcatgggtcttgtcccagatcaccttgaaggagtctgggtcccacggctcggtagaaacccacgagacgaccctcacgctgacctgccaccttctcgttcggtttcactcgacgtaccactgcgtaggtgggtcgtcgggtctggactccgtcgaccggacccccggaaaggcccggtagtcggtcttcgacgtacctgtaacgtttagtacgggaacttgaattcgaaacttacccacgttaccgaaccgtcccgtaatcctacggtacggaacggaaccgtcggaccttacccacccgtaacggaacggtaaaccggaaccaacccgtaaaccgaaaacgtcggtaccgtaacctaaacgaccgtacgaacctaacgcgtaccgtaaccacgtacgactaccgacgaccactaacgtctacgcgtacgacgtacggaacgggtgtacggtcggtgggtaacggtcgggtaaccgtcggaccggggtacgtaaccgggtcgttaacccggtcggtacccgttaccgtccgttaccgtcccggtaacgtcccgtacccgtaaaccggtaaccgggtacctaccgggttcccgtacccccggtcccggtacgggtccctacccggtcggtaccccgtacggtaaccgggacctacccggtaacccgccgtaacgggactacccgtacggtccccggg

SEQ ID NO: 72296 - DNA, 741 bp, Homo sapiens
  misc_feature: GYAE6OF02F8E6M.21.26.C04.1.454.CMB.1.raw
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (356)..(356): a, c, t, g, unknown or other
  misc_feature (356)..(356): n is a, c, g, or t
  modified_base (609)..(609): a, c, t, g, unknown or other
  misc_feature (609)..(609): n is a, c, g, or t
  modified_base (619)..(619): a, c, t, g, unknown or other
  misc_feature (619)..(619): n is a, c, g, or t
  modified_base (626)..(626): a, c, t, g, unknown or other
  misc_feature (626)..(626): n is a, c, g, or t
  modified_base (709)..(709): a, c, t, g, unknown or other
  misc_feature (709)..(709): n is a, c, g, or t
tcagtcgtcgctcgcacgaccggtgctcgatttagtctagcgactttgggtttggggggaagaggaagactgacggtcctgctgctgaccatcccttcactgggtcttgtcccagatcaccttgaaggtagtctggtcccacgctggtcgaaacccacagagaccctcacggctgacctgctaccttctcgttggtttcactcgagtaccactgcaggtgggtgtggtcgtggacgtcccgtcaccggaccccccggaaaggccccggagtggtcctacgcctactcgtagttttanacggtaatgatacgaactaacctacgtaccncgtacctatccgtacgtacgacggaccncggaccttaccgacccgtacgaacggtaacggaccaacccgaaccctaaaacggtccgggtaaccgttaccccgtaaagaccgtaaccggtacccaaagtaccggtaacccggtacccctaagtaccggaaccaacgttaccgaaccctaaacttcgtaaactccgtagtacgaccgaacgggtacgggtaagtcggtacggttcggtaacggtacggtactacgggtcggacggagtccgtcgcggtaaccnccgtcgtacnccgtacncccgaccgtaacgcgccgtaacgttccggtaccctcggtccgtcccgtaaccgtccgtacggcccggttaacgccgttacccnccggttacgaacggtcccagtcccgtaccggg

SEQ ID NO: 72297 - DNA, 756 bp, Homo sapiens
  misc_feature: GYAE6OF02JHW3S.21.26.C04.1.454.CMB.1.raw
  modified_base (127)..(127): a, c, t, g, unknown or other
  misc_feature (127)..(127): n is a, c, g, or t
tcagtcgtcgctcgcacgaccggtgctcgatttagtctagcgactttgggtttgggggaagaggaagactgacggtcctgctgctgaccatcccttcatgggtcttgtcccagatcaccttgaaggngtctggtcccacgctggtacgaaacccacagacgaccctcacggtctgacctgctaccttctcttggtttcactcacgtaccactgcgtaggtgggtcgtcgggtctaggtactccgtcaccggaccccccggaaacgggccccggaggtcggccttcgcctacttcgtatttacgtacggtaagtgaatagaactaaccacctacgacctccctatccgtacgtacggaacggtaccgtacgtccttaccgacccttacgaaaccggtaacgaccaacccgtaaccgaaaaccgtggtcctaaaccaacgactaccgaaccaacgtacgtaccgacccgtagacgactcaacgaccaactactaacgtccgtagtcgaccgacggtaacgggtagttcgggagttgggtaggtacgggtaccgtacgggtacgggtaccgtacggtacggtaccgtccgggtccgtacccgttccgtacctaccgccgtacccgtaacccgaccgggtaaccgtcccgtacgttcccggttaccccgtcccggtacggccccgttaccgtacgtcccgtaaccggtaacgaccgtccggaaccccgttacgaccggttacgacccgtacgtacccggg

SEQ ID NO: 72298 - DNA, 713 bp, Homo sapiens
  misc_feature: GYAE6OF02F9B5U.21.26.C04.1.454.CMB.1.raw
  modified_base (272)..(272): a, c, t, g, unknown or other
  misc_feature (272)..(272): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagtcgtcgctcgcacgaccggtgctcgatttagtctagcgactttgggtttgggggggggaagaggaagactgacggtcctgctgctgaccatcccttcatgggtcttgtcccagatcaccttgaaggagtctggtcccacgctgggtgaaacccacagagaccctcacgctgacctgcaccttctctgggttttcactcagtaccactgcaggtgggtgtgggctggactccgtcacgcccccggaaggccccggagtggcttgcactnatttatgtaatgatagactaaccactaccacgcccatcctacgtgaacggaccgtacggcctaccgaccctaccgaaccggaacggaccaacccgaacccaaaaaccgtaggtaccggtaccctaacctacctaacgaacctaacgacgtaccggaccccgtagtacggaaccacgacacccaataactacgtactgtacacgacgacgggngttggngtggggtagtcgggtacgtaggtaccgggcgtagggtcgttccgtcggtccgacgttcctacgtccgtaccgtccgtacccgacgtaccggaccgtaccgttccggttaccccgttcccggttaccggccggttccccgtaccggttacccgtacccgggaaccggtcccgggtaccgtaaccccgttaccgggaccgtaccggtaccggacctacccggggg

SEQ ID NO: 72299 - DNA, 714 bp, Homo sapiens
  misc_feature: GYAE6OF02G69HD.21.26.C04.1.454.CMB.1.raw
  modified_base (387)..(387): a, c, t, g, unknown or other
  misc_feature (387)..(387): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacggctggtcgaaacccacagagacccctcaccgctgacctgcaccttctcgttgggttttcactcacgtaccactgcaggtggggtgtgggctggactccgtccaccggaccccccggaaacgggcccccgggagtcggtcttcgctactcaattttagttggaatgatgaactaaccactacacgcccatctctggacgacgacgcctaccaccctacgacgaacggaccaccgaaccaaaaaccgnggtcgtaacctaacgactacgaacctaacacgtacgaaccctagacggacacgacacaacatactactgtcacgacgacgggagtcggtcgtggggtgtacgggaacttcgggtcggggaccggtacgggtacgtcccggtgtaccccggtaccgttccctccgtacccacgtaccccgtacccgaaacccgtaaccggggtaccctaaccggttcccgggttaccccgtttcccccggtcgggtcccccggtccgtccgtacccgtacccggtacggaacccgtacccgtccccgaaccggaacgccgtaccggaccgaacccggg

SEQ ID NO: 72300 - DNA, 749 bp, Homo sapiens
  misc_feature: GYAE6OF02HTIK0.21.26.C04.1.454.CMB.1.raw
  modified_base (269)..(269): a, c, t, g, unknown or other
  misc_feature (269)..(269): n is a, c, g, or t
  modified_base (383)..(383): a, c, t, g, unknown or other
  misc_feature (383)..(383): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtagaaacccacagagaccctcacgctgacctgcacctttctcgttgggttttacactcagtaccactgcaggtgggtgtgggctggatccgtcgaccgacccccggaaacggccccggagcgnttacgcactctatttatggaatgatagaactaaccactaacacgaccaatctacgtgaacggacctaggcctccgaccctacgaacgaacggaccaacccgaaaccaaaaccgnggtacgacctaacactacgacaacagtccgaacccagtacgaacacgtacgacctaacatactaacgtgtacgaacgacggaacgggtaagtcgggtaccgtggggtacgggtacgggttaacgtacgggtacggggaccgtaacggggtacgttacccgtacggttaccgtaccggttcctaccccgtacgacccgtacccgacccgtaaaccggtaaccgggtccccaaacggtttcccggtacccccgtttaccccgggtaccggaaccccggtccccggtacccggcccggtaacccgtaccgggacgtaaccccgtaccccggtaccggaaccggaacggtacccgtacggaaccccgggg

SEQ ID NO: 72301 - DNA, 656 bp, Homo sapiens
  misc_feature: GYAE6OF02FIPB3.21.26.C04.1.454.CMB.1.raw
  modified_base (304)..(304): a, c, t, g, unknown or other
  misc_feature (304)..(304): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcacccttgaaggagtctggtcccacggctgggtgaaacccacagagaccctcacgctgacctgcaccttctctgggtttcactcagtaccactgcagtgggtgtgggctgatccgtcacggccccccggaaaggtccccggatggcttgcactcatttatggatgatgataacatacagtccatctntgacgaccaggctcaccctacagtaagcaacgaccaaaaacgcggtgacctaacactaggaccaatacgcggacccatggaacctacacgcctaacgattaccgactgtacacgtacgacgggagtggcgtgggtagagggacttacggtcggggccctaagggtaccgttaccgtggtaccgtaccgttcgtacccgtcgaccgaccgttccgaaccgtacgggaccctaccgtccggttcccgttacccccgtgggtacccgccccggttacggcccgtacccggttacggtaccggacccttaccccgggtaacccgttacgggaaccgtcggtaaacccgtaccgggg

SEQ ID NO: 72302 - DNA, 842 bp, Homo sapiens
  misc_feature: GYAE6OF02JO3AL.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggtttctactcacgtacactgcgagtgggtggtggcgtggtacgtccgtccgacggacccccccgggaaacgggaccccgggacggtcggtccgttagccgtaccttaccttaacgttttagttagggtaaataggtaacgtagtactaacccgtaacctaacacgcctactcgtcgtacggacggtaccacggtacctaccctaccctacgaaccgaacggaaccgaccgaaaccgaaaaccgtacggtacgtacctaaacgaacgtacgaaaccctaacacgttaccgaacccgtaacgacggaaccaactaccgaccgaacctactaaccgtaactcgtacgaaccgaccggtacgggtacgggttcggacggttacgggggttaggtaccgggtaacggtacgggtccggggtaccgggtaagggtcccggtttacggtacccgggtacccgtcccggtttaccgtacccgtaccggtaaccgtccccgttaacccgaaccccgggtaaaccggtcccgtaaacccgggttccccggttccccgttaccccggtcggtaccccggcccttacccggcggttaacccgaacccgtcccggaaccgtaccccgtaaccggaccggtaccgtaccggaaccgtacccccgggg

SEQ ID NO: 72303 - DNA, 872 bp, Homo sapiens
  misc_feature: GYAE6OF02FN165.21.26.C04.1.454.CMB.1.raw
  modified_base (375)..(375): a, c, t, g, unknown or other
  misc_feature (375)..(375): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctcgtgggttttcactcagtaccactgcaggtgggtgtgggctggactccgtcacggaccccccggaaaggccccggagtcggtctcgcactctatttatgaactgatgactaccactacacgcccatctcgtcggacggtaccgaggtcctccacccgtacgacggaacggacaacccgaaccaaaaccgnggttacgtaccgtaacacgtacgaaccaagtacgtccggtaaccccaggttacgaccgtaacgaccgaccgaactaacgtttaaccgtacgttcggtaccgaccggtaaaccggaaccggggtacgggttacgggtaccgggttacgggggttaccgggttaccggggtaacccggttaacccggggttacgggggaccccgggttaacgggggtaccggttaccccgggttaccgggttacccggttaccccggttacccgtttacccggtaacccgtccgggttaaccccgttaaccccggaacccggtaaacccggggtacccccgtaagggtttcccccggttaccccggtttccccccgggttacgggtacccccggtccccggttaccggtaccccggtaaccccgggtaacgggtaacccccggtacccggttaaccccggacccgggtttaaccggacccggtacccggtaccccgggaacccccgggg

SEQ ID NO: 72304 - DNA, 759 bp, Homo sapiens
  misc_feature: GYAE6OF02F0VJX.21.26.C04.1.454.CMB.1.raw
  modified_base (223)..(223): a, c, t, g, unknown or other
  misc_feature (223)..(223): n is a, c, g, or t
  modified_base (228)..(228): a, c, t, g, unknown or other
  misc_feature (228)..(228): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagacgaccctcacgctcgacctgcaccttctcttgggtttcactcagtaccactgcaggtgggtggngggtntggatccgtcaccggccccccgggaaagggccccggagtcggccttcgcactcgtatttagttaggaatggatgaactaaccactacagcccatctcnggacggaccnggctccacctccgagaacgaccaaccgaacccaaaacgcggtacgtacctaacgactaacgaaccgaacaacgtccggaaccccagtcgaaccgacgacacccgaaatacctaactactacggtacgaccgtaacggacgggtacggtagggtcggtaggggtcggtacgggtaccgagggttaccgggacgtaaacggggtcgtaccggtcggtaccggtaccgttcctaccgtccgaccgtaccccgtaccgaaaccggtaccggaccccgttaacggtccccgggtttcccccgttaccccgtaccgggggttacccccgtcccgtacccgggtaccccttaccggggaaccccgttacggtaccccccggtacccgggtacccggaacgggtaccccaccggtacccggaaccccgggg

SEQ ID NO: 72305 - DNA, 756 bp, Homo sapiens
  misc_feature: GYAE6OF02FG7ZI.21.26.C04.1.454.CMB.1.raw
  modified_base (270)..(270): a, c, t, g, unknown or other
  misc_feature (270)..(270): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtccccacgctggtcgaaacccacagacgaccctcacgctgacctgctaccttctcgttgggttttcactcacgtaccactgcagtgggtgtgggctggactcgtcacggcccccggaagcccggagtcgcttgcnctctatttatgaatgatgaactaaccactacacgcctatctcgtaggacgaccgtcggtcctacaccctacgacgaacggaccaaccgaaccgaaaaccgtcggtacggtacctaaacgaccgtacgtaaccaacgtaacgtaccggtaaccccgagtacggaaccaccgtacgacccacgtaacgtaaccgtacgttagcgtaaccgacggaacgggtacggtcggtcggtacggggttacggtacggtacggttaccggtcggggaccgttcggggtaaccgttccgtacggtacccgtacccgttcgtacccgtacgcccgttaccgtacccgtaacccgggtaaccgacccgttccggttacccgtttaccccgttcccccggcggtacccccggttaacccacggttacccttacccgggaaggtacccgtaccccgtaaccggtacccgggaagtcccgggacccaacgggtaccccggg

SEQ ID NO: 72306 - DNA, 729 bp, Homo sapiens
  misc_feature: GYAE6OF02GOVI9.21.26.C04.1.454.CMB.1.raw
  modified_base (226)..(226): a, c, t, g, unknown or other
  misc_feature (226)..(226): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagagaccctcacgctgacctgacaccttctcttgggttttcactcagtaccactgcaggtgggtgtgggntggagtccgtcaccgacccccggaaaggccccggagtcggcttacgcactctatttagttggaatggatagaactaaccacgtacacgtcccatctcgtagacggaccgagtacctccacctacgaacgaacggaccaacccgaaccgaaaacgtcggtacgtaccctaaactacgtaccgaacctaacgaacgtaccgggaacccctagtacgggaaccaccgtacgaacccaactacctaaccgtacgtgtacgtaccgaaccggtagggtacgtcgggtacggtaggggtcgtagggtaccgtacggtggggacccagggtaccgtcgtacggtcccgtacgttccgtaccgtacgtacctcccgtaccgaacccgtaccgggtacccacggttaccccgttcccgttccccggtcgggacccgttccccgccggacccgtccggaaccgggtacacccggtaccggtacccgggaaccgcggtaccgacggtccccggg

SEQ ID NO: 72307 - DNA, 690 bp, Homo sapiens
  misc_feature: GYAE6OF02JAY7Q.21.26.C04.1.454.CMB.1.raw
  modified_base (334)..(334): a, c, t, g, unknown or other
  misc_feature (334)..(334): n is a, c, g, or t
  modified_base (491)..(491): a, c, t, g, unknown or other
  misc_feature (491)..(491): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
  modified_base (680)..(680): a, c, t, g, unknown or other
  misc_feature (680)..(680): n is a, c, g, or t
  modified_base (684)..(684): a, c, t, g, unknown or other
  misc_feature (684)..(684): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctgggtgaaacccacagagaccctcacgctgacctgcaccttctcttgggttttcactcagtaccactgcagtgggtgtgggctggactccgtcaccggaccccccggaaacggccccggagtcggcttgcactctatttagtgatgatagaactaaccgactacacgccctatcctcgtggaacggacccgnggcctccaccctacaacggaacgaccaacccgaaccaaaaccgtgggtaccgtacctaaacaccgtacgaaccaaacgtactaccggaccccagtaccggaacaccgacgacccaactaactaaccttacgtacgtacgaccgaaccggaacggggngtacggtcgggttcggggtaggtacgggtaccgtacgggtacggggaccggtacggggtaccgttccggtccgggtaccgtacccgtctacccgtcgtaccgtccctacccgaacccgtacggccctacgtccgttacccttcccggcgtccnccgtcnccgtacgacgaccgaccaccgtccgacgcnccgngtccgg

SEQ ID NO: 72308 - DNA, 722 bp, Homo sapiens
  misc_feature: GYAE6OF02JS1ID.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcacgtaccactgcagtgggtgtgggctcggtatccgtcgacgacccccggaaacggcccggagtcggcttgcactctatttagtaggaactggaatacgactaaaccgactacgacgtccatctctacggacggaccacggacctaccgacccgtacaaccggacgaccgtaaccgaacccaaaacgtcggttacgtaactaacgaccgtacaacctaacgacgtaacggaccctacgacgtaaccgaactaccgccaacgtactaaccgtactcgtacgacgtacgaacgggctaacgggtcgtaggggttcgtaacgggtcgtaacgggcgggtacggacgggtaaccggtcgttaccggtacgtaccgttccgtcccgtacgacgtcccgtaaccacgtacccggtccacggttcccgtcccggttccccaccgggtacctccccggtaccgtcgttaacccgacgggttacccggacccgttaaccggccggaacggtaccgtaccggtaccacccggggg

SEQ ID NO: 72309 - DNA, 636 bp, Homo sapiens
  misc_feature: GYAE6OF02JKAY3.21.26.C04.1.454.CMB.1.raw
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
  modified_base (347)..(347): a, c, t, g, unknown or other
  misc_feature (347)..(347): n is a, c, g, or t
  modified_base (375)..(375): a, c, t, g, unknown or other
  misc_feature (375)..(375): n is a, c, g, or t
  modified_base (467)..(467): a, c, t, g, unknown or other
  misc_feature (467)..(467): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggtttcactcagtaccactgcagtgggtgtgggctggatccgtcacggccccccggaaaggccccggagtggccttgcactcatttatggaatgatgataaccntacagccatcnctggacgaccaggcctcaccctnacgagaccaccgaccaaaacgnggtcgtacctaacgactacgaacctaanacgtcggaccccagtacggaaccacaacgccaacacttaccgtactgtacgacgtaacgacgggtagtcggcgtgggtcggtggacgtacgngggaccgagggacgtccgtcggtaccgtaccgtaccttccgacgtaccgtcccgtaccgaaccgacggacccgtacgtcccggttaccgtccccgtcgggcccgtcccggtccgtccgtccggaacggaccgtacccgacccgtccgaacgacgtaccgacgtacccgg

SEQ ID NO: 72310 - DNA, 756 bp, Homo sapiens
  misc_feature: GYAE6OF02G2YHO.21.26.C04.1.454.CMB.1.raw
  modified_base (353)..(353): a, c, t, g, unknown or other
  misc_feature (353)..(353): n is a, c, g, or t
tcagtcgtcgctcgcacgaccggtgctcgatttagtctagcgactttgggtttggggggaagaggaagactgacggtcctgctgctgaccatcccgttcatgggtcttgtcccagatcaccttgaaggagtctggtcccacgctggtgaacccacagagaccctcacgctcgacctgcaccttctctgggtttacactcagtaccactgcagtggtgtggctggactccgtcacggaccccccgggaaggccccggagtggcttgcactctatttagttgaatgatgactaaccactacacgcccatctctgacgaccaggctcacctcaacgagaccaccgaccaaaaccgnggtacgtacctaaccgactacgaccaactacgtacggacccctagtacggaacacacgccaacgtaactacctacgttacgtcgaccaaccggacggggtacggtacgggtacggttcggggttacgggttacggggtaccgttaccggggttacgggggtacccggtaagggggtacccggtttacccgtcggggtttaccctaacccggttccttacccggtaccgtacccggtacccccttaccgggaaaccccgaaaccggggttcccctacggtttaccccggttcccccgtttaccccggtcccgggtcccgtcccgggtccgtacccggtaccggtaacccggtaccgacccgttaccggtaacccggtagacccggtaccgaacccgtcccgggg

SEQ ID NO: 72311 - DNA, 829 bp, Homo sapiens
  misc_feature: GYAE6OF02GLIPV.21.26.C04.1.454.CMB.1.raw
  modified_base (548)..(548): a, c, t, g, unknown or other
  misc_feature (548)..(548): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtcgtcggtcccacgactggtacgaaacccacagacgaccctcacgctgacctgctaccttctcttggtttcactcacgtaccactgcaggtgggtggtgggctggactccgtacgacccggacccccgggaacggccccggagtcggtcttcgacctactacttattttacgttaggtaacttggtaatacggtaaactaaacccaactaaccgtaccgaccctattccttaccgtaggaaccggtaccgacggtccctaccccacccgtaccgtaaccggaaccggtaacccgaaacccgaaacccgaaaaccggtacggttaccggtaaccctaaacctaaccgtaccgaaaccctaacgtacgtacccggtaaccccgagtaccggaaccaacgacaccctaactactacttacgngtcgacacgggtagggacgtcggtgtggggtacggtacggtacgtacggggcgggtacggtacggtccgtaccgtcggtaacctaccggttcctaccgtaccgtaccgtaccccttaccggaacccgttaacggaccgttaaccgttccccggttacccgttccccgggtcggtacccccgttacccggttccgacccggttacccggacggttaaccccggaccccgtaacccggttacccgggtaaccacccggtttaacgaaccccgggtaccccggg

SEQ ID NO: 72312 - DNA, 781 bp, Homo sapiens
  misc_feature: GYAE6OF02GGLZA.21.26.C04.1.454.CMB.1.raw
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccagctggtcgaaacccacagacgacctcacgctgacctgcaccttctcttggttttcactcagtacctactgcgtagtgggtgtgggctggacgtccgtcaccggacccccggtaacggccccgagtcggctgcactctattagtgaatgatgactacactacacgccatctctaggacgcagcctccaccgtacacgacggaccaccgaaccaaacgcgtacgactaaccgctacaccaatacgaccgacccgtagtacgaaccgaaccacgtacccaaagttactaaccgtacgttcgacggtaaccgaacgggtaaccgggtaaacggtcgggttaccgggtgggggttaaccgggtcggggttaaccgtaccggggtggggaaccccgggttacggggttaccgggtccgttaaacggtccccgtaccggttcccgtcccgttagaccccgttccccgttaacccgggaaccctaccccgggggtaacccctttacccgggttccccgggtcccccgttacccccgggtacggggtcccccctcccgggtttacccggacccgtacgggtacccgtaacccggccccgtttaacccgacccgggttaaccgaacccggtaccctccggggtaccccggg

SEQ ID NO: 72313 - DNA, 647 bp, Homo sapiens
  misc_feature: GYAE6OF02F3QKI.21.26.C04.1.454.CMB.1.raw
  modified_base (318)..(318): a, c, t, g, unknown or other
  misc_feature (318)..(318): n is a, c, g, or t
  modified_base (357)..(357): a, c, t, g, unknown or other
  misc_feature (357)..(357): n is a, c, g, or t
  modified_base (569)..(569): a, c, t, g, unknown or other
  misc_feature (569)..(569): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtggtgtgggctggatccgtcacgcccccggaaaggccccggagtggcttgcactcatttatggaatgatgaataaccactacagcccatctctgacggaccaggccncacccacaacggaacggaccaacccgaaccaaaaaccgnggtacggtacctaaacactcgaaccaacacgtcggaaccccagtacgaacaacgacgccaacactactactgtacgcacgacggggagtcgggcgtgggtgtcggaacgtacggtcgggaccgaggggtacctccgtacgggtccaccgttcctccgtcgaccgccctaccgaacccgtaccgggccctaacgtccgttacccgttccccgngggtccccgtcccgtcggccctaccggacgggactacccgtacccgtaccggtacggaaccgtacccgacgacccggg

SEQ ID NO: 72314 - DNA, 654 bp, Homo sapiens
  misc_feature: GYAE6OF02GZF0Z.21.26.C04.1.454.CMB.1.raw
  modified_base (307)..(307): a, c, t, g, unknown or other
  misc_feature (307)..(307): n is a, c, g, or t
  modified_base (383)..(383): a, c, t, g, unknown or other
  misc_feature (383)..(383): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctgggtcccacgcctggtgaaacccacagagaccctcacgctgacctgcaccttctctgggttttcactcagtaccactgcagtggtgtgggctggatccgtcgacgccccccggaaggccccggagtggcttgcactcatttagtggatgatgactaaccactacagcccatctntcgaggacctaggctccaccctcgacgaacgacacccgaccaaaaccgtggtacgtaccaacactacgaccaaacncgtacggaccccatacggaccaacgacgccaactaactactctggtcgacaacgcgggtagtcggtcgtagggtcggtacggtaccgtacggtcggggccgacgggacgtcccgtcggtaccgacccgttcgtacccgtcgacgtcccgtaccgaacccggtaccggccctacgttaccggttcccttaccccggtggccccgttccccggtaggccccgtacgaccggaccgtacccgccggtaccgacggacgttcccacgtacccggg

SEQ ID NO: 72315 - DNA, 863 bp, Homo sapiens
  misc_feature: GYAE6OF02FXP3J.21.26.C04.1.454.CMB.1.raw
tcagtcgtcgctcgcacgaccggtgctcgatttagtctagcgactttgggtttggggggaagaggaagactgacggtcctgctgctgaccatcccttcactgggttcttgtcccagatccaccgtttgaaggagtcgttggtcccacgcttggtacgaaacccacagagaccctcacgctgacctgcctaccttctcgtgggtttttaccacgtccagtaccacttgcgtaggttcgggtggtagggtcttggtaacgtttcccgtaccgaacccggtaccccccccgggaaacgggtacccccgggaggttcggtaccgttacgcctaactttcctaagttttaccgtggtaattaggacgtagtaaccttaaccgaaccttaccgtaccgcccgtaactttctaccgttacggacggtaaccggtacggtacccttcccgaacccgttaccggaaccgggtaaaaccgtacccgaaacccgtaaaccccggtaaaaaaaccgtcgggtaaccggttaacccctaaaaccgtaccgtaacggaaaccctaaccctaacggtaacccggtaaccccgtagtaccgaacacccgaccgaaccgtactaaacgtacctcgttaccgtacgtacccgtaagccgggtacgggttaccgcggttacggggttacggaccgggtcttaccgggtaaccgggtacgaggggttacccgttccgttccgggtccggtaacccgtttcccgtacttccggaccgtacccgaacccgtcggaaacccggtccctaacgtcccgttacccttcccgtcgcccgtaaccgtcgaccgtacgcgtaaccgtcgacctcgaacgtccacgccgccg

SEQ ID NO: 72316 - DNA, 730 bp, Homo sapiens
  misc_feature: GYAE6OF02JJUMA.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtgaaacccacagagaccctcacgctgacctgcaccttctcttgggtttcactcagtaccactgcagtgggtgtgggctggatccgtcaccggccccccggaaaggccccggagtggcgttgcactctatttagtaggtaatgatcgaactaaccacgtaacacgaccctatcctacgtaggaacggacctacggtccctaccaccccgtacgaaccggtaacggaacccaaccctaaaccgaaaaaccgtcgggtaccggtacctaaacaccgtacgaaaccaacgactccggacccctagtacggacaaccgtacacctaaactacttacgtaacgtcggtacaccgtaaccggtacgggtaggtcggtcggtaggggtcggtaacgggtacctacccggggtgggtacccgagggtacccgttaccgtggtacccgtacccgtccgttacctcgacccgtcccgtaccgaacccggacggtcccttaaccggtcccgttacctccccggtgacccgtccccgtggtccctacccgggactaccgacccgtaccggtaaccgcggaacctccgacgtacccggg

SEQ ID NO: 72317 - DNA, 825 bp, Homo sapiens
  misc_feature: GYAE6OF02IXRYZ.21.26.C04.1.454.CMB.1.raw
  modified_base (132)..(132): a, c, t, g, unknown or other
  misc_feature (132)..(132): n is a, c, g, or t
  modified_base (169)..(169): a, c, t, g, unknown or other
  misc_feature (169)..(169): n is a, c, g, or t
  modified_base (218)..(218): a, c, t, g, unknown or other
  misc_feature (218)..(218): n is a, c, g, or t
  modified_base (269)..(269): a, c, t, g, unknown or other
  misc_feature (269)..(269): n is a, c, g, or t
  modified_base (785)..(785): a, c, t, g, unknown or other
  misc_feature (785)..(785): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggagtcnggtcccacggcctggtgaaacccacagacgaccctanacgctgaccctgcaccttctcttagggttttacacctcagtaccacttnctaggtgggtgtgggtctggactcgtcaccggacccccggaaagtcccggngcggtcttcggacactctagtttagttcgaatgactaggaactaaccaacgtacaccggtacccattctaccgtacggaaccggtaccgaggtccttaccaccctaccgaaggaaaccggaccaaacccggaacccttaaaaacgtacggggtttaaccggcccttaaacgaccgttaccgaaccctaaagtccgaccggtaccccaaagtccgggaaccaaaccggttcaaacccgtctaaagtttaccgaaccgtgtacggacccaacgggaacgggttgtccgggttacggttgggtccgggtaccggtacggttaccgggacgggggttacccgaaggggtacccggttcgttacccgggtcctaacccgggttccaccccggtttacaaccccggtcccttaccgaaaccccgggaccggtttaaaccccgtcgggttaacccgttttccccggtccccggttaaccggccccgtttccccgaaccggttccgaaccggttcccgtaaccnccggttaacccgccgagggtacccacggtaccccgtcggg

SEQ ID NO: 72318 - DNA, 694 bp, Homo sapiens
  misc_feature: GYAE6OF02J0MFZ.21.26.C04.1.454.CMB.1.raw
  modified_base (128)..(128): a, c, t, g, unknown or other
  misc_feature (128)..(128): n is a, c, g, or t
  modified_base (304)..(304): a, c, t, g, unknown or other
  misc_feature (304)..(304): n is a, c, g, or t
  modified_base (479)..(479): a, c, t, g, unknown or other
  misc_feature (479)..(479): n is a, c, g, or t
  modified_base (681)..(681): a, c, t, g, unknown or other
  misc_feature (681)..(681): n is a, c, g, or t
tcagtcgtcgctcgcacgaccggtgctcgatttagtctagcgactttgggtttggggggaagaggaagactgacggtcctgctgctgaccatcccttcatgggtcttgtcccagatcaccttgaaggngtctggtccccacgcctggtcgaaacccacacgaacgcccctcacggctagacctacaccttctcttgggtttcaactcacgtaccactgcaggtgggtcgtgggctggactccgtcacggacccccggaaaggcccggagtcggcttgcactctatttagtggaatcggataganaaccaataccgcacctactctcgtagacggaacctggcctaacctcccgcaagaacggaacccaccgacccaaaaacgtcgggtacgtacctaactaccagaacaactatccgggaacccaggtacggacacacacctaccgaactcttaacgctaggaccaccggagggacggngcggtgggtacgggttggaaccgttcgacggggcccgtaagggccgttaccggtcgggacctcccggcttccgaccgcgttacccgcccgacccgtaaacggtcccgtcgttccgtcccgttcccgtccggaccggttcccgaacgcccgttaccgaaccgggacccgcccgttaaccggcccgtaaacgccgcgaacccgnggttaccccgggg

SEQ ID NO: 72319 - DNA, 726 bp, Homo sapiens
  misc_feature: GYAE6OF02JE6PY.21.26.C04.1.454.CMB.1.raw
  modified_base (370)..(370): a, c, t, g, unknown or other
  misc_feature (370)..(370): n is a, c, g, or t
tcagtcgtcgctcgcacgaccggtgctcgatttagtctagcgactttgggtttgggggggaagaggaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcacggaccccccggaaaggccccggagtggcttcgcactctatttatggaatgatgaactaaccactacacgcccatctcgtgacggaccacggtcctaccacctacgaacgaacggaccaacccgaaccaaaaaccnggtcgtacctaacactacgaaccaactacgtaccggaaccccagtcggaaccacgacgaccacgactactacgtacgtgaccaacggacggggtagtacgggtcggtagggttacggtacggggtaaccttaccgggtacggggacccggtaggggtaccgttccgtacgggtcccaccggttccttacccgtacgaccgtccccttaacccgaacccggtaaccgggacccctacggttcccgggttccccttaccccgtcggggtaccccgtccccgttacggacccgtcccggaacgggaccgtacccgtaccccgttaccgggaacggacccgtacccgaacgtaccccggg

SEQ ID NO: 72320 - DNA, 882 bp, Homo sapiens
  misc_feature: GYAE6OF02FO05Y.21.26.C04.1.454.CMB.1.raw
tcagtcgtcgctcgcacgaccggtgctcgatttagtctagcgactttgggtttggggggaagaggaagactgacggtcctgctgctgaccatcccttcatgggtcttgtcccagatcaccttgaaggagtctggtcccacgctggtcgaaacccacagacgacctcacgctcgacctcgctaccttcttcgttcgggttttcaccgttctacggtacctacgtcgaccgtaggtcgggtcggtcgggtctacgggtacttcccgtaccgaccggtacccccccgggaaagggcccccgggtaggttacggtccgtttacggcctaccgttacctagttttaacgtacggtaacttaggaacgttaggaacttaaaccctacctaacgaccgtaccctacgttcgttcgtacggaacggaccgtaggcccttaccgacccgtagaaccggaacggaccaacccgtaaccgaaaaccgtcggttaccggtacctaaccgaaccgttcgaaaccctaaaccgtcgtaccggtacccctaggtaccggaaccgacgtaccgaccaaccgttactaaccgttcgtaggtacccgcgtaaccggacggggtaacggtcgggtacgttcgggtacgggtcggtaaccgttacgggtccgggacgtacgggtaccggtccttacgggtacccgtccgttacccgtcccgttaccggacccgttacccggtaccccgtaacggtaaaccccgggtcccttaccggttaccccgggttacccctttaccccgggtccggtcccggttaccccggtcggtaccccgaacggtacccggtaccgcccccgttaaccgtcccggtaaccgtacgggtaccccaggtaaccccggg

SEQ ID NO: 72321 - DNA, 135 bp, Homo sapiens
  misc_feature: GYAE6OF01EDXYP.14.35.D02.1.454.CMB.1.raw
  modified_base (129)..(135): a, c, t, g, unknown or other
  misc_feature (129)..(135): n is a, c, g, or t
tcagcgtctagtaccacgaccggtgctcgatttagcacacgatagttgggtttgggcacagcggccctgggctgcctggtcaagactacttccgtactagacgctgagcgggctggcaaggcgcatagnnnnnnn

SEQ ID NO: 72322 - DNA, 130 bp, Homo sapiens
  misc_feature: GYAE6OF01BBIWH.14.35.D02.1.454.CMB.1.raw
  modified_base (130)..(130): a, c, t, g, unknown or other
  misc_feature (130)..(130): n is a, c, g, or t
tcagcgtctagtaccacgaccggtgctcgatttagcacacgatagttgggtttgggcacagcggccctgggctgcctggtcaaggactacttccgtactagacgctgagcgggctggcaaggcgcatagn

SEQ ID NO: 72323 - DNA, 182 bp, Homo sapiens
  misc_feature: GYAE6OF01EPB1S.14.35.D02.1.454.CMB.1.raw
  modified_base (173)..(182): a, c, t, g, unknown or other
  misc_feature (173)..(182): n is a, c, g, or t
tcagcgtctagtaccacgaccggtgctcgatttagcacacgatagttgggtttgggggaagaggaagactgacggtcccccaggagttcaggtgctgggcacagcggccctgggctgcctggtcaaggactacttccgtactagacgctgagcgggctggcaaggcgcatagnnnnnnnnnn

SEQ ID NO: 72324 - DNA, 130 bp, Homo sapiens
  misc_feature: GYAE6OF01EKSE1.14.35.D02.1.454.CMB.1.raw
  modified_base (129)..(130): a, c, t, g, unknown or other
  misc_feature (129)..(130): n is a, c, g, or t
tcagcgtctagtaccacgaccggtgctcgatttagcacacgatagttgggtttggcacagcggccctgggctgcctggtcaaggactacttccgtactagacgctgagcgggctggcaaggcgcatagnn

SEQ ID NO: 72325 - DNA, 552 bp, Homo sapiens
  misc_feature: GYAE6OF01EUFL6.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgaacggcctgagatttgacgacacggccttctattactgtgcgagagaactcgctacgataaatatgcccttgcctcttgactactggggccagggaaccctggtcaccgtctcctcagcctccaccaaggcccatcgtcttcccctggccaccctcctccaacgacgccacctctcggggcaccgacgcggcccgtgggcctcgccctgggtacaaggacttacgttcccgtaaccg

SEQ ID NO: 72326 - DNA, 506 bp, Homo sapiens
  misc_feature: GYAE6OF01DUPAK.14.35.D02.1.454.CMB.1.raw
  modified_base (407)..(407): a, c, t, g, unknown or other
  misc_feature (407)..(407): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggatccggggtcctgagcgattcagtgcagcgggtctgggacagtatttcactttcaccatcagcagcctgcagctgaagntgtgctagtttattactgtcagcaatattatagtacttcctactactttggccgtagggaccaagctaggagatacgaaacgaactgtagctgcactac

SEQ ID NO: 72327 - DNA, 501 bp, Homo sapiens
  misc_feature: GYAE6OF01BYUMS.14.35.D02.1.454.CMB.1.raw
  modified_base (476)..(476): a, c, t, g, unknown or other
  misc_feature (476)..(476): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccgggtcctgagcgattcagtggcagcgggtctgggacagatttcactttcaccatcagcagcctgcaggctgaagatgtggcagtttattactgtcagcatattatatactcctactactttggcctagggaccaagcgtgagntacaaacgaactgtggctgcactac

SEQ ID NO: 72328 - DNA, 568 bp, Homo sapiens
  misc_feature: GYAE6OF01A4P9A.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactacgtgggccacgggaacccgtggtcaccgtctcctcacgcctccaccacgggcccactccggtccttcccccgtcggtccaccctccctccaacgacgccacctccgtcgggggccacgacgccggcccgtcgggcctcggccctggtaccaacggtacctacgttacccg

SEQ ID NO: 72329 - DNA, 580 bp, Homo sapiens
  misc_feature: GYAE6OF01DDTB6.14.35.D02.1.454.CMB.1.raw
  modified_base (342)..(342): a, c, t, g, unknown or other
  misc_feature (342)..(342): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaattacgcacagagattccaagacagactcacgattaccgcggacaaatcacggccacagcctacatggagttgagcggctgagatttgacgacacggccttntattactgtgcgagagaactcgactacgaataaatatcgcccttgcctcttgactacgtcgggccacgggtacctcggtcaccgtcctcctcacgcctaccaccgacggccctacgtccgtccttcccccgtcgtccaccctccctaccctacgacgccaccgtccgtcggggcctacgacggccggccccggtcgggcctcgtcccgtcggtaccaacggtacctaccgttacccgg

SEQ ID NO: 72330 - DNA, 534 bp, Homo sapiens
  misc_feature: GYAE6OF01B54U7.14.35.D02.1.454.CMB.1.raw
  modified_base (238)..(238): a, c, t, g, unknown or other
  misc_feature (238)..(238): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttagcttggtaccaacagaaaccaggacagtctcctaagttgctcattttctggcatctaccggaatccgggtcctgagcgattcagtggcagcgggtctgggacagtatttcactttcaccatcagcagcctgcaggctgaagagtgtgctagtttattactgtcagactaattattatacgttacctccctacgtactttcggccgtaggggaccaaggtcgtaggaacgacgtacgaaaacgtaacgtggtacggactgcctccgtaacg

SEQ ID NO: 72331 - DNA, 551 bp, Homo sapiens
  misc_feature: GYAE6OF01D6580.14.35.D02.1.454.CMB.1.raw
  modified_base (526)..(526): a, c, t, g, unknown or other
  misc_feature (526)..(526): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttcgtattactgtgcgagagaactcgctacgataaatatgcccttgcctcttgactacgtgggcagggaaccctggtcaccgtctcctcacgcctccaccaacggcccatccggtccttcccccgtggtccaccctccctcccagacgccacccgtcgtggggccacgacgcggcccgtgggcngcctggcaacggctaccgttacccg

SEQ ID NO: 72332 - DNA, 523 bp, Homo sapiens
  misc_feature: GYAE6OF01ADHL7.14.35.D02.1.454.CMB.1.raw
  modified_base (469)..(469): a, c, t, g, unknown or other
  misc_feature (469)..(469): n is a, c, g, or t
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacaggcccctagacaagggcttgagtggatgggaagatcatccctattcgtcgtataacaaattacgcacagagattccaagacagactcacgattaccgcggacaaattcacggccacagcctacatggagttgagcggcctgagatttgacgacacggtccttctattactgtgcgaganaactcgctacgattaaatctcgcccttgcccttcttagacctcgtgggtacccg

SEQ ID NO: 72333 - DNA, 547 bp, Homo sapiens
  misc_feature: GYAE6OF01A50O4.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaacaataagaactacttagcttggtaccaacagaaaccaggacagtctcctaagttgctcattttctgggcatctacccgggaatccggggtccctgagcgattcgagtggcagcgggtctgggacagtactttcactttcacctatcagcagcctgcaggctagaagatgtggctagtttattactgtacagtactaattattaatacgttacctacccttactacgttttcggaccgtacggggacccaaggtcgtgggaagtactacaaacgtaactgtacggactcgctaccgtac

SEQ ID NO: 72334 - DNA, 132 bp, Homo sapiens
  misc_feature: GYAE6OF01AQ3M5.14.35.D02.1.454.CMB.1.raw
  modified_base (130)..(132): a, c, t, g, unknown or other
  misc_feature (130)..(132): n is a, c, g, or t
tcagcgtctagtaccacgaccggtgctcgatttagcacacgatagttgggtttgggcacagcggccctgggctgcctggtcaaggactacttccgtactagacgctgagcgggctggcaaggcgcatagnnn

SEQ ID NO: 72335 - DNA, 521 bp, Homo sapiens
  misc_feature: GYAE6OF01B3HUY.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctggcatctacccgggaatccggggtccctgagcgattcagtggcagcgggtctgggacagatttcactttcacctatcagcagcctgcaggctgaagatgtggctagtttattactgtcagacaatattatagtactccctactactttcggcgtacgggaccaagcgtaggagtactacgaaacgactggtacggactgctacctacg

SEQ ID NO: 72336 - DNA, 528 bp, Homo sapiens
  misc_feature: GYAE6OF01AXNUK.14.35.D02.1.454.CMB.1.raw
  modified_base (313)..(313): a, c, t, g, unknown or other
  misc_feature (313)..(313): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaacaataagaactacttagcttaggtaccaacagaaaccaggacagtctcctaagtgctcatttcnggcatctacccggatccggggtccctgagcgtatcagtcggcaggcgggtcgtgggacagtatttcgactttcaccatcagcagcctgcaggctagaagagtggtgactagtttatactgtcagtactaatattatagttactcctaactctttaggacctacgggtaccaaggctaggagtactacgaaacgacgtacgtggactgccacgtac

SEQ ID NO: 72337 - DNA, 564 bp, Homo sapiens
  misc_feature: GYAE6OF01D4NPS.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaagggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgccttgcctctgactacgtgggccagggaaccctggtcaccgtctcctcacgccctccaccaacgggcccacgtccggtccttccccccgtggtccctaccctccctcccaacgcgccacctcgtcggggccacgagccggcccgtgggcctcgtcctcggtacaacggtctacgttacccgg

SEQ ID NO: 72338 - DNA, 541 bp, Homo sapiens
  misc_feature: GYAE6OF01AL42F.14.35.D02.1.454.CMB.1.raw
  modified_base (239)..(239): a, c, t, g, unknown or other
  misc_feature (239)..(239): n is a, c, g, or t
tcagcgtctagtaccacgaccggtgctcgatttagcacacgatagttgggtttgggggaggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttagcttggtaccaacagaaaccaggacagtctcctaagttgctcattttctgggcatctacccgggaatccgggtccctgagcgattcagtggcagcggtctgggacagatttcactttcaccatcagcagcctgcaggctgaagatgtgtcagtttatactgtcagcaatagttatagtacttaccctataccttttggaccgtaggggtaacccaaggtccgtagggtacgtataccgaaaccgtaactcggtacggtacgtacgtcgaccgtacg

SEQ ID NO: 72339 - DNA, 578 bp, Homo sapiens
  misc_feature: GYAE6OF01A5KSG.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactacgtcgggccagggaacccgtcggtcacccgtctcctcacgcctccaccaacggcccacgtccgtccttcccccgtcggccaccctcctaccacgacgccacctccgtcggggccacgacggccggcccgtcggggccttacggccgttacgggtacccaacgggtcctacccgtacccgg

SEQ ID NO: 72340 - DNA, 626 bp, Homo sapiens
  misc_feature: GYAE6OF01CFAF8.14.35.D02.1.454.CMB.1.raw
  modified_base (367)..(367): a, c, t, g, unknown or other
  misc_feature (367)..(367): n is a, c, g, or t
tcagcgtctagtaccacgaccggtgctcgatttagcacacgatagttgggtttgggcacggtgggcatgtgtgagttttgtcacaagatttgggctcaactctcttgtccagctggtgcagtctggggctgaggtgaagaagcctgggtcctcggtgaaggtctcctgcaaggtttctggaggcacgttcgacacctacactatcaacgtgggtgcgacaggcccctggacaagggcttgagtggatgggaaggatcatccctattcgtacgtataacaaattacgcacagagattccaagacagactcacgattaccgcggaacaaattccacggccacagcctacatggagttgagcggctgagntttgacggacacggcttctattcgtgtcgcgagacgactcgctacgaataaatatcgtcccttgcccttcgttgacctacggtcggggaccacgggaaccccttggtacctacccgttctaccctcgaccgcccctacccgtaacccgaccgggacccctacgttccccggttccccgttaccccccgttcgggacccccttacccccgtccccgtaccccgaacggacccgtaccctcccggttccggtaccgggggg

SEQ ID NO: 72341 - DNA, 580 bp, Homo sapiens
  misc_feature: GYAE6OF01DZCF4.14.35.D02.1.454.CMB.1.raw
tcagcgtctagtaccacgaccggtgctcgatttagcacacgatagttgggtttgggcacggtgggcatgtgtgagttttgtcacaagatttgggctcaactctcttgtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagtatttgacgacacggccttctattactgtgcgagagaactcgactacgataaatactgtcccttgccttcttgaccgttacgtcggggccgaacgggtaaccctggtcctaccgttcctccctcacgccctacccaccgaaccgggccctacgtccgtcccttcccccgtcggccctacccctcccgtacccaacgacgcctccgtcgtaccggggg

SEQ ID NO: 72342 - DNA, 517 bp, Homo sapiens
  misc_feature: GYAE6OF01DKLVJ.14.35.D02.1.454.CMB.1.raw
  modified_base (238)..(238): a, c, t, g, unknown or other
  misc_feature (238)..(238): n is a, c, g, or t
  modified_base (313)..(313): a, c, t, g, unknown or other
  misc_feature (313)..(313): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctacaacaataagaactacttagcttggtaccaacagaaaccaggacagtctcctaagttgctcattttcngggcatctacccgggatcccggggtcctgagcgattcagtggcagcgggtctgggacagtatttcactttcaccatcagcagcctgcaggctgaagatgtgctagtttattactgtcagcaattattatagtacttaccctactactttcggccgagggaccaagcgtaggagatacgaaacgacgtgtacggctcgcactacg

SEQ ID NO: 72343 - DNA, 673 bp, Homo sapiens
  misc_feature: GYAE6OF01ANNEP.14.35.D02.1.454.CMB.1.raw
  modified_base (250)..(250): a, c, t, g, unknown or other
  misc_feature (250)..(250): n is a, c, g, or t
  modified_base (254)..(254): a, c, t, g, unknown or other
  misc_feature (254)..(254): n is a, c, g, or t
  modified_base (435)..(435): a, c, t, g, unknown or other
  misc_feature (435)..(435): n is a, c, g, or t
tcagcgtctagtaccacgaccggtgctcgatttagcacacgatagttgggtttgggggtacgataacaaccagattcctcctctaaagaagacccctgggagcacagctcatcaccatggactggacctggaggttcctctttgtggtggcagcagctacagctgtccagtcccaggtccagctggtgcagtctggggctggaggtgaagaagctgggtcctcggtgaaggtctcctgcgaagggtttcngggnggctacggttcgacaccgtacacgtatcaactgggtcgcgacacgggcccctgggaccaaggggccttaggagtggatgggggaaggatcgagttccctagttccggtcggttaataactaaactttacgactacgaagtaggaacttaccgaaagtacaggtactcgacgtacttaccgnggtaacaacgttaccacggacccaacgagtaccctaacacgtaggagtttcgagtcggacctcggaaggtactttaggacgtaccgaacgggtccttaccgttacgttaacgttcgtaggtcgtaacgacgtaaccgtcggacctacggaacttaagtaacgttacgcccgttaactcccgtacttaccggtaacccttgggttaccgggcccgtaaacggggtcccgttaaccgggg

SEQ ID NO: 72344 - DNA, 506 bp, Homo sapiens
  misc_feature: GYAE6OF01CUZTP.14.35.D02.1.454.CMB.1.raw
  modified_base (238)..(238): a, c, t, g, unknown or other
  misc_feature (238)..(238): n is a, c, g, or t
  modified_base (280)..(280): a, c, t, g, unknown or other
  misc_feature (280)..(280): n is a, c, g, or t
  modified_base (479)..(479): a, c, t, g, unknown or other
  misc_feature (479)..(479): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctaccaacaaataagaactacttaagcttggtaccaanaagaaaccaggacagtctcctaagttgctcattttctggcatctacccgggaatccggggtccctgagcgattcagtggcagcggtctgggacagattcacttcacatcagcagcctgcaggctgaagatgtcggctagtttattactgtcagacaatattatagtactccctatactttgcagggacaagcgtagganatacaaacgactagtggatgcactacg

SEQ ID NO: 72345 - DNA, 528 bp, Homo sapiens
  misc_feature: GYAE6OF01EFX7M.14.35.D02.1.454.CMB.1.raw
  modified_base (314)..(314): a, c, t, g, unknown or other
  misc_feature (314)..(314): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaacaataagaactacttagcttggtaccaacagaaaccaggacagtctcctaagttgctcattttcngggcatctacccgggaatccggggtccctgagcgattcagtgcgagcgggtctgggacagatttcactttcaccatcagcagcctgcaggctagaagatgtggctagtttattactgtcagacaatattatagtactaccctactacgtttcggaccgtaggggaacctaaggctaggagtactaccaaacgaactggtagactcgcaccgtac

SEQ ID NO: 72346 - DNA, 603 bp, Homo sapiens
  misc_feature: GYAE6OF01AE0A8.14.35.D02.1.454.CMB.1.raw
  modified_base (251)..(251): a, c, t, g, unknown or other
  misc_feature (251)..(251): n is a, c, g, or t
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagccgtgggtcctcggtgaaggtctcctgctaaggtttcnggaggccacgttcgacacctacactatcaactgggtgcgacaggcccctggacaagggcttgagtggagtgggaaggatcaatccctattcgtacgtataaacaattacgcacagacgattcaagacagactacacgacttaccgacgaacaatcacgccacacgcctacataggtagttgacgtcggcctaggtacgtagtttacgaccgtaaccgaccggtaccctttacgtatttacgtggtacgacgtaagaagtaaacctcggtaccgtaacggtaattaaacgttacgttcgtccccgttacgtcccttacgtttaccggaccttacgggtcgggggtaaccccgg

SEQ ID NO: 72347 - DNA, 541 bp, Homo sapiens
  misc_feature: GYAE6OF01ECLEI.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacagctccaacaataagaactacttagcttggtaccaacagaaaccaggacagtctcctaagttgctcattttctgggcatctacccgggaatccggggtccctgagcgattcagtggcagcgggtctggggacagtatttcacttttcaccatcagcagcctgcaggctgaagatgtggcagttttattactgtcagctaaatatttaatacgttaccttcccttactaccgttttggacccgtaggggaccaaggtccgtaggacgtataccgaaacgaacgtggtaggactgcctactacg

SEQ ID NO: 72348 - DNA, 720 bp, Homo sapiens
  misc_feature: GYAE6OF01BGFKL.14.35.D02.1.454.CMB.1.raw
  modified_base (252)..(252): a, c, t, g, unknown or other
  misc_feature (252)..(252): n is a, c, g, or t
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacggggacatcgtgatcgacccagtcctccagacctcccgtggctgtcgtctcgtgggcgaggacggcccaccatacaactgacaacgtccagccagtagttgttttanacagcctaccaaacaataaacgaacttacttagtcttacggtaaccaacaacgaaaccaggacagtctactaagtnctctatttcgnggctactccgtaccgggacgtccggggtacctggacgcgtattcgaggtcggacgtacggtcgggtacgtggggactaggttactttacctaccgtttaccaacctagtaccgacgtaccgtaccgtccgtacggaccgtacggtaccgtaaggtaacgtaggttcgggtaggtaccgtttaaggtttacgttacggtacgttacgaagtaaccgttaatttaacgtttaacgttaaccgttacccttaaccccttaacgtttacggtttacccgggaaccggttaaccgggaaccgtaacggtaccggttagggaaccgtaacgtaaacccgtaaaccggtacgtacggtacggtacctacggtacccgtaaccgttacg

SEQ ID NO: 72349 - DNA, 579 bp, Homo sapiens
  misc_feature: GYAE6OF01EOAL1.14.35.D02.1.454.CMB.1.raw
  modified_base (311)..(311): a, c, t, g, unknown or other
  misc_feature (311)..(311): n is a, c, g, or t
  modified_base (525)..(525): a, c, t, g, unknown or other
  misc_feature (525)..(525): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggttttctggaggcacgttcgacacctacactatcaactgggtgcgacacggcccctggacaagggcttggagtggatgggaaggatcatccctattcgtcgtaataacaaattacgcacagagattaccaagacagactcacgattaccgcggacaaattcacggccacagcctanatggagttgagcggcctgagatttgacgacacggccttctattactgtgcgagagaactcgctacgaataaatatgcccttgccctcttgactacgtggggccagggaaccctggtcctaccgtctcctcacgcctccaccgaacggcccagtccgtccttcccccgtggccctaccctccctccaacgacgcctaccctcgtcggggccacgnggccggcccgtgggcctcggcctacggtaccgaacggtcctacgttaacccggg

SEQ ID NO: 72350 - DNA, 637 bp, Homo sapiens
  misc_feature: GYAE6OF01C03T1.14.35.D02.1.454.CMB.1.raw
  modified_base (240)..(240): a, c, t, g, unknown or other
  misc_feature (240)..(240): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanacagctaccaaacaataaagaactacttagcttaggtaaccaacaacgaaaaccaggacagtcctacctaagttcgctactattttcgtgggctacgtccgtaaccccgggtaacgtccccgggggtccctaggacgtcgtacgttcgaggtcggcaggtcgggtcgtagagacactactttacacttctaccaccatcagcacgcctgccgaggctagaagtagtcggtacgtactagttttaacttacgtagtaccaaacgtagtactaatttaacttaaccttaccgttacccgttaaccgttaccgttttcgggaacccgtaacgggggtaaccctaaggtccggtaggaacgtactacggaaacggtacgtaacgttcggcggtcctaacgg

SEQ ID NO: 72351 - DNA, 555 bp, Homo sapiens
  misc_feature: GYAE6OF01AL4EI.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagtatttcactttcacctatcagcagcctgcaggctagaagatgtggctagtttattactgtacagactaagtattatacgttacctacccttacttacgttttacggccgtacggggaaccctaaggtcgtaggacgtactaaccgaaaacgtacttaggtacggtactcgacctaccgtacg

SEQ ID NO: 72352 - DNA, 691 bp, Homo sapiens
  misc_feature: GYAE6OF01AV6SW.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacggggacatcgtgatgacccagtctccagactccctggctgtgtctcgtgggcgaggacgggccaccatcaactgacaagtccagccaggtagttgttttatacagtctaccaaactaataagaacttacttagcttacggtaaccaacaacgaaaccaggaaccacgttctcctaaagttcgactctattttcgtgggctactccgtaacccgggtaacgtcccggggtccctggacgtcgtattcgaggtggactacggtcgggtcgtacgggactaggtactttacctacttttaccaactacttcgacgtcgacgtcccgtgacgacggtacgtagaagtagtggtcggtacttaggtttatttacgtcgttacgtacgtactaaagttactttaacgtaccgttaacttaccccgttaacttaccggttttaccggaccggtacggggtaacccgtaaacggtccggtaagggtaacgtaaacgttaaccgtaaaacggtaaccgttacggtacggtaccgtacgaccgtaccgttaaccgg

SEQ ID NO: 72353 - DNA, 636 bp, Homo sapiens
  misc_feature: GYAE6OF01BD47S.14.35.D02.1.454.CMB.1.raw
  modified_base (239)..(239): a, c, t, g, unknown or other
  misc_feature (239)..(239): n is a, c, g, or t
tcagcgtctagtaccacgaccggtgctcgatttagcacacgatagttgggtttggggacataacaaccagattcctcctctaaagaagcccctgggagcacagctcatcaccatggactggacctggaggttcctctttgtggtggcagcagctacagctgtccagtccaggtccagctggtgcagtctggggctgaggtgaagagcctgggtcctcggtgaggtctctgcaggtttcnggagcacgttcgacacctacactatcaacgtgggtcgacgacgacggccccgtggacaagggcttgagtggagtgggaagatcatacccgtattcgtacgtaataacaattacgacaacgagagacttacaaggaccagtacctagtacgaacgttaccgacggtaactaaacttcgaaccggccctaacgacgacctaacgtaacgtagggtacgttaggacgaccgggtacctagtaagtacgtttacggaaccggtaccgtaccggttccttacttaagttacccgtggttacgacggaacgtacgaacgtccgaacgtacgtaactaaagtcgtacggttcccttacgtccttacgtacgtactacggtagggacccgtaggacccgttacgg

SEQ ID NO: 72354 - DNA, 175 bp, Homo sapiens
  misc_feature: GYAE6OF01D4SY3.14.35.D02.1.454.CMB.1.raw
  modified_base (173)..(175): a, c, t, g, unknown or other
  misc_feature (173)..(175): n is a, c, g, or t
tcagcgtctagtaccacgaccggtgctcgatttagcacacgatagttgggtttgggggaagaggaagactgacggtcccccaggagttcaggtgctgggcacagcggccctgggctgcctggtcaaggactacttccgtactagacgctgagcgggctggcaaggcgcatagnnn

SEQ ID NO: 72355 - DNA, 561 bp, Homo sapiens
  misc_feature: GYAE6OF01AQXVI.14.35.D02.1.454.CMB.1.raw
  modified_base (239)..(239): a, c, t, g, unknown or other
  misc_feature (239)..(239): n is a, c, g, or t
  modified_base (321)..(321): a, c, t, g, unknown or other
  misc_feature (321)..(321): n is a, c, g, or t
  modified_base (533)..(533): a, c, t, g, unknown or other
  misc_feature (533)..(533): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttanacagctaccaaacaataagaactacttagcttaggtaccaacagaaaccaggacagtctacctaagttcgctctattttcgngggactatccgtaacccgggtaactcccggggtccctgagcgtattcgagtggacaggtcgggtcgtaggggactagtactttccactttcacctatcagcacgcctgcgaggctaggaagtagtgtgtactagtttacttactagtctagactaatattaatacgttacctacctactacgtttcggaccgtaggaccagtcgtaggatanacgaacgacgtcgtagctcgactctacg

SEQ ID NO: 72356 - DNA, 698 bp, Homo sapiens
  misc_feature: GYAE6OF01D5DXC.14.35.D02.1.454.CMB.1.raw
  modified_base (238)..(238): a, c, t, g, unknown or other
  misc_feature (238)..(238): n is a, c, g, or t
  modified_base (282)..(282): a, c, t, g, unknown or other
  misc_feature (282)..(282): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagaggccaccatcaactgcaagtccagccagagtgttttanacagctacaaacaataaagaactacttacgcttaggtaccaaanacgaaaccaggacagtcctactaagttcgctctattttcgtgggcatccgtaacccgggaatcccggggtccctgacgcgtagttcgagtggcaggcgggtctgggactagtacttcacgtttcacctactactacgcacgccgtagacgaggtacgtagtaacgtagttcggtaggtacgttaaggttttaacgtttaacgttaggtacctaaggtaaccgttaaagtttaacgtttaaacgtttaaacggttaacccgtttaaccccgttaaccgtttaaccgtttttacgggaacccgtaaacgggggtaaacccgtaaacggtaccgtaagggtaacggtaaacgtaaacccgtaaaaaccggtaaaccgttacggttacggtacccttacggacccgtaacccgttaaccg

SEQ ID NO: 72357 - DNA, 557 bp, Homo sapiens
  misc_feature: GYAE6OF01EDZUY.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgacgatttgacgacacggccttctattactgtgcgtagagtaactcgctaacgataaatatgtcccttgtcctcttgacttacgtcgggacgagggaacctcggtcaccgtctcctcacgcctccacaacggcccactcggtccttccccgtggcctaccctcctccacgacgcacctcgtcgggctcgagcccggtccgtcggctcgtccgtggtaccaggactcgttaccgg

SEQ ID NO: 72358 - DNA, 581 bp, Homo sapiens
  misc_feature: GYAE6OF01DNHQL.14.35.D02.1.454.CMB.1.raw
  modified_base (379)..(379): a, c, t, g, unknown or other
  misc_feature (379)..(379): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaaacaataaagaactaacttagcttaggtaccaacaagaaaccaggacagtctcctaagttgctctattttcgtgggcagtcctacccgggtaactcccggggtccctgagcgattcagtggcagcggtgngggacagtatttcactttcaccatcagcagcctgcaggctgaagtgtgtggactagtttacttactgtacagtctaagttattactacgttaccttacccttactacgttttcggaccgaaggggtacccaaggtccgttagggaacgtacgtaacgtaaaaccgaacgttcgggtacggtctacggaccctaccgttaacg

SEQ ID NO: 72359 - DNA, 554 bp, Homo sapiens
  misc_feature: GYAE6OF01B1WYX.14.35.D02.1.454.CMB.1.raw
  modified_base (251)..(251): a, c, t, g, unknown or other
  misc_feature (251)..(251): n is a, c, g, or t
tcagcgtctagtaccacgaccggtgctcgatttagcacacgatagttaggtttgggggcatcacataacaaccagattcctcctctaaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgctaaggtttcnggagcacgttcgacacctacactatcaactggtgcgacacggcccctggacaagggcttgagtggagtgggaagatcactcctattcgtcgtataacaaattacgcacagagattaccaagacagactcacgtataccgcgaacaattcacggccacagcctacatggagttgagcggctgagtagtttgaccgactacggtccctttacttattacgtgtgacgagacgtaacctcgacctaacgtaattaaagtactcgtcccttcgtcccttcttagaccttacggtcggggtaacccgg

SEQ ID NO: 72360 - DNA, 713 bp, Homo sapiens
  misc_feature: GYAE6OF01CPREM.14.35.D02.1.454.CMB.1.raw
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagccgtgggtcctcggtgaaggtctccgtgctaggttctggaggcacgttcgacacctacactatcaacgtgggtgcgacacggccctggacaagggcttgagtggagtagggagatcactccctagttcgtcgtaataacaaacttacgacaacgagacgtaactaccaaagtaccagactacgaacgtacgttacccgacgtaactaactccgaaccggaccaacacgtacctacagtagggtagttgacgccgtcgtagagtagttcgaaccgtaccgtaccggtaccctttacgtactttacgtcggtagtaccggtaaacggtacgtaaacccgtcggtaaacccgttaaaaccggttaacgtttaaaaaacgttaaccggtttaccccggtttacccccccgttttaccgggtaacccccccgttttaacggtttaacccggttaaacccccggtttaaccgggggttacccgggggggttaaaacccccccgggg

SEQ ID NO: 72361 - DNA, 650 bp, Homo sapiens
  misc_feature: GYAE6OF01BUGX0.14.35.D02.1.454.CMB.1.raw
  modified_base (241)..(241): a, c, t, g, unknown or other
  misc_feature (241)..(241): n is a, c, g, or t
  modified_base (328)..(328): a, c, t, g, unknown or other
  misc_feature (328)..(328): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggacgagagggccaccatcaactgcaagtccagccagagttgttttanacagctaccaacaataagaactacttagcttaggtaaccaacaagaaacccaggactaggtctaccgtaagttgctactattttcgngggactataccgtacccgggaatccgggtccctggagcgtatcgagtcggcgagtcgggtacgtggacagtactttaccactttcgaacctatcacgacacgtccgtgacgacggtaccgtagtaagacttggtacggtacgtagttttaactacgtacgtacaaggtacttaaagttattaactaacgttaccccttaccttaaccgttaacgtttcgggacccgtaaacggggtaccctaaacgtcggttagggaaacgtactaaacccgaaaacggttaacgttaggttacgggtacgtaccgtacgtaacccgttacg

SEQ ID NO: 72362 - DNA, 598 bp, Homo sapiens
  misc_feature: GYAE6OF01C59BN.14.35.D02.1.454.CMB.1.raw
  modified_base (239)..(239): a, c, t, g, unknown or other
  misc_feature (239)..(239): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccacatcaactgcaagtccagccagagttgttttanacagctaccaaacaataaagaactacttagcttggtaaccaacagaaaccaggacagtcctacctaagttgctctattttcgtggctatccgtaaccgggaactccggggtccctgacgcgattcagtggacaggcgggtctgggactagtactttcctacgtttcactagtcagccagtccctgacaggctaggaagatggtagctagtttattacgtgtcagactaagttattaattacgtaccttaccccgttataccgttttcgggacccgaacggggtaacccaagtccggtaaggtaacggtaacttaacgaaaaccggaacgttggtacggacgttacgcccgtaacgtaac

SEQ ID NO: 72363 - DNA, 776 bp, Homo sapiens
  misc_feature: GYAE6OF01DW3GG.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggagtgggaaggatcatcctatcgtcgtataacaattacgcacagagattaccaagacagactacacgacttaaccgacggactaaacttcacggccacgacgacctacgatcggtagttgaacggccggaccttgagtagtttacggaacgtacgtacggtccctttacttacgtttaactggtcggaccgtaaggacgtaaaccgtccggtacttaaacgaacttaaaagttaactcccggtaccctttcggaccctttacgttacggtaccgttaacgggtacggggacccggtaaccgggtaacccggtcgggtaccgtacccggtccgtacccgttacgacccgtcccgttacccgacccgaaccgggccctaacggttcccggttaccccttccccccggtccggtacccgtaccccccttacccgttaacccgaacgtaaccgtaccgtaccccgtccgggttaccggggaccgaccgtaaccgggccccgggtcccgggtcgggtccgtccgggtaccgtcgggtaaccgtaaccggggttccctaacccggtttaaccccgg

SEQ ID NO: 72364 - DNA, 661 bp, Homo sapiens
  misc_feature: GYAE6OF01EK6UR.14.35.D02.1.454.CMB.1.raw
  modified_base (271)..(271): a, c, t, g, unknown or other
  misc_feature (271)..(271): n is a, c, g, or t
  modified_base (391)..(391): a, c, t, g, unknown or other
  misc_feature (391)..(391): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacacggcccctggacaagggcttgagtggatgggaagatcactcctattcgtcgtaataacaaattacgcacagagattaccaagacagacncacgattaccgcggaacaaattcacggccacacgcctacagtcggagttggagcggcctggagtatttgacgacaccggtccttctattactgtgcgagagactcgctaacgaataaatntcgccttgccttcttcgacttacgtcgggaccacgggtacctcggtcctaccgtcctcctcacgtccctaccaccgacggccccacgttcccggtcccttcccccgtcggaccctaccccttccctacccgaacggtaccgaccctaacccgttccgggtaccggggtacccgaaccgtaaccgggcccgggtccccggttcgggggtccctccgggtcccgttacgggtaaccgaaaccgggttacccgttaacccgtttaaccccggg

SEQ ID NO: 72365 - DNA, 720 bp, Homo sapiens
  misc_feature: GYAE6OF01EXSYT.14.35.D02.1.454.CMB.1.raw
tcagcgtctagtaccacgaccggtgctcgatttagcacacgatagttgggtttgggggagctacaacaggcaggcaggggcagcaagatggtgttgcacgacccaggtcttcatttctctgttgctctggatctctggtgccgtacggggacatcgtgatcgacccagtctccagactccctggctgtgtctcgtgggcgaggacggccaccatcaactgacaagtccagccagtagttagttttacacgacgtacctaaccaaataaactaaacgtaacttacgttacgtaccgttacggaaaccaaacgaaacgaaccgaggtaactacgtacctacgttaaggttcgccttacttacgtttcgacggtactaccgtacccggtaacccgggtacgttcccgggtacctagacgtcgtacgttcgaggtcgacggtacggtcggtcggtacggtactacgttactttactaccgttacctactacgtaccgacgactaccggtccgtcggaacgtacggtacgtaaggtaacgtgttacgggtacgtaagtttacgtttaacgttaccgtgaacgtacttaacttaagttattaaccgttaaccttacccttaccctttacgtaccggttacggaccgggtacggtaaccgtagtccggtaaggacgtaacgtaacccgaaacgttcggtacggtactaccgtacaccgtacgttccg

SEQ ID NO: 72366 - DNA, 701 bp, Homo sapiens
  misc_feature: GYAE6OF01DNWMJ.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaacgtgggtgcgacacggccccgtggacaagggcttgagtggagtgggaaggatcactcccttattcgtacgtataaactaattacgcacagagacttaccaagacagactacacgtacttaccgacggaactaaattccgacggccaacgacgtaccctaacgagtgggtagttggacggtccggtccgtggagtacgtttacggaccgtaaccgtaccggttcctttacttacttacgtgtcgacgagaacgtaactcgactaacaaattaaatgtcgtcccttgtccttgttacgacgttcggtcgggaccgtaacggtacccgtcggtacctacccgttcctcccgtcaccgccctaccgaccgaccggcctacgtccgttcccttccccgtacgtcccctaccccgtcctaccgacgccgaccctaccgtccggtacgggaccaccgaccgggtcccggtccggtcgggacccgttccggtcccggttacggtaacccggaacggttacccgttacgtttaaccccgg

SEQ ID NO: 72367 - DNA, 820 bp, Homo sapiens
  misc_feature: GYAE6OF01DIJ8Y.14.35.D02.1.454.CMB.1.raw
  modified_base (244)..(244): a, c, t, g, unknown or other
  misc_feature (244)..(244): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctcagactccctggctgtgtctcgtgggcgaggacggccaccatcaactgacaacgtccagccagtagttgttttaanacacgctaccaaacaataaacgaacttacgttacgtcgtttacggtaaccaaacaacgaaaaccgaggaactacggttacctaaccgttaaaggtttcgtacctttactttaacgttttttcggtacggggtacccttaacgtttaccccggtaaacccccggggggttaaaccgttcccccggggggtttacccctaggaaccggtaccggttaacgtttacccggtaagggtcgggtaccgtaacgggtcccggggttacggtaccgggggtaactaacggtttaacgttttacccgttaaccgttttacccgaacccgtaacgtaccgaacggtaccgacggtacccgtaggtaccgacgggtaccgtaggaacgtgttcgggtacgtacgtttaagttttacgtacttcgtacgtagtaacttaaagtttacgttaacgttaccgttaccctttacccttacgttaccggtttaccggaacccggtaacgggtaaccctaacgggtccgtaaggaacgtaccgtaaaccgtaaacggtaacgttcggttacgaccgtcgacgtacccttacg

SEQ ID NO: 72368 - DNA, 605 bp, Homo sapiens
  misc_feature: GYAE6OF01CSFHZ.14.35.D02.1.454.CMB.1.raw
  modified_base (335)..(335): a, c, t, g, unknown or other
  misc_feature (335)..(335): n is a, c, g, or t
  modified_base (422)..(422): a, c, t, g, unknown or other
  misc_feature (422)..(422): n is a, c, g, or t
  modified_base (480)..(480): a, c, t, g, unknown or other
  misc_feature (480)..(480): n is a, c, g, or t
tcagcgtctagtaccacgaccggtgctcgatttagcacacgatagttgggtttgggcacggtgggcatgtgtgagttttgtcacaagatttgggctcaactctcttgtccagctggtgcagtctggggctgaggtgaagagcctgggtcctcggtgaaggtctcctgcaaggtttctggaggcacgttcgacacctacactatcaactgggtgcgacacggcccctggacaagggcttgagtggatgggaaggatcactcctagttcgtacgtataactaaattcgcacagagacttcaagacagactcacgataccgcgacaatcacggccacngcctacatggagtgagcggcctgagtattgacgacgacggtcctttcgtattactgtcgcgagagaactcgactaacgaattaaatntcgcccttgcccttactgacttacgcgggccaacgggacccgtggtcctaccgttccnccgtaccgcgaccctcccgaaccgaaaccgggtcccctaacggttcccgttaccccgtttccccgtccggtcccctaccccttcccgtaccgaaccgaccgtccctaccgtccgggtaccggggg

SEQ ID NO: 72369 - DNA, 630 bp, Homo sapiens
  misc_feature: GYAE6OF01BSSHS.14.35.D02.1.454.CMB.1.raw
  modified_base (391)..(391): a, c, t, g, unknown or other
  misc_feature (391)..(391): n is a, c, g, or t
  modified_base (591)..(591): a, c, t, g, unknown or other
  misc_feature (591)..(591): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaagatcatccctattcgtcgtataacaaattacgcacagagattccaagacagactcacgattaccgcggaacaaattcacggccacaacgcctacagtggtagttgaggcgcctgagtagttgacgacgccggtcttactattcgtgtcgcgagagaactcgactaacgaaataaatntcgtcccttgtcccttcgttacgaccgttacggtccggggaccgaaccgggtacccgtcggtacctacccggttcctccctcgtaccgcccttacccgaaccgaaccggtccctacgttcccgttcccttcccccgcgtcccctaccctcctaccgaacgacgcccgtaccgtcggtacgggccacggcggcccggccgngggtcctcgtccgtacggtacaacggtccttcgttaccg

SEQ ID NO: 72370 - DNA, 707 bp, Homo sapiens
  misc_feature: GYAE6OF01AY8I6.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacacggcccctggacaagggcttgagtggagtgggaagatcactccctattcgtcgtaataacaaattacgcacagagattaccaagacagactcacgacttaccgacgaacaattcacggccaacacgcctacagtggtagttggacggccggtcctaggagttacgtttgaaccgacgacggtcccttacttattactggtgacgagtaacgactcgactacgtaataaatagtacgtcccttacgtccttacgttagtacgtacggtacggggaccgaccgggtaaccgtcggtacccgtaccgttcctaccgtaccgacctccctacccgaaccgtacggtcccctaacggttccccgttaccccttcccccgtacggtcccctaccccgttaccctacccgtaacggaccgaccgtacccgttaccggtccggggtaccaccggaccggtcccgggtacccggtcgggtcccgtccggtaccggttacggtaacctaaccggtacccgttaccgttacccggg

SEQ ID NO: 72371 - DNA, 622 bp, Homo sapiens
  misc_feature: GYAE6OF01BLQLY.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaacaataagaactacttagcttggtaccaacagaaaccaggacagtctcctaagttgctctattttctgggcatctacccgggatccggggtccctgacgcgattcaggtggcaggcgggtcgtggggacagtatttcactttccacctatcagcagcccgtgcgtacggctaggaacgtagtcggtggtcgtaagttttacgttaacgttcgtacgaagtacctaaagtttatttaagttacgttaaccgttacccttaccgttaaccgttttcggacccggtacggggtaacccaaggtccttaagggacgtaacgtaaccgtaaaacccggaacgttcgggtacggtacctacgtaccgtaaccgttaaccg

SEQ ID NO: 72372 - DNA, 821 bp, Homo sapiens
  misc_feature: GYAE6OF01D1MCX.14.35.D02.1.454.CMB.1.raw
  modified_base (248)..(248): a, c, t, g, unknown or other
  misc_feature (248)..(248): n is a, c, g, or t
  modified_base (357)..(357): a, c, t, g, unknown or other
  misc_feature (357)..(357): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacggggacatcgtgatgacccagtctccagacctccctggctgtgtctcgtgggcgaggacgggccaccatcaactgacaagtccagccagtagttgtttttaanacagcctaccaaactaaataaagaaaccttacttagcttacgtaaccaaacgaacgaaaaccaggaacctacgtaccttaccttaagttcgaccttcttaatttttcgngggtcctaacgttccgtaaaccccgggtaacgttccccgggggtccctaggacgtaccgtacgtttaccgagggttcggaccgtacgggtccggggtcgttacgggggaactaacggtttaacttttacccgtaaccgtttttacccaaccttacgttaccgaacggtaccgtaacggtcccttacggacggtaacgggtcgttaacggaaggtacgttgggtacggttaccgtttaaggtttttacgtttacgttacgtaccgtaaggtaactttaagtttaacgtttaaagttaaccgtttaacccttaccccttacgtttaaccggtttttaccgggaccggtaaaccggggtaacccgtaaagggtccggttaagggaaacgttaccgtaaaaccggtaaaaccggttaaacggttacgggtaccgggtacccgtaaccggtaccctaaacccgttaacg

SEQ ID NO: 72373 - DNA, 766 bp, Homo sapiens
  misc_feature: GYAE6OF01BQ0LX.14.35.D02.1.454.CMB.1.raw
  modified_base (243)..(243): a, c, t, g, unknown or other
  misc_feature (243)..(243): n is a, c, g, or t
  modified_base (341)..(341): a, c, t, g, unknown or other
  misc_feature (341)..(341): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgaggagggccaccatcaactgacaagtccagccagagttgttttanacagcctaccaaacaaataacgtaactaacttagacctttaggtaaccaaacaagaaaccaggacagtcctacctaagttcgaccttctacttttcgngggctaactaccgtaccccgggaacgtccccggggtccctggacgcgtattccgagtcggcacgggtcggtcgtgggactagtactttccgtacttttccaacctataccgacgtacgtacgtcccgtggaccgtacgggtaccgtaaggaacgtacggttggtacggtaccgttaaaggtttttactttaacgttcgttacgacgaactttaaagtttaagtttaacttaacggtttaccccttaaccccttaacgtttaacccgttttaccgggtacccgggtaaccggggggtaaaccctaacgggtacccggttaaaggggtaacgttaaaacccggttaaacgtaaaaccccgggtttaaaccgggttacgggtttacgggtaacccgtaccgggtaaaccctaaaccccggtttaaccg

SEQ ID NO: 72374 - DNA, 814 bp, Homo sapiens
  misc_feature: GYAE6OF01CP3FJ.14.35.D02.1.454.CMB.1.raw
  modified_base (279)..(279): a, c, t, g, unknown or other
  misc_feature (279)..(279): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtcgccgtacggggacatcgtgatcgacccagtcctccagtcctccgtggctgtcgtctgtgggcgaggacggcccaccatacaacgtgacgaacgtaccgacgaccaggtacgttacgttttacaacgaccgaccccaaaanaataaaacgtaaccttacgttaagtaccgttacggtaaccaaaccgtaacgaaaaccgacggaacctacgttcccttaccgttaaagttcgtcttacgttactttcggtacggacctaacgttaccccggtaaccccgggtaaccggttccccggggtacctaggtacgtaccgtacgttccggagggttacgggaccgtacgggtaccgggtcggttaacggaacgttacgttacgtttacccgttaccgtttaccgaaccttacgtaccgacgtaccgaccgtccgtacgcgtaaccggtacgtaacggtagtagtacgggttacggttacgtttaacgttttagttacgttacgttaaccgtaacgtattaaactttactttaacggttaacccttaaccccgttaaccctttacggtttaccgttaccgggtaccggtaaaccgggtccgtaaacggtacggttacggtaacgtaacgtaaccgtaaacgttacggttcggtaacgtacgaccgtaccacgttacgttccg

SEQ ID NO: 72375 - DNA, 562 bp, Homo sapiens
  misc_feature: GYAE6OF01ANPC0.14.35.D02.1.454.CMB.1.raw
  modified_base (246)..(246): a, c, t, g, unknown or other
  misc_feature (246)..(246): n is a, c, g, or t
  modified_base (413)..(413): a, c, t, g, unknown or other
  misc_feature (413)..(413): n is a, c, g, or t
  modified_base (492)..(492): a, c, t, g, unknown or other
  misc_feature (492)..(492): n is a, c, g, or t
tcagcgtctagtaccacgaccggtgctcgatttagcacacgatagttaggtttgggggcatcacataacaaccagattcctcctctaaagaagcccctgggagcacagctcatcaccatggactggacctggagttcctctttgtggtggcagcagctacagctgtccagtcccaggtccagctggtgcagtctggggctgaggtgaagagcctgggtcctggtgaaggtctcctgcaaggtttcnggaggcacgttcgacacctacactatcaacgtgggtgcgacaggcccctggacaagggctgagtggatgggaagatcactcctattcgtacgtataactaattacgacacagagtatacaagacagacacacgtacttaccgacgtacaatcacgccacacgcctanagtggagttgacgcggcctaggagtagtttagaccgacgaccggtcttacgtattactaggtgtcgaacgtagtaaccncgtaccgtaacgaattaactattaccgtaccctttcgacccttcttacgccgtacggtcgggtaacccgg

SEQ ID NO: 72376 - DNA, 705 bp, Homo sapiens
  misc_feature: GYAE6OF01AFQW4.14.35.D02.1.454.CMB.1.raw
  modified_base (383)..(383): a, c, t, g, unknown or other
  misc_feature (383)..(383): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaacgtgggtgcgacacggcccctggaccaagggtcttggagttggatggggaagatcctagtccctagttcgtacgtataacaattcgcacgagagacttaccgaagacacgactcacgacttacgacgacaaatcgacgccacgagcctacgagtgagttgcggacgtccgtagagtactttggacacgacggtacttcgtactacgtgtacgngacgtacgaacctcgtactacgtaataaacgtcgacgttcctacgtccttacgttagtaccgttacgcggggacctaaccgggttacccgtcgtacgtaccccgttacttccccgtatcccgtacccgtacccgtaaccggtacccggtcctaaccggtttcccggtaaccccttcccgtacggcccctacccgttctaccgaccgtaacgtccctaaccttcggggacccgggtaccgaactcccggggtacccgtccggtacccgggtctacccgttcccgtacgggaacccgtacgtttaccccgggcctttaaccggg

SEQ ID NO: 72377 - DNA, 700 bp, Homo sapiens
  misc_feature: GYAE6OF01AONTW.14.35.D02.1.454.CMB.1.raw
  modified_base (240)..(240): a, c, t, g, unknown or other
  misc_feature (240)..(240): n is a, c, g, or t
  modified_base (318)..(318): a, c, t, g, unknown or other
  misc_feature (318)..(318): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanacagctaccaacaataagaactacttagcttaggtaccaacaagaaaccaggacagtctactaagtgctctattttcnggctatccgtaccgggtaacgttccgggtcctgtagctactcgagtggcaggcgggtcgtcgggacagtagtttccacgtttaccacctacgtacacgtaccgacgtaccttcgacgtacgggtaccgtaaggtaaacggtagttacgggttcgggtacgtttaacggtttttaacgtttaccgttacggttaacgtaaacggtaaccttaaaagtttaacttttaaacgtaacgtttaacccttaccccttaaccgtttacgttttaccgggacccggttaaacggggtaacccgtaacggtaccgtagggtaacgtaaccgttaaccgaaaaaccgttacggttacggtacggtacccgttacgaacccgtaccgtaacg

SEQ ID NO: 72378 - DNA, 738 bp, Homo sapiens
  misc_feature: GYAE6OF01BRAMA.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacacggcccctggacaagggcttgagtggatgggaagatcatccctattcgtcgtataacaaattacgcacagagattccaagacagactcacgattaccgcggacaattcacggccacacgcctacatggagttgaggcggcctgagatttgacgacacggccttctattactgtgacgagagaactcgtactacgtaaataaattcgtcgtcccttcgtcccttcgttacgtaccgttacgggtccggggacccgtaacccgggtaacccgttcgggtacccgtacccgttcccgttccctcgacccgtccccgtacccgaacccggaccccgggtacccctacggttccccggtttccccttaccccccggtccggtacccccgttaccccttcccccgttaacccgaaccgtacccggtccctaaccccgggttccgggtaccgggggtacccgaccgggtaccgggccccgggtacccggtcccggggtcccgttccggtacccggttacgggaaccggtaaccggttaacccgtttcccgtttaaaccccggg

SEQ ID NO: 72379 - DNA, 745 bp, Homo sapiens
  misc_feature: GYAE6OF01AKSIJ.14.35.D02.1.454.CMB.1.raw
  modified_base (335)..(335): a, c, t, g, unknown or other
  misc_feature (335)..(335): n is a, c, g, or t
tcagcgtctagtaccacgaccggtgctcgatttagcacacgatagttaggtttgggggcgatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagagcctgggtcctcgggtgaaggtctccgtgctaaggttttctggaggccacggttcgacacctacactatcaactggggtcgcgacacggcccctggacaagggcttgagtggagtgggaaggntcatccctattccgtacgttataaactaaattacgcaacagacgtacttccgaaaggacaggactaccgacgtacgtttaacccggcggtaactaaacttccgaaccgggcccaaaccgaacggtaccctaaccgtaggtacggggtaacggtttacgggacggtaccccggggtccgttacgggaagttaacgttttacggggaaacccgtaaccggtaacccggggttacccttttccgttaacgttttaacccggttcggtcggaaccggtaaggtacggtaaacccgtaccggtaaccgttaacggtaaagtttaaaaccgtcgttacccggttccccctttaacggttcccccgtttacgtttaaccggaaccgtttacccgggggtccgggggtaacccccggg

SEQ ID NO: 72380 - DNA, 830 bp, Homo sapiens
  misc_feature: GYAE6OF01EB6AV.14.35.D02.1.454.CMB.1.raw
tcagcgtctagtaccacgaccggtgctcgatttagcacacgatagttgggtttgggggagctacaacaggcagggcaggggcagcaagatggtgttgcagacccaggtcttcatttctctgttgctctggatctctggtgccgtacggggacatcgtgatcgacccagtcctccagacctcccgtggctgtgtctcgtgggcgaggacgggcccaccatacaactcgacaacgtccacgaccgagtagttagttttaactacgacgtacctaccaaaactaaagtaaacgtaaaccttaacttagtaccgttacggtaaccaaacgaaacgaaaccgaggactacgtcctaccgtaagttcgacttcttatttcggacggactacgtaccggtaacccgggtacgttccccgggtctggacgtcgtatacgaggtcggacgacgggtcggtcggtaggacgtagttactttacctaccgtttaccaacgtactaccgacgtccgaacggtcccgtagaaccggtacgggtacgtaaaggtaaacgttcgggttacgggttaacggttacgttttaaacggttttttaacttaccggtttacggtaaaccgtaactttaaaacgttaacgttttaaacgtttaacctttaaaccgtttaacccccgttacccttttaacgggtttacccgttttaccgggggaccccgggaaaaccggggttaacccgtacggtacgggttaaggggttaaccttaaacggttaaaaccccgtaaacggttaaccgggtttcgggacgtacccggttaacgaacccccgttagttaacccg

SEQ ID NO: 72381 - DNA, 620 bp, Homo sapiens
  misc_feature: GYAE6OF01A5DSY.14.35.D02.1.454.CMB.1.raw
  modified_base (242)..(242): a, c, t, g, unknown or other
  misc_feature (242)..(242): n is a, c, g, or t
  modified_base (608)..(608): a, c, t, g, unknown or other
  misc_feature (608)..(608): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtcctccagactccctggctgtgtctcgtgggcgagagggccaccatcaactgcaagtccagccagtagttgttttanacagcctaccaaactaataagaacttactagtcttacgtaaccaacaagaaaccaggacacgtctactaagttcgctctagttttctgggactactcgtaacccggggtaacgtcccgggtacctggtacggcgtacgttacgaggtcggcgaggtcgggtcgtaggggtactagttactttcctacgtttacaacctatcacgcacgctacgcgaggtctaggtaacgtgtcggtcggtactttaagtttacttacgtgtacgtacgtattaagttacttagtaacttaccgtacctacgttacgtttcggacgtacggtactaagtcgtaggactacgtaacgaaaccgtacgtcgtacgtacncgctaccgtacg

SEQ ID NO: 72382 - DNA, 752 bp, Homo sapiens
  misc_feature: GYAE6OF01CJO6W.14.35.D02.1.454.CMB.1.raw
tcagcgtctagtaccacgaccggtgctcgatttagcacacgatagttgggtttgggcacggtgggcatgtgtgagttttgtcacaagatttgggctcaactctcttgtccagctggtgcagtctggggctggaggtgaagaagcctgggtcctcggtgaaggtctcctgcaaggtttctggaggcacgttcgacacctacactatcaacgtggtgcgacacggcccctggacaagggcttagagtggatgggaaggatcgatcctattcgtacgtagtaacaaattacgacacagagataccaagacagactcacgattaccgacggaactaaattccgacggccaactacgaccttaacagtggagtttaggacgccggtaccgtggaagtacgttttacggaaccgtaaccacccgggttacctttacttaacgtttacgttcggttacggacccgtaaggaacggtaaacgttaccggtacccgttaaacggtaaactttaaaactacgttaccgtaaccccgtttacggtcccctttaccggtttacgtaaccgttaaccggttaccgggggtacccggaaaccggggtaaccccgttacgggtaaccccgtacccggttccttacccgttaccacggtacccctacccgtaccgaaccgggtccctacgttccggtacccgttacccccgttcggaccctacccccgtaccctacccgtaacgacgaccctccgtcggtacccgggg

SEQ ID NO: 72383 - DNA, 813 bp, Homo sapiens
  misc_feature: GYAE6OF01AOO5V.14.35.D02.1.454.CMB.1.raw
  modified_base (317)..(317): a, c, t, g, unknown or other
  misc_feature (317)..(317): n is a, c, g, or t
  modified_base (343)..(343): a, c, t, g, unknown or other
  misc_feature (343)..(343): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaacgtgggtgcgacacggcccctggacaagggcttgagtggagtggggaagatcactccctattcgtcgtaataacaattcgcacagagacttacaagacagactacacgtacttaccgcgaactaattcgacggccatacggccctanagtcggagttgagccggtactagganagtttcgacgaccgacggtcctttacgttattaccgtgttacgacgacggaagtaacgtccgacgtaacgtactaaaaattcgtccggttaccctttacgtaccttccgtttagtaaccgttacggtacggggtcccgtaaaccggggtacccggttacgggtaccttacccggttaccgttaccctccgtaccgtaccccgttacccgacccggtaaacccgggtacccctaaccggtttcccgggttacccccgttttacccccgtaccggggtacccccttaaccccccgttcccgttaaccccggaaacctcccgggtacccttacccgggttacccggtaccggggggtaacccctaaccgggacccgggtccccggggtcccggttacccgggggtctcccggggtccccttaccggggttaacccgtaacccgggttaacccgttaccgtttaaacccccggg

SEQ ID NO: 72384 - DNA, 1040 bp, Homo sapiens
  misc_feature: GYAE6OF01DHGX9.14.35.D02.1.454.CMB.1.raw
  modified_base (143)..(143): a, c, t, g, unknown or other
  misc_feature (143)..(143): n is a, c, g, or t
  modified_base (225)..(225): a, c, t, g, unknown or other
  misc_feature (225)..(225): n is a, c, g, or t
tcagcgtctagtaccacgaccggtgctcgatttagcacacgatagttgggtttgggtgcccgaagctgcgtggagggcacggtcaccacgctgctgaggtgaagaagcctgggtcctcggtgaaggtctcctgctaggtttcnggaggcacgttcgacacctacactatacaacgtgggtgcgacgacggcccctggacgaagggtctgagtggagtagggaagntcactccctattccgtacgtaataaacctaaattaccgacaacaaggataactttaccgaaaggacaacggacttacgaacgtaactttacccggacggtaactaaaacgtttccgacccggaccaaccgacgtacccctaataacggttggtaacggtttcgaacggtaccggtacccgttaagggtaacgttacgttttaaccggaccggtaacggtaaccccggggtttacccctttaactttaaaccggttttaacggttaccggggttagtaacccgggaaaacgggttaaaccgtaaaacccggtttaccccgggttaaccgttaaaccgggttaaaaaactttttaaaacaaacccggttttcgttaaccccccggtttttaccggtaccccgtttaccgtttaaccggttaaacccggtttaaacccggggttaccgggggtaaccccgggtaaacggggtaaaccgtttaccccgggttaccggggtttaaccccgtaacccccggtttcccgttacccctttaccccgacggttaccccccgtaaaccccgaaacccggggtaacccccgggttaaccccccgttaaggttttacccccccgggtttaccccccgtttaccccccgggttaccccgtacccccgttaaccccgttcccccgttaaccggaaacccggttacgaacccccgttacccgttacggggacccgggtcccgaacccgaccggggttcccgaccccgggttcggacccgttaccggcccggttaaccggtaccggtaaacggttacccgtttacccccgg

SEQ ID NO: 72385 - DNA, 818 bp, Homo sapiens
  misc_feature: GYAE6OF01DY22Z.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacgggacatcgtgatgacccagtctccagacctccctggctgtcgtctcgtgggcgaggacgggacccaccatcaactgaccaacgtccacgccaggtacgttagttttacacgacgcctaccaaacaataaacgaacttacgttagtctttacggaaccaaacgaacgaaaccgaggactacgttaccttaccgttaaaggttcgtccttacttaacgtttttccggtagggtactacgttacccgtaacccgggtacgttcccggggtcctaggacgcgtacgtcgaggtcgcgaggtcgggtcgtacgggactagttacgtttactaccgtttaccacctactacgacgtacgtacgtaccgtcggacgtaacgggtcgtaaggtaacggtacggtttacgggtacggtttaacgtttaaggtttttacgttttaaccgtaggttaaccgaacgttaaccgttaaacttttaacgtttaaaccggtttaccctttaaacccccgtttaccgtttaacccgttttaaccgggttttacccggggaacccggtaaccgggggtaaacccttacggggtaccgttaaaggggaacgttaaaccgttaaacccggtaaaacggttaaccggttacgggttacggaccccgttacggtaacccgttaaccgttacccg

SEQ ID NO: 72386 - DNA, 946 bp, Homo sapiens
  misc_feature: GYAE6OF01BDU14.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatccaactgcaacgtccagaccgaggtagttgttttaatacagtcctaccaacaaataaagaacttacgttagtcttacggtaaccaaacaacgaaaccgaggaacctagttcctaccgttaagtttcgaccttacgttacttttcgtgggactacgttacccggtaaccccggggtaacggttccccgggggttaccgtcggtacggtacgttacttcggtaacgggtcggtaccgtacgggtccggggttacgtagggggaaccctagggttacctttttacgtacccgttttacccaaccgtaacgttccgaacggtaccgtaaccggtcccgttcggtaacggtaacggggtaccgttaacgggtaaacggttcgggtttacggtaaccgggttaccgttttaacgggttttttaaaccgtttttaccggttaacggttacccggtaaaccggtttaaacctttaaacgttttaaaccgggtttttaaccgttttaaaccccggttttaaacccccgttttaacccccgttttaacccggtttttaaacccgggttttacccgggggtaacccccgggttaaaaccgggggggtaaaccccttaaaccggggttccgggttaaggttaaaacccgggttaaacgttaaaccccgggtaaaaacccgtttaacgggtaccgggggtttacggtaacccggttaccggtaaacccccgttaacgtttacccggg

SEQ ID NO: 72387 - DNA, 651 bp, Homo sapiens
  misc_feature: GYAE6OF01CPECQ.14.35.D02.1.454.CMB.1.raw
  modified_base (141)..(141): a, c, t, g, unknown or other
  misc_feature (141)..(141): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttcnggaggcacgttcgacacctacactatcaactgggtgcgacaggcccctggacaagggcttgagtggatgggaagatcatccctattcgtgtaataacaaattacgcacagagattccaagacagactcacgattaccgcggaacaaatcaggccacagcctacatggatgagcgctgatattgacgacncggtccttntacttactgtgcgagagaactcgtacaacgtaataaacgtatcgaccctttgcctcttgactacgtcgggaccacgggtaacctggtccctaccgtccgtacctcgaccgtccctacccgaaccgaacggcccgacttcccgggtaccccttccccgtccggtcccctaccctccctaaccgacgacgtcccgaaccgttccggtacggggaccctaaccggacccgggacccgggtccccggtacggggcccgttccggtacccggttacgggtaacccgtaacccggtaaccgttccgtttaaccccggg

SEQ ID NO: 72388 - DNA, 677 bp, Homo sapiens
  misc_feature: GYAE6OF01C3ZZ0.14.35.D02.1.454.CMB.1.raw
  modified_base (220)..(220): a, c, t, g, unknown or other
  misc_feature (220)..(220): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacacggcccctggacaagggcttggaggtggagtgggaagntcactcctattcgtacgtaataaacaattacgacacagagatccaagacagactacacgtacttaccgacggaacaaattccgacggaccacacgcctacagtaggagttggacgcggcctaggagtagtttgacgtaccaccggtccttatacttcgtgtcgacggagacgtacgtcgactaacgaattaaatacgtcgtcccttgtcctcgttcgtacgtacggtcgggaccgaacggtaccgtcggtccgtccgtcctcctccgaccgccctaccaccggaacggtccctcggtcccgttcccgttccccgtccgtaccctacccctaccttacccgtacgaccgtcccgtacgtccggtacggggaccgaccgcgggccccgggtcccggtcgggtccccgtcggtcccggttaacggtaccggtaaacggtacccgtttccggttaacccgg

SEQ ID NO: 72389 - DNA, 920 bp, Homo sapiens
  misc_feature: GYAE6OF01CQIDD.14.35.D02.1.454.CMB.1.raw
  modified_base (179)..(179): a, c, t, g, unknown or other
  misc_feature (179)..(179): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctgatctctggtgccgtacgggacatcgtgatcgaccagtcctcagacctcccnggctgtgtctcgtgggcgaggacggaccaccatccaacgtcgacaacgtccgacgaccaggtacgtttagtttaacacgacgtaccttaaccaaactaagttaaacgtaaccgttaacgttacggtacgtttaaccggaaacctaaacgaaccggtaaaacgacgggtaaccttacggttaccgttaacccgtttaaggttcctaccgttaaccttaccggtttttcggacgggtacccttaccgttaacccggggtaccccggggtaccggttccccgggggttaccctaaggtacggccgttaacgttaccggtagggtcgggaaccgtcggtaccggggttcgaacggggtacctacggttaccttttaccgtaacccttaccgaccttaacgtccgtaacgggtaccgtacccggtccgtacgggtacccggtacggttaacggtaaacggacgggttaaccggttcgggttaaccggttacgttttaacggttttacgttaacggttaccgttaacgttaaccggtaacgttaaacgtttaacgtttaaccttaaccggtttaacccctttacccggtttaaccgtttcccgggtttaaccggggaacccggtaaaccggggtaaacccgttacgggtaccgttaaccggggtaactaaacccggttaaaccggtaaaccgttacggtttaccgggtaaccggtaccgtacccggtaaacccgttccggttaaccg

SEQ ID NO: 72390 - DNA, 742 bp, Homo sapiens
  misc_feature: GYAE6OF01AWI0C.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctgatctctggtcgccgtacgggacatcgtgatcgacccagtctccacgacctccgtggtctgtcgtctcgtgggcgaggacggccacctactacaacgtcgaccaacgtccacgtaccgaggttagtttagttttaacacacgtacctaacaaactaaagtaaacgtaacctttaacttacgtaccgtttacggaaaccaacgtaaacgtaaaccgtggaaccgtacgttaccttaaccgttaggttcgtctttacgtttacgttttccgtacgggtacctaccggttacccggtaacccgggtaaccggtccccgggttaccacggtacggtaccttagttacggaggtcggaccgacggggtcggttcggacggtaacgtacgtttactttaccgtactttacccgactcgtaccgacggtcacgtcgtacgcggaacgtacgtaacgagttcggtacgtacgttacttagtttactcgtagtactaagtaacttagttagttactaccgttaccttaccttacgttaccggttaggacccgaagtaacgtacggtacgtaggaacgtaactaaccgaacgttcggtcgtacgtacgtactccgtaacgttccg

SEQ ID NO: 72391 - DNA, 605 bp, Homo sapiens
  misc_feature: GYAE6OF01ART1N.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaacaaataagaactacttagcttggtaccaacagaaaccaggacagtctacctaagttgctctattttcgtgggcatccgtacccgggtaactcccggggtcctgcgcgacttcagtggcacggcgggtcgtggggacagtactttcgacctttcacctatcagcacgtcctgacgacggactagaagtagtggtcggtactagtttattacgtgtacagtactaattatttaatacgttaccttaccccttacttaccgtttggacccggtacggggaaccctacggtacgtagggaagtacgtaaccgaaaacggtaaccgtacgggttacggtacctacggtacccaccgtacg

SEQ ID NO: 72392 - DNA, 678 bp, Homo sapiens
  misc_feature: GYAE6OF01AW54P.14.35.D02.1.454.CMB.1.raw
  modified_base (244)..(244): a, c, t, g, unknown or other
  misc_feature (244)..(244): n is a, c, g, or t
  modified_base (294)..(294): a, c, t, g, unknown or other
  misc_feature (294)..(294): n is a, c, g, or t
  modified_base (330)..(330): a, c, t, g, unknown or other
  misc_feature (330)..(330): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagacctcccgtggctgtgtctcgtgggcgagacgggccaccagtcaactgcaagtccagccagagttgttttanacagctaccaacaataagaactacttagcttaggtaaccaacagaaaccnggacacgtactaccgtaagttcgactctattttcgngggctatccgtaccgggaacgttcccggggtcctggagccgtattcgaggtcggcgacggtcgggtcgtgggactaggttatttccgtacgtttaccacctatccgagacacggtccgtcgacgtacggtcgtaggtaacgtagttcggtacggtagttaacggtttaagtttaccgttaggttactaaggtaccttaagtttaagtttaacgttaccgttaaccgttacccttaccgtacgttttaccgggaccgtacggggaacccgtaacggtcgttaaggtacgtaacgttaacgaaaaccggtaacgttcggtacggttaccggtacgtccgtaacccgtacg

SEQ ID NO: 72393 - DNA, 847 bp, Homo sapiens
  misc_feature: GYAE6OF01BB4SR.14.35.D02.1.454.CMB.1.raw
  modified_base (265)..(265): a, c, t, g, unknown or other
  misc_feature (265)..(265): n is a, c, g, or t
tcagcgtctagtaccacgaccggtgctcgatttagcacacgatagttgggtttggggtgccaagctgcgtggagggcacggtcaccacgctgctgaggtgaagaagcctgggtcctcggtgaaggtctcctgcaaggtttctgggaggcacgttcgacgaccgtacactatcgaactgggtagcgacaggccctggacaagggcttagaggtggacgtgggaagatcgacttccgtaattcggtactaacgtaacaaattacggnaacagtagacttaccaagtacagactcgaacgtattaaccggacgaactaaagttccgaacggccaacgacggtacctaacgacgtcgggtaacggttcgaacgccgggtcctaggacgttacggtttaggaaccgtaccgtaacggtcctttacgtacgttacgtcggtacggacggaacggtacgttaaaccgtcgaaccggttaacgtaaattaaaccgtagttccgtacccgttgtacccgttacgtttaccggaaccgttaccgggttcggggacccgttaacgggtaacccgttcgggtaccgtaacccggtacccgttaccgttaaccgacccggtacccttaaccccggaacccgggtaacccgggtaccccgttaacggttcccgggtttacccgttaccccccggttggtacccccgttaacccccgtccgttaacccgtaacggacccgtaccgtaacccggttccggggtaccgggggaacccgtaccgaaccgggtccccggtacccgggtcgggtacccgtcggttaccggtacggtaccggtaacggtaccgttaccgttaacccgg

SEQ ID NO: 72394 - DNA, 728 bp, Homo sapiens
  misc_feature: GYAE6OF01C637P.14.35.D02.1.454.CMB.1.raw
  modified_base (224)..(224): a, c, t, g, unknown or other
  misc_feature (224)..(224): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgctaggtttctggaggccacgttcgacacctacactatcgaacgtgggtgccgacgacggcccctggacgaggtcttgagtggagtagggaagntacacgttcctattcgtacgtaataactaagtacgcaactaggatactacaagacacgactacacgaacttaccggacggtaactaacgttaccgaccgaccaacgcgtacctaccagtaggtagttaggacgtcggtccgtagtagtagtttaggaccgacgtacggtaccttacttattacgtgtgacgagacgtaacgtcgacgtagaataacttacgaccgttccttacgtaccttcgtacgtaccgttacgggaccgggtaccgacgggtaaccgtcggtacccgtacccggttacctacctccgtaccgtaccctaccccgacccgaccggtcccgtacgttaccccggtccccgttccccggtcccgtaccctaccccctaccgtacccgaacgtccgtacctccggtacggtaccgggaccgacggacccgggccggtccccggtcgggtccgtccgacggttaccggaacgtacggtaaccgttccgttacccgg

SEQ ID NO: 72395 - DNA, 770 bp, Homo sapiens
  misc_feature: GYAE6OF01BCKV6.14.35.D02.1.454.CMB.1.raw
  modified_base (248)..(248): a, c, t, g, unknown or other
  misc_feature (248)..(248): n is a, c, g, or t
  modified_base (340)..(340): a, c, t, g, unknown or other
  misc_feature (340)..(340): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagtactccctggctggtgtctcgtgggcgaggacgggccaccatacaactgacaacgtccagccagtagttgttttanacagcctaccaaacaagtaagaacttacttagcttaggaaccaaacaacgaaacctaggacagtctaccgtaagttcgctactagttttcgngggactactaccgtaacccggaacgtcccgggtccctaggacggtcgtacttcgtaggtcggcgtaacggtcgggttcgtaacggggactaacggtactttactaccgttttaccaaccgtagtaccacgtaacgaccggtccgttacggacgtaacgggtccgtaaggtaaacgttacgttacgggtcggtaaccgtttaaggtttttaacgtttaccgtaacggttaccgtaacgtaactaaacgtttaacgtttaaacgttaccggttaaaccttccccggttaaccttaaaccgggttttacggaaccccgggtaaaggggtaaaccccttaaagggtccgttaacgggtaaacggtaaactaacccggtaaaacggtaaccgttacgggtacggtaccgtaccgtaaccccgtacgttaaacccg

SEQ ID NO: 72396 - DNA, 749 bp, Homo sapiens
  misc_feature: GYAE6OF01BZOZA.14.35.D02.1.454.CMB.1.raw
  modified_base (254)..(254): a, c, t, g, unknown or other
  misc_feature (254)..(254): n is a, c, g, or t
  modified_base (366)..(366): a, c, t, g, unknown or other
  misc_feature (366)..(366): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacggggacatcgtgatcgacccagtctaccagacctcccgtggcttgtcgtctcgtgggcgaggacggccaccatccaatgacaagtccagccaagtagtttagttttaanacgacgcctaaccaaactaaataaacgtaaccttacttacgacttacggaacctaacgaacgaaacctacggaactacgtacctacctaagttcgcctacttacgttttcgnggactacgtaccgtaacccgggtacgttcccggtacctggacgtcgtacttcgaggtcgacgtacggtccgggtacgacggggtactaacggttctttaccgtacgtttaccaacctagtaccgagtccgtacgtccgtacgaccgtaacggtacgtaggaacgtagttacggtacgttacgttacgttttacttaacgtacgtacgtaacgtaaccttaagtttaagtttaaccgtacggtttaacccctttaaccccgttacgttttaccgggtttaccggaaccgggttaaacccgggtaaacctacggtacggtaacgtacgtaaccgtaacgaaaccgttacggtcggtaccggtaccttacggaaccctaccgtacg

SEQ ID NO: 72397 - DNA, 866 bp, Homo sapiens
  misc_feature: GYAE6OF01C5SPU.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagccgtgggtcctcggtgaaggtctcctgctaaggtttctggagcacgttcgacacctacactatcaacgtgggtgacgacgacggccccgtaggaccgaagggtcttggaggtgggagtagggaaggactctactcccgtagttcggtacgtaataaactaaacttacgacaacgagagtaacttaccgaagacagactcgacgtacttaccggacgaactaaacttccgacggaccactacgaccgttaacagtggtagttcgacggccggacctaggacgtagtttacggacgaccgacgggttccttacttacttaaccgtggtacgacggaacggtaacgtaaccgtacggaactaacggtaattaaaacttcggtaccgtccccgtttacgtacccttcggttacgtaacccggttaccgggtacgggaaccccggtaaccgggtaacccgtaccgggtacccgtacccgtaccctcccgtacgacccgcccgttaaccccgaacccggtaacggtcccctaacgggttcccggttacccccgtttcccccggccgggttaccccctaccccgtaccccgttaacccgaaacgggtacccttacccggtaacccgttcccgggggacgggtaccccgaccgggtacccgggtccccgggtcccgggttacccggggacccgttccccgggttaacccggttaccggggtaaaccctttaaaccgggtaaccccgttaacccggttttaacccccggg

SEQ ID NO: 72398 - DNA, 553 bp, Homo sapiens
  misc_feature: GYAE6OF01APQAU.14.35.D02.1.454.CMB.1.raw
  modified_base (319)..(319): a, c, t, g, unknown or other
  misc_feature (319)..(319): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
  modified_base (546)..(546): a, c, t, g, unknown or other
  misc_feature (546)..(546): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccatcaactgcaagtccagccagagttgttttatacagctaccaacaataagaactacttagcttggtaccaacagaaaccaggacagtctcctaagttgctctattttcngggctactccgtaccccgggtaagtcccggggtccctgacggcgtattcgagtggcacggcgggttcgtcggggacagtactttctactttcaccatcagcagcctgacnggctagagatgngctagtttattactgtacagtactaattattaactagttaccttccctattaccgtttggccgtacgggaccaggtcaggagactacgaaactacgtgtcgacgnccagtac

SEQ ID NO: 72399 - DNA, 874 bp, Homo sapiens
  misc_feature: GYAE6OF01CQF6I.14.35.D02.1.454.CMB.1.raw
  modified_base (154)..(154): a, c, t, g, unknown or other
  misc_feature (154)..(154): n is a, c, g, or t
  modified_base (163)..(163): a, c, t, g, unknown or other
  misc_feature (163)..(163): n is a, c, g, or t
  modified_base (226)..(226): a, c, t, g, unknown or other
  misc_feature (226)..(226): n is a, c, g, or t
tcagcgtctagtaccacgaccggtgctcgatttagcacacgatagttgggtttgggggagctacaacaggcaggcaggggcagcaagatggtgttgcagaccaggtcttcatttctcttgttgctctggatctcgtggtcgaccgtacgggacngtcgtgacncggaccagtcctaccagtcctccgtggtccgtgtcgtctcgtagggacgaggtacggcaaccntaccaaactcggctaaacggcacggacctagtacggttttactttaacgacacggtacccttaacaaactaaaccggtaaagttaaccttaacgttaacggtacgtttaacggtaaacccgaaagtaaaccggaaaccggaaacgtccgtaaacttcccgtttaaccggtttaagttcgttacccgttaacttacgtttttacgggccgtaccggtaaaccgtttccccggggtttaaacccggggaaccccgggttcccggggtttacccagggtttaacgacggtttaaacgtcgggttaacgggcggaacggttaacggtcggggtccggtaaagggtacccgtattttaaaccggtttccgtaaccgtttaaccgactaaacggttccaacggttaccgaccggtcgttaccggacgttacgggttaaccgaacggtaaacgttcgggaaggtttccgtaaggttttaccgtttaagtaccgttaccgtaagtaccgttaaacttaagtttaaacctaccgttttaaacgcccgttaacccgtttacgtaaccggtttaccggaacggtaccgtacggtacgttaaccgggaagtcgtaaaacaccgttaacacgtttccggaacgtccgaagtacctggtacc

SEQ ID NO: 72400 - DNA, 699 bp, Homo sapiens
  misc_feature: GYAE6OF01DFRKV.14.35.D02.1.454.CMB.1.raw
  modified_base (223)..(223): a, c, t, g, unknown or other
  misc_feature (223)..(223): n is a, c, g, or t
  modified_base (352)..(352): a, c, t, g, unknown or other
  misc_feature (352)..(352): n is a, c, g, or t
tcagcgtctagtaccacgaccggtgctcgatttagcacacgatagttgggtttgggtgcccaagctgctggagggcacggtcaccacgctgctgaggtgaagaagcctgggtccctcggtgaacggtctcctgcaaggtttctggaggcacgttcgacacctacactatcaacgtgggtgcgacacggcccctggacaagggcttgaggtggagtgggaagancatcctagttcgtcgtaataaacaattacgcaacagagtataccaagacagactacacgattaccgacgaactaaataccacgacacagcctacagtgagtgagcgctgagattgacactacgtccttntacttacgtgtacgacgagtagactcgactaacgattaaactagtcgtccctttagccttacgttcgtacttaacgggtccgggacccggtacgggtacccgtacggttaccgtaccccgtacgttccctcctaccgtacccctacccgaaccgacccgggtacccctacgttcccggttccccttacccccgttccggtacccctacccccgttaccctacccgaaccgaccggtaccccaccgttccgggtcggggaccctaccggaccgggaccccggtccggtccggggcgttccggaccggttacggttaccgaaaccggttacccgttaccgttaacccgg

SEQ ID NO: 72401 - DNA, 855 bp, Homo sapiens
  misc_feature: GYAE6OF01EBOZK.14.35.D02.1.454.CMB.1.raw
  modified_base (351)..(351): a, c, t, g, unknown or other
  misc_feature (351)..(351): n is a, c, g, or t
tcagcgtctagtaccacgaccggtgctcgatttagcacacgatagttgggtttgggtgcccaagctgctggagggcacggtcaccacgctgctgaggtgaagagccgtgggtcctcggtgaaggtctcctgctaggtttcgtggaggctacgttcgacacctacactatacacgttgggtcgcgacgacggcccgtaggacgagggtcttggaggtaggagtacgggaagtactcacttccttagttccgtagtaaactaaactaaacttcggacagagtagtacttaccgaagacagtactacgacgtactaccgacgtaactaacgtcgaccgccacgacgacctacgngtggtagttggacggcggactggagttacttacgacgtaccgtaccggttctttactacgttactcggtcgacggtacgaacgttacccgttacggaaccttaagtaaacgtttaaagttacccgttaccgttacccgtttcgtaccgtttacgttaccgtacccggtttcggggaacggggttaaccccggtaacgggttaccccgttacgggttcccgtacccggttccctacccggtaccaccccgttacccgtaaccccggaaccggttaacccgggtcccgtttaaccggttcccggtttaccccccttaccccccggttaccggtacccccttaccccgtttcccgaaaccggtaccggaacccgttcccggtaaacccggtccgggggtaacgaccccgggacggtacccggggttacccccgggtccgggtacggttccccgttcggtaccgggttaccgggaaaccgtttaccgtaccgttttccccggtaccgg

SEQ ID NO: 72402 - DNA, 813 bp, Homo sapiens
  misc_feature: GYAE6OF01BI4C8.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtggcgagacggccacatacactgacaacgtccagccaggtagttgttttaacacagtcctaaccaaacaaagtaaacgtaacttacgttaacgtcgttacggtaaacccaaacaaacgaaaccgaggaacctacgtacctaccgttaagttcgaccttcttattttcgtgggactagttacccgtaacccgggtaacgttccccggggtaccctggacgcgttactcgtaggtacggcgacggtcgggttcgacgggaactagttactttccaaccttttcgaaccgtacgtaccagaccgaccgtccgtacgccgacggtacgtaaggtaacgggtagttacggtacggtacgtttaaacgtttttacgtaaccgttcgttaaccgaagttaaccttaaagtttaacgtttaaacgttaaccgtttaaccccgttaccccgtttaaccgggtttaacccgttttacggggaacccccggttaaaacgggggaaacccctaacgggttaccggttaacgggaaaggttaaccccgttaaacccggtaaaaccggttaaacccggttggggttaacccgggtacctaaccgggttaaaccccgtaacccgttttaaacccgg

SEQ ID NO: 72403 - DNA, 746 bp, Homo sapiens
  misc_feature: GYAE6OF01CZZJK.14.35.D02.1.454.CMB.1.raw
  modified_base (261)..(261): a, c, t, g, unknown or other
  misc_feature (261)..(261): n is a, c, g, or t
tcagcgtctagtaccacgaccggtgctcgatttagcacacgatagttgggttttgggggagctacaacaggcgaggcaggggcagcaagatggtgttgcagacccaggtcttcattttctcttgttgctctggatctctggtgcctaggggacatcgtgactcgacccgagtcctccacgtacctccctgggctcgtcgtcgtcgtgggcgagacgggcccaccatacgaactcgacaagtccagccagtacgttgtttanacgctacctacgaaacaacgttaagtaaccttacgttacgtacgtttaacggtaacccaaacgacgaaaaccgacggactacggtacccttaaccgtaagttcgtacttacttaacgttttcgacggtctacgttacccggaccggtacggtcccgggtcctagacgtacgtagttaccgacggttcggacgacggttccggacggttacgggactagttacctttctaaccgttttacgacccgtacgtaccgacgaccgtacggaccgttacggacggtacggtacgtacggttaacgcgtttaggtaccggtactttaacgttttacgttaccggttcgtacgaaccgttaacttaagttacttaacgttaacgttcccttacgttaccgtacggtttacggaccggtaaccgggtacgtaacggtcggtaggaagttaccgaaccgtaacggaccttcggacgtacgactaccgtcgtacc

SEQ ID NO: 72404 - DNA, 721 bp, Homo sapiens
  misc_feature: GYAE6OF01CZ129.14.35.D02.1.454.CMB.1.raw
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
tcagcgtctagtaccacgaccggtgctcgatttagcacacgatagttgggtttgggggagctacaacaggcaggcaggggcagcaagatggtgttgcagaccaaggtcttcatttctctgttgctcgtggatctcgtggtcgccgtacgggacagtcgtgatcgacccagtctcagcctcctggctgtgtcgtcgtgggcgagcgggccaaccgatccaacgtncgaacgtccacgccagtagtttatttanacgacnctaccaaactaaataaactaacctacgttagtcgtttacggaaaccaaacgtaacgaaaccgaggtaactacgttcctaaccgttaagttccgtactacttagtttccggagggtcctaacggttcccgtaacccggggtacgtccccggggtcctaggtacgcgtacttcggaggtcggacgtcggtcgggtggtacggacgtagttaccgtttacgtaccttaccaccgtactacgcgtaccgagtccgagccggtacgtacgtacggaagtcggttcgtacgggtacgtttaacgttttacgttacgtgaacgtaaccttaagtaaccggtttaattaccgtaaccgtttaccttacccgttacgttaccggtttaaccggaccggggtagaacccgtaggtccgtaaggtaacgtaacaaccggtaacgtactcgggtacgtccacgtccgtaacgtcg

SEQ ID NO: 72405 - DNA, 589 bp, Homo sapiens
  misc_feature: GYAE6OF01E38DU.14.35.D02.1.454.CMB.1.raw
  modified_base (189)..(189): a, c, t, g, unknown or other
  misc_feature (189)..(189): n is a, c, g, or t
  modified_base (253)..(253): a, c, t, g, unknown or other
  misc_feature (253)..(253): n is a, c, g, or t
  modified_base (386)..(386): a, c, t, g, unknown or other
  misc_feature (386)..(386): n is a, c, g, or t
  modified_base (448)..(448): a, c, t, g, unknown or other
  misc_feature (448)..(448): n is a, c, g, or t
  modified_base (499)..(499): a, c, t, g, unknown or other
  misc_feature (499)..(499): n is a, c, g, or t
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtncagtcgtggggctggaggtgaagagccgtgggtcctggtgacggtctccgtgctaaggtttcgnggagctacgttcgacacctacactactcaacgtggcgacgacgacggcccgtaggacgaaggtcttgaggtggagtgggaagtatcactcctagttcgtactataactaatcgacacgagagtactaccgaanacacgacacacgtacgtaccgagaactaacgtcgacgacacacgcctacagtggtagtacgnggcgctagtacgtagttacgaaccgtacgaccgttacttacgttagttcgnggtacgcggtaacgtacgtaccgtacgacgtacaattaacgcttaccgtcccttcgtacccttagtacgtaccggtcggcggtacccggg

SEQ ID NO: 72406 - DNA, 766 bp, Homo sapiens
  misc_feature: GYAE6OF01CKA5I.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgctaaggtttctggaggcacgttcgacacctaacactatcaacgtgggtcgacgacgaccggccccgtaggacgaagggtcttaggaggtggagtagggaaggtactcacgttacccttagttcgtacgtaataaactaattaccgacaacgaagtagacttaccgaacgaacgacgtactaccgtaacgtaccgttaaccggaaccggaactaaacgttaccgaaccggaccacgacggtacctaacgtaagtcgggaggttcggacggtaccggtcgtagtagtacgtttacgacggtacctacggttaccttactacgttcgtagtacgacggagtaacgtactacgtactaacggaattaactacgtacgtccgttcgtcccttacgttaccgtacgtacgggtccgggaccgtaccgggtaaccgtcgtacccgtccgtcttccgtacgtccgtacccgtacccgaacccggtaccgtacccgttaccgttccccgttccccttccccggtcccgtacccgacccctaccgtaacccgacgaccgtacccgtaccggtccggtaccggacgacccgtcgggtccgtcccggtgtccgtcgtacgtacgtacgaacgtccgttacgtaccgg

SEQ ID NO: 72407 - DNA, 775 bp, Homo sapiens
  misc_feature: GYAE6OF01E4I5B.14.35.D02.1.454.CMB.1.raw
  modified_base (248)..(248): a, c, t, g, unknown or other
  misc_feature (248)..(248): n is a, c, g, or t
tcagcgtctagtaccacgaccggtgctcgatttagcacacgatagttgggtttggggagctacaacaggcaggcagggcagcaagatggtgttgcagacccaggtcttcatttctctgttgctctggatctctggtgcctacggggacatcgtgatcgacccagtcctccagacctccctggctggtcgtctcgtgggcgaggacgggccaccatcaactgacaacgtccacgccagagtttgtttanacagtcctaaccaaacaataacgtaaccttacgttagtccgttacggtaaccaaacgaacgaaaccacggactacgtacctacctaagttcgtctactttatttccgtggacctacgttacccggtaaccccgggtaacggtcccgggtacccgtagaccgtacgttactacggtaggtcggacgtacgggccgggttacgtacgggaacgtacttacgttttaaccgtaccctttaccaaccgttactaccgaacgcctaaccggtccctacggtacggacgtcgtaaggaacgttgttcggttaacggtaccgtttaacgttttaacgtttaccgtacggtacctaacgtaaacgttaactttaagtttaacgttaaccgtttaaccccttacccgttaacgtttaccgtttaccgggaccgggtaaaccggggaaccctaagggtccggtaaggaaaccgtaacggttaaacccgaaaaccggtttaccggtacgggttacacgtcccgttaacacccgttacg

SEQ ID NO: 72408 - DNA, 912 bp, Homo sapiens
  misc_feature: GYAE6OF01B78KO.14.35.D02.1.454.CMB.1.raw
  modified_base (271)..(271): a, c, t, g, unknown or other
  misc_feature (271)..(271): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacggggacatcgttgatcgtacccagtcctccagtacctccctggtctgttcgtctcgtcgggcgaggacggccaaccgatacaactgaccaacggtcccaaggtacctaggtagtttacgttttaanaaccgacggtaccttaaccgaaacttaaataaacggttaaaccttacttaacggtaccgttttaccgggaaaccaaaccggaaacggaaacccgtacgggtaaacctggttacccttaaccgtttaaaggttcgtcctttaaccgtttacgttttaccggtacgggtactacgtttaccccggtaacccggggttaaccggttccccggggttaccctggtaccggtaccggtttacttacggtacggttccgggaaggttaccggtccgggggttaacggttacgggaaactaacgggtttccttttaccccgtaacggttttacccaaccctaagttaccaaacggttcgaacccgttccgtcgtaccgggaagttcggtaacggttaaagtcgtttaacgggtcgttaccgtttaacggttttattaccggagtaaccttagaaacgtttaatttacgttaaaccggttccttaaacccgttaacccggttacttttacccggttaacccgggggtaactacccggggttaaactaccgggttaacggtaaaccgggttactaaacccctaaaccgggtttaaacggtaacccggtcggtttaacccggtgttaaccccggtactaaccgggttaacc

SEQ ID NO: 72409 - DNA, 767 bp, Homo sapiens
  misc_feature: GYAE6OF01BFU7I.14.35.D02.1.454.CMB.1.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactactcaacgtgggtgcgacacggcccctggacagggcttggagtggagtgggaaggntcatccctattcgtcgtataactaattacgcanagtagactaccaagacagactcacgattaccgacggacaaattcacggtccaacagcctacagtcggtagttagacggcggccgtagacgtagtttacggacgtacgacggtccttacttattacgtntacggcgaagagtaactcgtacgtaacgtaanaaattatctacccgtttgtcccttgttacgtacgtaccggtacgggacccggtaacgggtaacccgtcgggtacccgtacccgtcccttacccgtcgtaccgtacccgtacccgtaaccgaacccgggtaccccgtacgtccccgggtttacccttcccccgtccgggtacccctacccccgttaccccgtacccgaaccgaaccgtccccgtaacccgggttcccgtaccgggggtacccgacccggtaacccggtccccggggtacccggtccggggtccggttacccgggtaccggttacgggttacccgggaaacggtttaaccccggtttacccggtttaaccccggg

SEQ ID NO: 72410 - DNA, 689 bp, Homo sapiens
  misc_feature: GYAE6OF01D2N42.14.35.D02.1.454.CMB.1.raw
  modified_base (437)..(437): a, c, t, g, unknown or other
  misc_feature (437)..(437): n is a, c, g, or t
  modified_base (524)..(524): a, c, t, g, unknown or other
  misc_feature (524)..(524): n is a, c, g, or t
  modified_base (560)..(560): a, c, t, g, unknown or other
  misc_feature (560)..(560): n is a, c, g, or t
  modified_base (681)..(681): a, c, t, g, unknown or other
  misc_feature (681)..(681): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctcgtggtcgccgtacggggactattcgtgatcgaccctagtctccagtacctcccgtggcttgtgtcgtcgtaggcgaggcggccacagtcaactcgacacgccgagccaggtagtttctttaacgacgacgtcctaaccgaaactaaagtaaacgaacctttacgttacgtaccgttaccggtaaacccaaacgaaacgaaaccgaggtaacctcgttaccttaaccgttaagttcgtaccttagttacgtttaccgcggtaacctacggtacccggtaacccgggtaccggtcccgggttccnggtaacctcgtacgttcgaaggtcgacgtcggtcggtcgagggtactagttacctttactcctacgacctagtcacggtcacgtcgngacgacgcgtagagtcgtagtacgtcgttatttacncgtagtaacacgtaattactaagtttactaccgttaccccttagtttaccttcgggttacggacgtacgggtactacgtcggtaagtactaacaaccgtaagtccgttgaacgtcgtaccnctgttacg

SEQ ID NO: 72411 - DNA, 869 bp, Homo sapiens
  misc_feature: GYAE6OF01BG8WD.14.35.D02.1.454.CMB.1.raw
  modified_base (263)..(263): a, c, t, g, unknown or other
  misc_feature (263)..(263): n is a, c, g, or t
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccacgtcccaggtccagtcgtggtcgctaggtcgtggggtctggagggtagaagtacgtccgttgggtccgtacgggtgtaaccggtcctaccgtntacgttaagggtttcgagggacggctacggtaccgtacacctacactactaccgtaacggtcgggtacgccggtaaccgacccggtaccccggttacgggaaacggtagggtacggttagggtagggttagggtaacggtagggggaaactcgttacccgtaccgtttaccctttacggtttaccggttaacgttaactaaaacgttaaacttaccgaacgtaacgtaaggtaacgttaaccgttaacgaaacccgaaccgtacgtaaccgttaccgtaaaccgttacccggttaaccgggtaaccccgtaattaaacccggttacccggaaccccgtaccgacccgtaccaacccgttaacgtacggtttacgggtacgggttaacgtaccgggtccgggtaccgttacggttaaacggttacgggttaccgaacccggtaaccggttacccgttaccccgtttacgtttaccgtttcggttacggtaccggacgtaacggtacctaccggttacgtaaccgtaaagtaacttaagtacccggttacccgttcgttccgttacgttcccgttacggtaaccggtccgggtaaccgggtaccccgg

SEQ ID NO: 72412 - DNA, 971 bp, Homo sapiens
  misc_feature: GYAE6OF01B8MT6.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctcgtggatctcgtggtcgccgtacgggacagtcgtagactacgaccctagtctccgacgtacctcccgtggcttcggtcgtccgttcggtcgggacggacgggaccgggacccaaccgtactaaccgaaccgttacggaccgtaaccgtccgacggaccgtaagttacggttttacgttttaacacgtacgtacctaaccgaaaactaaacgttaaacgtaaccttaacgttacggtacgttaaccggtaaaccaaacgtaaaccgtaaaccggacggaaccttacgttacccgttaaccggttaacgtttcgtacctttacgtttaccgttttcggacggtaccttaaccgttaaccccggggtaacccgggttaaccggtccccggggttaccctaggtaccggacgtttaagttccgggtagggtcggtaccgggtacgggtcgggtaccggtagggtaacctagtttacctttaccgttaccgtttaccaaccgttagtaaccgccgtacgtccggaccgttacggacgtaacgggttaccgtaagggtaccgttaggaccggtttacccggtaagttttaaccggttttactaccgggttacgtaaacgtactttaaaccggttaaagtttccggtttaaaacgttaccccgtttaaccccgtttaacccgtttaccgggtttaacccggtttaacccggggaaacccgggttaccgggggttaaaacccttaccgggtaaccggttagggttaaacccgtacggttaaaaacccgggtaaacggtttcgtaaccgggttccgtaaacccggtacccgttaaaccgttcccgtttaaccggg

SEQ ID NO: 72413 - DNA, 807 bp, Homo sapiens
  misc_feature: GYAE6OF01ARRU1.14.35.D02.1.454.CMB.1.raw
  modified_base (276)..(276): a, c, t, g, unknown or other
  misc_feature (276)..(276): n is a, c, g, or t
  modified_base (647)..(647): a, c, t, g, unknown or other
  misc_feature (647)..(647): n is a, c, g, or t
tcagcgtctagtaccacgaccggtgctcgatttagcacacgatagttgggtttgggggagctacaacaggcaggcaggggcagacaagatggtgttgcacgacccagtcttcatttctcttgttgctctggtattcctcgtgggtacgtcccggtacggggactcgtcggtatacgttcgacccctagtcctaccgaacgtccttccgtggtcttcgtcgttcgtcggtcgggcgtaacgggccggcctaacctagtaccactcgactaacgtccncgaccgtagttaggtttactttaacacgacctactaaaccaaataacgtaacgtaaaccttacgtaccgtacgttaccgtaaaccaacgtaaacgaaccgtacgacttaccctcgttaaccgttaacgtcgtacttcgttaccgttggtacggtaacctacggttacccggtaacccgggtccgtccggttccgtaggtaccgtacgtacgtacggagtaccggacgtcggtccgggtcgtaccgtacgtacgtttacctacgtacctttacgcgtaacgtcgaccgtacgtccgacgtacgttacggacttaaggaacggtgttacggttcgttagtaccgtttaacgtttcacggttacgacgtttaanaacgtttaaccgttgtttaacctccggttaacccgtcgtttaaccggttcgtaaccgggtaccggtagtaacccggtagttaccgttaacgaccggttaactaaacgggttcccctagggttaccgtacgtaccttaaccgtaaccgtggttaaaccccg

SEQ ID NO: 72414 - DNA, 174 bp, Homo sapiens
  misc_feature: GYAE6OF02G9PR5.14.35.D02.1.454.CMB.1.raw
  modified_base (173)..(174): a, c, t, g, unknown or other
  misc_feature (173)..(174): n is a, c, g, or t
tcagcgtctagtaccacgaccggtgctcgatttagcacacgatagttgggtttgggggaagaggaagactgacggtcccccaggagttcaggtgctgggcacagcggccctgggctgcctggtcaaggactacttccgtactagacgctgagcgggctggcaaggcgcatagnn

SEQ ID NO: 72415 - DNA, 149 bp, Homo sapiens
  misc_feature: GYAE6OF02F73X7.14.35.D02.1.454.CMB.1.raw
  modified_base (132)..(149): a, c, t, g, unknown or other
  misc_feature (132)..(149): n is a, c, g, or t
tcagcgtctagtaccacgaccggtgctcgatttagcacacgatagttgggtttgggcgacagcggccctgggctggcctggtcaaggactacttccgtactagacgctgagcgggctggcaaggcgcatagnnnnnnnnnnnnnnnnnn

SEQ ID NO: 72416 - DNA, 138 bp, Homo sapiens
  misc_feature: GYAE6OF02HG48T.14.35.D02.1.454.CMB.1.raw
  modified_base (132)..(138): a, c, t, g, unknown or other
  misc_feature (132)..(138): n is a, c, g, or t
tcagcgtctagtaccacgaccggtgctcgatttagcacacgatagttgggtttgggcgacagcggccctgggctgcctggtcaaggactacttccgtactagacgctgagcgggctggccaaggcgcatagnnnnnnn

SEQ ID NO: 72417 - DNA, 502 bp, Homo sapiens
  misc_feature: GYAE6OF02H41J0.14.35.D02.1.454.CMB.1.raw
  modified_base (453)..(453): a, c, t, g, unknown or other
  misc_feature (453)..(453): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcacttttcaccatcagcagcctgcaggctgaagatgtggcagtttatactgtcagcaatattatagtactccctanacttttgccagggaccaagctaggagatcaaacgactgtggctgcacta

SEQ ID NO: 72418 - DNA, 507 bp, Homo sapiens
  misc_feature: GYAE6OF02JBCRB.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcggtctgggacagatttcactttcaccatcagcagcctgcaggctgaagatgtgctagtttatactgtcagcaatattatagtactcctactactttgccagggacaagctaggagtatacgaaacgactggtaggctgaccactacg

SEQ ID NO: 72419 - DNA, 131 bp, Homo sapiens
  misc_feature: GYAE6OF02FPO2Q.14.35.D02.1.454.CMB.1.raw
  modified_base (130)..(131): a, c, t, g, unknown or other
  misc_feature (130)..(131): n is a, c, g, or t
tcagcgtctagtaccacgaccggtgctcgatttagcacacgatagttgggtttgggcacagcggccctgggctgcctggtcaaggactacttccgtactagacgctgagcgggctggcaaggcgcatagnn

SEQ ID NO: 72420 - DNA, 507 bp, Homo sapiens
  misc_feature: GYAE6OF02HINFC.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggctagtttatactgtcagactaatattatagtactcctactactttcgccagggacaaggctaggagatacaaacgtactgtggctgcactac

SEQ ID NO: 72421 - DNA, 546 bp, Homo sapiens
  misc_feature: GYAE6OF02FNW0P.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgccctttgcctcttgactactgggccagggaaccctggtcaccgtctcctcagcctccaccaagggcccatccgtcttccccctggccaccctcctccaacgacgccacctctcggggccacagccggccctgggctcggcctggtcaacggtactacgttacccg

SEQ ID NO: 72422 - DNA, 508 bp, Homo sapiens
  misc_feature: GYAE6OF02HT2ZX.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaccaggacagtctcctaagttgctcattttctgggcatctacccgggaatccggggtcctgagcgattcagtggcagcggtctgggacagatttcacttttcaccatcagcagcctgcaggctgaagatgtgctagtttatctgtcagcaatattatagtactccctactacgttttgacctagggaccaaggctggagatacaaacgtactgtacggctgcactacg

SEQ ID NO: 72423 - DNA, 534 bp, Homo sapiens
  misc_feature: GYAE6OF02HAZWI.14.35.D02.1.454.CMB.1.raw
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaaggatcatcctattcgtcgtataacaaattacgcacagagattaccaagacagactcacgattaccgcgacaaattcacggccacacgacctacatggagttgagcggcctgagtatttgacgacacgtccttcttattactgtgcgagacgactcgactaacgaataaatatcgtaccttcgccttcttacgtacgttacgtgggtacccgg

SEQ ID NO: 72424 - DNA, 519 bp, Homo sapiens
  misc_feature: GYAE6OF02IV4WO.14.35.D02.1.454.CMB.1.raw
  modified_base (444)..(444): a, c, t, g, unknown or other
  misc_feature (444)..(444): n is a, c, g, or t
  modified_base (486)..(486): a, c, t, g, unknown or other
  misc_feature (486)..(486): n is a, c, g, or t
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaagatcatccctattcgtcgtataacaaattacgcacagagattccaagacagactcacgattaccgcggaacaaattcacggccacagcctacatggagttgagcgcctgagatttgacgacncggccttctattactgtgcgagagactcgctaacgataaatntacgccttgccttcttcgactacgtgggtaccg

SEQ ID NO: 72425 - DNA, 173 bp, Homo sapiens
  misc_feature: GYAE6OF02H0YUV.14.35.D02.1.454.CMB.1.raw
  modified_base (173)..(173): a, c, t, g, unknown or other
  misc_feature (173)..(173): n is a, c, g, or t
tcagcgtctagtaccacgaccggtgctcgatttagcacacgatagttgggtttgggggaagaggaagactgacggtcccccaggagttcaggtgctgggcacagcggccctgggctgcctggtcaaggactacttccgtactagacgctgagcgggctggcaaggcgcatagn

SEQ ID NO: 72426 - DNA, 505 bp, Homo sapiens
  misc_feature: GYAE6OF02FV662.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagtgctcattttctgggcatctacccgggaatccggggtcctgagcgattcagtgcagcgggtctgggacagatttcactttcacatcagcagcctgcaggctgaagatgtgctagtttatactgtcagacaatattatagtactcctactactttgcctagggaccaagctaggagtaactacgaaacgactgtggctcgcaccta

SEQ ID NO: 72427 - DNA, 523 bp, Homo sapiens
  misc_feature: GYAE6OF02HIS9Z.14.35.D02.1.454.CMB.1.raw
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggagcacgttcgacacctacactatcaactgggtgcgacacggcccctggaccaagggcttggagtggatgggaagatcatccctattcgtcgtataaacaattacgcacagagattccaagacagactcacgataccgcgacaatcacgcacagctacatggagttgagcgcctgagtattgacgacacggccttctacttactgtgcgagagactcgactaacgaactaaatacgtcgtcccttgccttcttacgtactacgtgggaaccgg

SEQ ID NO: 72428 - DNA, 499 bp, Homo sapiens
  misc_feature: GYAE6OF02IYLDA.14.35.D02.1.454.CMB.1.raw
  modified_base (238)..(238): a, c, t, g, unknown or other
  misc_feature (238)..(238): n is a, c, g, or t
  modified_base (370)..(370): a, c, t, g, unknown or other
  misc_feature (370)..(370): n is a, c, g, or t
  modified_base (450)..(450): a, c, t, g, unknown or other
  misc_feature (450)..(450): n is a, c, g, or t
  modified_base (474)..(474): a, c, t, g, unknown or other
  misc_feature (474)..(474): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttagcttggtaccaacagaaaccaggacagtctcctaagttgctcattttctgggcatctacccgggaatccggggtcctgagcgattcagtggcagcggtctgggacngatttcactttcaccatcagcagcctgcaggctgaagatgtggcagtttatactgtcagcaatattatagtactcctacnctttgccagggacctaagctgganatacaacgatgtaggctgcactacg

SEQ ID NO: 72429 - DNA, 509 bp, Homo sapiens
  misc_feature: GYAE6OF02HIVLM.14.35.D02.1.454.CMB.1.raw
  modified_base (238)..(238): a, c, t, g, unknown or other
  misc_feature (238)..(238): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttagcttggtaccaacagaaaccaggacagtctcctaagttgctcatttctgggcatctaccggaatccggggtcctgagcgattcagtggcagcggtctgggacagatttcacttttcacatcagcagcctgcaggctagaagatgtgctagttattactgtcagactaatattatagtactcctactactttgaccgtagggaccaagtctggagtatacgaacgacgttagcgtgtcgcactacg

SEQ ID NO: 72430 - DNA, 602 bp, Homo sapiens
  misc_feature: GYAE6OF02I92MX.14.35.D02.1.454.CMB.1.raw
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacacggccctggacaagggcttgagtggatgggaagatcagtccctattcgtcgtataacaaattacgcacagagacttccaagacagactacacgtaacttaccgcgaactaaattccgaacggtccaacgacgccgtaaccaagttggaacgttgaacggccggacctaggtaagagttttacgaaccggtaccgtacggtacctttactactttaccgtagtcgtaccgagaacgtactcggtactaacggtaacttaaacgtatacggtcccttacgtccttccgttacggaacttacggagggtacccgg

SEQ ID NO: 72431 - DNA, 497 bp, Homo sapiens
  misc_feature: GYAE6OF02FNK4F.14.35.D02.1.454.CMB.1.raw
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacgggtacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcatttctggcatctacccgggaatccggggtccctgagcgattcagtggcagcgggtctgggacagatttcactttcacatcagcagcctgcaggctgaantgngctagttatatgtcagcaatatatagtactcctactactttgccagggaccaggctaggagtatacgaacgactgtagctgccactac

SEQ ID NO: 72432 - DNA, 550 bp, Homo sapiens
  misc_feature: GYAE6OF02I6BN5.14.35.D02.1.454.CMB.1.raw
  modified_base (490)..(490): a, c, t, g, unknown or other
  misc_feature (490)..(490): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaaattcacggccacagcctacatggagttgagcggcctgagattttgacgacacgggccttcattactgtgcgagagaactcgctacgataaatatgccctttgcctcttgactactgggccagggaacctggtcaccgtctcctcagcctccaccaaggcccatccgtcttccccctcggccaccctcctccacgacgcaccnctcggggcacgacgccggcccgtgggctcggcctggtccaacgggtactacgttacccgg

SEQ ID NO: 72433 - DNA, 552 bp, Homo sapiens
  misc_feature: GYAE6OF02H8EIP.14.35.D02.1.454.CMB.1.raw
  modified_base (475)..(475): a, c, t, g, unknown or other
  misc_feature (475)..(475): n is a, c, g, or t
tcagcgtctagtaccacgaccggtgctcgatttagcacacgatagttgggtttgggtggcccaagctgctggagggcacggtcaccacgctgctgagatgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatcggagttcgagtcggcctgagatttgacgacacggccttctattactgtgcgagagaactcgctacgataaatactgcccttgcctcttgactactcgggcagggaaccctggtcgaccgtctcctcagccctcaccaagggcccatccggtcttccccgtggccncctccctcaacgcgacacctcgtcggggccacgacgccggcccgtggcctcggccctgggtccacggtaccttaccg

SEQ ID NO: 72434 - DNA, 815 bp, Homo sapiens
  misc_feature: GYAE6OF02GLQ5K.14.35.D02.1.454.CMB.1.raw
  modified_base (353)..(353): a, c, t, g, unknown or other
  misc_feature (353)..(353): n is a, c, g, or t
  modified_base (420)..(420): a, c, t, g, unknown or other
  misc_feature (420)..(420): n is a, c, g, or t
  modified_base (806)..(806): a, c, t, g, unknown or other
  misc_feature (806)..(806): n is a, c, g, or t
tcagcgtctagtaccacgaccggtgctcgatttagcacacgatagttgggtttgggggtaggcgtacaacaggcaggcaggggcgagcaagatggtgttgcagacccaggtcttcatttctctgttgctctggatctctggtgcctacggggacatcgtgatgacccagtctccagactccctggctgtgtctctggcagagggcctaccatcaactgcaaagtcccaggacccagttagttagtttttacgaaccaggccttaccaaaccaaataaacgaaacttacctttaagccttttggtaaccaaacaacgaaaaccacggaacaagtcctacctaaattggaacctntaacttttcgtgggcaaacttcctaaaccccggggtaagttcccccgggggttccctagggtaccgnggtaaactttcccggaagtttacggggcccaaagggtcccgggggtttacgtacgggggaactaaagtccgtttttacccgaaacgtttttcccaaacccgtaaccgtttactaaaccggtccgtaaaccgggacccttacgggtcccgaacggggttcccggttaagaaaccgggtttaattggggtacgttacgtaacggttttaattaaccgttttgaaccgttagaccttaaagttaacctttaaagtaacggtttaacctaccccttaaaccgttacgttttaccgggtaccgtaacggggtaacccaagggttccgtacggaaggtaaccgttaataaaacccgggtaacttagggttacggtaaccgtggtaaccccgnttaaacccg

SEQ ID NO: 72435 - DNA, 511 bp, Homo sapiens
  misc_feature: GYAE6OF02H87PN.14.35.D02.1.454.CMB.1.raw
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagatccagacagactcacgattaccgcggacaaattcacggccacagcctacatggagttgagcgcctgagattgacgacacgccttctattactgtgcgagagactcgctacgataaatatgcccttgcctcttgacttacgtgggaccg

SEQ ID NO: 72436 - DNA, 504 bp, Homo sapiens
  misc_feature: GYAE6OF02HJC3H.14.35.D02.1.454.CMB.1.raw
  modified_base (313)..(313): a, c, t, g, unknown or other
  misc_feature (313)..(313): n is a, c, g, or t
  modified_base (481)..(481): a, c, t, g, unknown or other
  misc_feature (481)..(481): n is a, c, g, or t
  modified_base (494)..(494): a, c, t, g, unknown or other
  misc_feature (494)..(494): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttcngggcatctacccgggaatccgggggtccctgagcgattcagtggcagcgggtctgggacaggatttcacttttcaccatcagcagcctgcaggctgaagatgtggctagtttatactgtcagcaatattatagtactcctacacttttggccagggaccaagctgganatcaaacgactgngctgcactac

SEQ ID NO: 72437 - DNA, 635 bp, Homo sapiens
  misc_feature: GYAE6OF02JWAWG.14.35.D02.1.454.CMB.1.raw
  modified_base (180)..(180): a, c, t, g, unknown or other
  misc_feature (180)..(180): n is a, c, g, or t
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (310)..(310): a, c, t, g, unknown or other
  misc_feature (310)..(310): n is a, c, g, or t
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (391)..(391): a, c, t, g, unknown or other
  misc_feature (391)..(391): n is a, c, g, or t
tcagcgtctagtaccacgaccggtgctcgatttagcacacgatagttggtttgggtgtcccgaagctgctggagggcgacggtcaccacgctgctgaggtgaagaagcctgggtcctcggtgaaggtctcctgcaaggtttctggaggcacgttcgacaccgtacactatcaactgggtncgacaggcccctggaccaagggcttgagtggatgggaagatcatccctatcgtgtanaacaaattcgcanagagattccaaagaccagactcagattaccgcgacaaattcaacggccaacagcctaacntaggagttgaaggcgacctgagtatttgaccganaccggccttgtattacgngtgcgagtagaactcgctacgaagtaaanacttgccccgtttgcctcttaggaccttaacgtcgggacctaacgggacccgtggtacctaaccggtctaccgttctacgccgttaccgacccaacgggccctaagttccggtaccttcccccgtcgggaccctacccgttccctcccgtaaacgacgtccaacccttcgtccggggtaccaccggtacgcccggaccgtcggccgtccgaccgtcgtacggaaccgtacgtaccgttacccgg

SEQ ID NO: 72438 - DNA, 191 bp, Homo sapiens
  misc_feature: GYAE6OF02H7WIU.14.35.D02.1.454.CMB.1.raw
  modified_base (175)..(191): a, c, t, g, unknown or other
  misc_feature (175)..(191): n is a, c, g, or t
tcagcgtctagtaccacgaccggtgctcgatttagcacacgatagttgggtttgggggaagaggaagactgacggtccccccaggagttcaggtgctgggcacagcggccctgggctgcctggtcaaggactacttccgtactagacgctgagcgggctggcaaggcgtcatagnnnnnnnnnnnnnnnnn

SEQ ID NO: 72439 - DNA, 586 bp, Homo sapiens
  misc_feature: GYAE6OF02H9II6.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagttgttttatacagctaccaacaataaagaactacttagcttaggtaccaacagaaaccaggacagtctaccttaagttcgactctatttttctgggctattaccgtaacccgggtaactcccgggggtccctaggacgtcgattcagtggacagcgggtctgggacagtatttcacttttcaccatcacgcagcctgcgacggactagaagtagtgtgtactagtttattacgtcgtcagactaataattatagttacctaccctaacttacgttttcgaccgtacggggaccctaaggtcgtaggacgtaattaaccgaaacgtacgtaggtacggactacgtaccaccgtaacg

SEQ ID NO: 72440 - DNA, 534 bp, Homo sapiens
  misc_feature: GYAE6OF02HEKNP.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctctatttctgggcatctacccgggaatcccggggtcctgagcgattcagtggcaggcggtctgggacagtatttacactttcacctatcagcagcctgcgaggctagagtatggtggactagtttattactgtacagtactaattattaatagttacctaccctactactttgaccgtagggaccaacggctaggacagtacgaaacgtacgtggtaggctgccactacg

SEQ ID NO: 72441 - DNA, 577 bp, Homo sapiens
  misc_feature: GYAE6OF02J2I8I.14.35.D02.1.454.CMB.1.raw
  modified_base (239)..(239): a, c, t, g, unknown or other
  misc_feature (239)..(239): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtcccagccagagtgttttanacagctccaacaataagaactacttagcttggtaccaacagaaaccaggacagtctcctaagttgctcattttctgggcatctacccgggaattcccgggggtcctgacgcgtaattcagttcggcagcgggtctggggaccaggtatttccgacttttccgacctagtaccagtcacggtcctagcaggcctagaacgtattggtaggtctagtttagttactgtacagtaccaattagttatacgttacctccctaactacttttcggccgtagggtaccaaggtcgtaggtagacttacgaaacgtacgtacggtcggactcggacctaccctag

SEQ ID NO: 72442 - DNA, 623 bp, Homo sapiens
  misc_feature: GYAE6OF02HB98Z.14.35.D02.1.454.CMB.1.raw
  modified_base (332)..(332): a, c, t, g, unknown or other
  misc_feature (332)..(332): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgacaagtccagccagagttgttttatacagcctaccaacaaataacgaactacttagcttacggtaaccaaacaacgaaaccaggactagtcctacgtaagttgctctattttcgnggctactccgtaacccgggaacgttcccggggtccctggacgacgtagttccgagttcggacgaggcgggtcgtagggaacagtactttcctactttacacctactcagccacgccgtgacgcgctacgagtacgttggtacgtacgttagtttacttcgtagtcagtactaatattagtacgttaccttacctacgttacgtttacggaccgtacgggacctaacggtcgtaggaacgtacgtaaccgaaacggtacgtcggttaggtaccgtacggtacctacctaccg

SEQ ID NO: 72443 - DNA, 550 bp, Homo sapiens
  misc_feature: GYAE6OF02IMGXD.14.35.D02.1.454.CMB.1.raw
  modified_base (320)..(320): a, c, t, g, unknown or other
  misc_feature (320)..(320): n is a, c, g, or t
  modified_base (412)..(412): a, c, t, g, unknown or other
  misc_feature (412)..(412): n is a, c, g, or t
  modified_base (494)..(494): a, c, t, g, unknown or other
  misc_feature (494)..(494): n is a, c, g, or t
tcagcgtctagtaccacgaccggtgctcgatttagcacacgatagttgggtttggggacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacacggcccctggacaagggcttgagtggatgggaagntcatcctattcgtacgtataacaaattacgcacagagtattaccaagacagactacacgacttaccgcggaacaattcacggcacagcctanatggattgagcggcctgacgtatttggacgacgacggtccttctacttcgtgtgcgagacgaacgtcgactacgataaactntcgtcccttgcccttcgtttcgaaccgttcgtcggggaccacggggacccttcggg

SEQ ID NO: 72444 - DNA, 574 bp, Homo sapiens
  misc_feature: GYAE6OF02H6JWU.14.35.D02.1.454.CMB.1.raw
  modified_base (240)..(240): a, c, t, g, unknown or other
  misc_feature (240)..(240): n is a, c, g, or t
  modified_base (378)..(378): a, c, t, g, unknown or other
  misc_feature (378)..(378): n is a, c, g, or t
  modified_base (423)..(423): a, c, t, g, unknown or other
  misc_feature (423)..(423): n is a, c, g, or t
  modified_base (430)..(430): a, c, t, g, unknown or other
  misc_feature (430)..(430): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggagggccaccatcaactgcaagtccagccagagttgtttanacagctccaacaataagactacttagcttggtaccaacagaaaccagacagtctactaagttgctacattttcgtggcacgtcgtacccgggagtcccggggtcctgacgcgtattccgaggtcggccaggcgggtcngggacagtattctactttcacatcaagcacgctgcagctagaagntggtcgngtacgtttattaccgtgacctagactaagttattaagtacgttacctaccctacgtacgttttcgggaccgtacgggaccaaggtccgtaggtaagtacgtaacgaaaaccgtacgtacgttcgggactacgaccgacttaacg

SEQ ID NO: 72445 - DNA, 613 bp, Homo sapiens
  misc_feature: GYAE6OF02HJM30.14.35.D02.1.454.CMB.1.raw
tcagcgtctagtaccacgaccggtgctcgatttagcacacgatagttgggtttgggtgcccaagctgctggaggcacggtcaccacgctgctgaggtgaagaagcctgggtcctcggtgaaggtctcctgcaaggtttctggaggcacgttcgacacctacactatcaactggtgcgacaggcccctggaccaagggcttgagtggatgggaaggatcatcctatcgtcgtataacaaattacgcacagagattccgaagacagactcacgataccgcgacaaattcacgcacagtctacatgagttgagcgacctgagatttgacgacacggccttctattactgtgacgagagtaactcggactacgaataaatatgacccttgacctcttgtactacgtgggacctacgggaacccgtaggtccaaccggtctcctacgtacgccctccaaccgaacggcccaactcccgggtccttccccccgttggcccgtaaccccttccctacccgaaacgaccgaccaacccgtccgtcgggggccaaccgacgccgggtcccgcgggtcgtcgacccgttcggttacgaaacggtaccgtaccgtttaacccgg

SEQ ID NO: 72446 - DNA, 523 bp, Homo sapiens
  misc_feature: GYAE6OF02HQ2QM.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaacaataagaactacttagcttggtaccaacagaaaccaggacagtctcctaagttgctcattttctgggcatctacccgggaatccggggtccctgagcgattcagtggcaggcgggtctggggacaggtatttcacttttcaccatcagcagcctgcaggctagaagatggtggctagtttattactgtcagacatattatagtacctccctactacttttgccgagggacctagcgtggagatacgaacgaactcgtggctcgcgacctaacg

SEQ ID NO: 72447 - DNA, 565 bp, Homo sapiens
  misc_feature: GYAE6OF02IZDFH.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgtacacggccttctattactgtgcgagagaactcgctacgaataaatatgtcccttgcctcttgactacgtgggccagggaacctggtcaccgtctcctcacgcctccgaccaacggcccaacgtccgtccttcccctcggccctacccgtcctccgaacgacgctacctcgcggggtaccacgcgccggcccgtggccgtcgccgtcggtacacggtactacgttacccgg

SEQ ID NO: 72448 - DNA, 692 bp, Homo sapiens
  misc_feature: GYAE6OF02H07OA.14.35.D02.1.454.CMB.1.raw
  modified_base (295)..(295): a, c, t, g, unknown or other
  misc_feature (295)..(295): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgataccgcgacaatcacggccanacgcctacatggtagttgagcggcctgagtattgacgacgacggtccttctattactgtgcgtagagaactcgactacgaataaatagtacgtcccttacgtccttcttacgacttacggttcggggaccgtaacgggtaacccgtacggtccgtacccgtccttaccttaccgtaccgtcctacccgaaccgaaccggtacccgtacgtcccggttacccttcccccgtaccggtaccctacccccgttccctacccgtaaacgaaccgtacctacccgtacgggtccggggtacccaaccggtaccggtcccgggtaccccggttcgggtacccggttccggtcccggttacgggttacccggtaacgggttacccgttacccgtttaaccccgg

SEQ ID NO: 72449 - DNA, 557 bp, Homo sapiens
  misc_feature: GYAE6OF02HTJEW.14.35.D02.1.454.CMB.1.raw
  modified_base (357)..(357): a, c, t, g, unknown or other
  misc_feature (357)..(357): n is a, c, g, or t
tcagcgtctagtaccacgaccggtgctcgatttagcacacgatagttgggtttggggacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaaggatcatcctattcgtcgtaataacaaattacgcacaganattccaagacagactacacgattaccgcggaacaaattacacggccacacgcctacatggagttggagcggctgagatttgacgacacggtccttactatttactgtgcgagagaactcgctacgaataaatactcggtacccttgacccttctttacgaccgttaccgtcgggggtaccctacgggtacccgtaccggg

SEQ ID NO: 72450 - DNA, 508 bp, Homo sapiens
  misc_feature: GYAE6OF02HNCYB.14.35.D02.1.454.CMB.1.raw
  modified_base (277)..(277): a, c, t, g, unknown or other
  misc_feature (277)..(277): n is a, c, g, or t
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
  modified_base (503)..(503): a, c, t, g, unknown or other
  misc_feature (503)..(503): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaanagaaaccagacagtctacctaagttgctctatttctggcatctacccgggaatcccggggtcctgacgcgtattcgagtggcaggcggtcgtgggacagtatttcactttcactatcagcagcctgacagctaganagtgtgactagttattactgtnagactatatatacgtactacctatacgtttgcgaggacagntganatacgaagtacgtgtgactcacncctag

SEQ ID NO: 72451 - DNA, 574 bp, Homo sapiens
  misc_feature: GYAE6OF02JGE8L.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacgggccttctattactgtgcgagagaactcgctacgataaatatgcccttgcctcttgactacgtgggccagggaccctggtcaccgtctcctcacgcctccaccaacgggcccagtccggtccttcccccgtcggccacccctcctaccaacgacgcctacctccgtcggggccgacacggccggcccgtcgggccgtcgtcccgtggtccaacgggtaccttaccgtttacccgg

SEQ ID NO: 72452 - DNA, 566 bp, Homo sapiens
  misc_feature: GYAE6OF02G5KLQ.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaaactcgctacgataaatatgcccttgcctcttgactactgggccagggaacctggtcaccgtctcctcacgcctccaccaacgggcccatccggtccttcccccgtggccaccctccctaccaacgacgccacctcgtcggggccaacacggccggcccgttcgggcctcggccgtggtaccgaaggtccttaccgttacccgg

SEQ ID NO: 72453 - DNA, 578 bp, Homo sapiens
  misc_feature: GYAE6OF02HX8ES.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagtatttgacgacacggccttctattactgtgcgagagaactcgactacgaataaatatcgacccttgcctcttgactacgtgggccagggaacctggtcaccgtctcctcacgcctccaccaacgggcccagtcccggtccttcccccgtcggcctaccctccctccaacgacgccacctccgtcggggtccacgacgccggcccgtcgggccgtcggcccgtcggtaccgaacggtacctaccgttacccgg

SEQ ID NO: 72454 - DNA, 655 bp, Homo sapiens
  misc_feature: GYAE6OF02J2GBX.14.35.D02.1.454.CMB.1.raw
  modified_base (218)..(218): a, c, t, g, unknown or other
  misc_feature (218)..(218): n is a, c, g, or t
  modified_base (271)..(271): a, c, t, g, unknown or other
  misc_feature (271)..(271): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatggggaaggntcatccctattcgtcgtataacaaattacgcacagagattccaagacagactnacgattaccgcggacaaattcacggccacagcctacatggagttgagcggacctgagtatttgacgacacggccttctatactgtgcgagagaactcgctaacgaataaatatcgtacctttgccttcttagacctacgtcggggaccagggtaaccctcggtacctaccgtctcctctacgccctacccgaccgaacgggccctacgtacccggttcccttcccccgtcggaccctacccccttacccgtacccgaaacggtccgtacccaccccgttaccgggtccgggggacctaaccggaccggcccgggtccccggttcggggcccttccggcccgtcgggttaaccgaaccgggttacccttacccgtttaaccccgg

SEQ ID NO: 72455 - DNA, 795 bp, Homo sapiens
  misc_feature: GYAE6OF02GGBLI.14.35.D02.1.454.CMB.1.raw
  modified_base (240)..(240): a, c, t, g, unknown or other
  misc_feature (240)..(240): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagtagttgttttanacagcctaccaaacaataacgaacttacgttagcgtttaggtaaccaacaacgaaaaccaggaacctagttacccttaccgttaaaggtttcgaccttacttacgtttttcgcgggtactaacgttacccggtaacccggggtaacgttccccgggggttacctggacggtcgttacttcgaggtcggacgtacggtccgggttcgtagggaacgtacgtacttttccgaccttttacaaccgtataccgacggtcctaacggtcccgttaggaccgtagggtaccgtacggtaaacgtacgttcgggtacggtacgtttaaacggttttactttaaccggttgttaacccggtaacgtaacttaaacgtttaaacgtttaaccgttaaccgtttaaccctttaaccccttaacgttttaacccgtttacgggaacccgggtaacgggtaaccctaacgggttccggtacgggtaaaccgtaacgttaacccggtaaaaccggttacggttaccgggttacggtacccgtacggtaaccccgtaccgtttaaccg

SEQ ID NO: 72456 - DNA, 525 bp, Homo sapiens
  misc_feature: GYAE6OF02HHPG5.14.35.D02.1.454.CMB.1.raw
  modified_base (247)..(247): a, c, t, g, unknown or other
  misc_feature (247)..(247): n is a, c, g, or t
  modified_base (460)..(460): a, c, t, g, unknown or other
  misc_feature (460)..(460): n is a, c, g, or t
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagagcctgggtcctcggtgaggtctcctgcaaggtttcnggaggcacgttcgacacctacactatcaactgggtgcgacaggcccctggacaagggcttggagtggatgggaaggatcatccctattcgtcgtataacaattacgcacagagattcaagacagactcacgataccgcgacaattcacgcacagcctacagtgagttggacgcggctgagatttgacgacacggtcctttctatttactgtgngagagacgtcgacgtacgaattaactagttcgtcccttgcctcgttcgacttacgtcgggtaccg

SEQ ID NO: 72457 - DNA, 616 bp, Homo sapiens
  misc_feature: GYAE6OF02IRGG0.14.35.D02.1.454.CMB.1.raw
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
tcagcgtctagtaccacgaccggtgctcgatttagcacacgatagttgggtttgggtgcccaagctgctggagggcacggtcaccacgctgctgaggtgaagaagcctgggtctcggtgaaggtctcctgcaaggtttctggaggcacgttcgacacctacactatcaactgggtgcgacaggcccctggacaagggcttgagtggatgggaaggatcatccctattcgtcgtaataactaaattacgcacagagattccaagacagactcacgattaccgcggacaaattcaacggccaanagcctacatggattgaagcggcctgagtattggacgacncggcctttctagttactcgtgaccgtagagtaacgtcgactacgaataaactatcgtcccttagtcctactcgacttacgtcgggacctagggaacccctggtaccgtaccgtacctcctcacgtcctccaaccgacggccacttcggtccttacccctgccctacccttccctaccaacgtacgaccctaccgtccgttacggggaccctaacgacgccgggtacccgtcgggcctcggccgttacgacggtaacggtacgtaccgttaaccgg

SEQ ID NO: 72458 - DNA, 553 bp, Homo sapiens
  misc_feature: GYAE6OF02G05EC.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaacaataagaactacttagcttggtaccaacagtaaaccaggacagtctcctaagttgctcattttctgggcatctaccgggatcccggggtcctgagcgattcagtggcagcgggtcgtgggacagatttcactttcacctatcagcagcctgcaggctagaagatggtgctagtttactctgtcagacaattattaagtacgttaccttaccctacgtaccttttcggaccgtacggggaccaaggtccgtagggacacgttaaccgaaacgtaacgttcggtcggctacggacacccgttacg

SEQ ID NO: 72459 - DNA, 623 bp, Homo sapiens
  misc_feature: GYAE6OF02H6XJW.14.35.D02.1.454.CMB.1.raw
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
  modified_base (377)..(377): a, c, t, g, unknown or other
  misc_feature (377)..(377): n is a, c, g, or t
tcagcgtctagtaccacgaccggtgctcgatttagcacacgatagttgggtttgggtgcccaagctgctggagggcacggtcacacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtaataacaaattacgcacagagattccaagacagactcacgattaccgcggacaaattcacggccacagcctacatggagttgagcgctgagnttgacgacacgtctctattactgtgngagacgaactcgactacgaataaatntacgtccttgcctcttgtacctacgtgggacccgtacgggtaacctcgggtaccaccgttctcccttcgtacgccctacccaacgaacgggaccctagtcccggttcccttccccccgtacggccctaccccgttaccctacccgaacgacgacctacccgtcgtccgggggaccaccgtaccggccggaccccggtcggccgtcggcccgttcggtacgaacggtaccgtaccgtttaaccccgg

SEQ ID NO: 72460 - DNA, 760 bp, Homo sapiens
  misc_feature: GYAE6OF02IFORH.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacgggacatcgtgatgacccagtctccagactccctggctgtgtctcgtgggcgagagggccaccatcaactgcaacgtccgagccgtagagttgttttaacacagtcctaccaaactaagtaaacgaactaacttagctttacggtaacccaaacgaacgaaaaccgtacgggaacctagttacccgttaccgttaaaggttcgtaccttaccgttaattttttccgggtagggacccttaacgttacccggtaaacccgggggtaaacgttccccgggggttaccttaggacgtaccgtatttaccgaggttcggcgtaggtccggggttcgtcgggaaacctaggtaaccgttttcctaaccttttacccgaaccgtaacgtaccgacgttaccgacggtcccgtagtaccgtacggtacgtaagtaacgtagtcggtcgtacgtaagttttaacgtagtcgtagtaacgtaagtaatttagttaattaccgttaccttaccttaacgttaccgttttacggaacccggtacggaaccgtacgtaacggtacgtaaggtaacttaacccgtaaacggtaacgtcggttaggtccgtaccgaccgtaccgttacg

SEQ ID NO: 72461 - DNA, 517 bp, Homo sapiens
  misc_feature: GYAE6OF02GP0JE.14.35.D02.1.454.CMB.1.raw
  modified_base (238)..(238): a, c, t, g, unknown or other
  misc_feature (238)..(238): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttagcttggtaccaacagaaaccaggacagtctcctaagttgctcattttctgggcatctacccgggaatccggggtccctgagcgattcagtggcagcgggtctgggacagatttcgacttttcaccatcagcagcctgcaggctgaagattgtgctagtttattactgtcagactaatattatagttactcctactactttcgccgtagggaccaagcgtaggagactacaacgtactgtgactgaccactacg

SEQ ID NO: 72462 - DNA, 923 bp, Homo sapiens
  misc_feature: GYAE6OF02GZWEZ.14.35.D02.1.454.CMB.1.raw
  modified_base (243)..(243): a, c, t, g, unknown or other
  misc_feature (243)..(243): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgaggacgggccaccgatcaactgcaagtccagccagtgttgttttanacagctaccaaactaataacgaacttacgttagtctttacggtaaccaacgaacgaaaccgaggaactacgttccttaccgttaaaggttcgtaccttacttacgtttttccgagggtacctacgttacccggtaaaccccggggtacggttcccccgggggttaccctaggtaccggtaccgtacgttaccgaagggttcggtaccgtacggggtccggggttacgtacgggggaaccttaacgggttaccttttacccgtaaccgtttttaacccgaacccgtttaacgttacccggtaaacggtcccgtaaaccggttccccgttagggtacccggttaaggggtacccgttaacgggtaaaaacggttcgtttacgggggtttaaccggtaccgttttaaacgggtttttaaaccgtttaccggttacggtttacccggtaaacgttaaccgtttaaacgttttaaacgttttaaccggttaaaccgttttaaccccgtttaacccgtttaaacgttttaccggttttaccgggggacccgttaacgggggttaaacccccgttaggttaaccgggttaacgggtaaccgttaaaccgtttaaacccggaaacggtttaccgttacgggggttaccgtaaccggtttacccggtaacccgttacccgtttaaccgg

SEQ ID NO: 72463 - DNA, 754 bp, Homo sapiens
  misc_feature: GYAE6OF02I2E1Z.14.35.D02.1.454.CMB.1.raw
  modified_base (190)..(190): a, c, t, g, unknown or other
  misc_feature (190)..(190): n is a, c, g, or t
  modified_base (209)..(209): a, c, t, g, unknown or other
  misc_feature (209)..(209): n is a, c, g, or t
  modified_base (416)..(416): a, c, t, g, unknown or other
  misc_feature (416)..(416): n is a, c, g, or t
  modified_base (491)..(491): a, c, t, g, unknown or other
  misc_feature (491)..(491): n is a, c, g, or t
tcagcgtctagtaccacgaccggtgctcgatttagcacacgatagttgggtttgggggtaggctacaacaggcaggcaggggcagcaagatggtgttgcagacccaggtcttcatttctctgttgctctggatctctggttgcctacggggacatcgtgatcgacccagtctccagactccctggcctgngtctctggcgagcgggccnccgactcaactgcaagtccaggcccagacgttgttttacgacaggctaccaaacaagtaaagactacttagtcttaggtaaccaacaagaaacctaggaacctagtcctacctaagttcgctctagtttctgggtcatccgtacccgggaacgtcccggggtaccctgacggcgtacttctaaggtgacggtacggcggggttaccnggggacctaaggtatttaccgtaccgtttccaaccctattccaacgcgaacggtccgtacgggtaccaccgggtntaccgggtaaaggtacggttaccggttagggtaccgttaaaggtttttacgttaacccgttagttacccgaacggttacgtaaactttaacgttttaaacttaaacgttacccgttaacccttaaccgttaacccggtttttcgggaacccggtacggggtaaacctacggtacgggtaaccgttaacggtaaacgtttacccgtaaaacgggtacccggttagggtaccgggttacctacggtacccgtaacgtttaacccg

SEQ ID NO: 72464 - DNA, 198 bp, Homo sapiens
  misc_feature: GYAE6OF02GF294.14.35.D02.1.454.CMB.1.raw
  modified_base (193)..(198): a, c, t, g, unknown or other
  misc_feature (193)..(198): n is a, c, g, or t
tcagcgtctagtaccacgaccggtgctcgatttagcacacgatagttgggttagggggaagaggaagactggaccggtccccccgaggtagttcgaggtgcgtgggcacagccggcccgtgggctcgcctggtacaaggacttacttccgtactagacgctggaggcgggcgtggacgaaggccgcaagtagnnnnnn

SEQ ID NO: 72465 - DNA, 597 bp, Homo sapiens
  misc_feature: GYAE6OF02JHTEQ.14.35.D02.1.454.CMB.1.raw
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
  modified_base (536)..(536): a, c, t, g, unknown or other
  misc_feature (536)..(536): n is a, c, g, or t
  modified_base (554)..(554): a, c, t, g, unknown or other
  misc_feature (554)..(554): n is a, c, g, or t
  modified_base (580)..(580): a, c, t, g, unknown or other
  misc_feature (580)..(580): n is a, c, g, or t
tcagcgtctagtaccacgaccggtgctcgatttagcacacgatagttgggtttgggtcgacggtgggcgatgtgtgagttttgttcacaagatttgggctcaactctcttgtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataaacaaatttacgctaacagagtattccaaagaccagacctcacgattacccggcggaacaaattcacggccaacacgcctacatcggagttgagcgggcctaggagtattttcgaacgaccacggccctttctaagtttactggtacgtcgaagacgaacctcgctaacgaataaatactgcccttgcctctttagacttaacgtgggccacgggtaccctggtccaccgtcttaccnaccnctccaccgtaggcccnctccggtaccttccccgnggcctacccctcccgtacaagtaccncctaccgtccgtcgggg

SEQ ID NO: 72466 - DNA, 579 bp, Homo sapiens
  misc_feature: GYAE6OF02GN2O8.14.35.D02.1.454.CMB.1.raw
  modified_base (238)..(238): a, c, t, g, unknown or other
  misc_feature (238)..(238): n is a, c, g, or t
  modified_base (373)..(373): a, c, t, g, unknown or other
  misc_feature (373)..(373): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttagcttaggtaccaacagaaaccaggacagtctcctaagttgctctattttcgtgggcatccgtacccgggaatcccggggtccctgacgtcgattcagtgcaggcgggtntggggacagtatttccacgttttcacctatcagcagtcctgcaggctagaagtattgtggacgttagtttattactgtacagtactaaattacttatacgttacctcccttaactaccgttttcggaccgtacggggtaacctaaggtctacgggaagtacttaacgaaaccgtaacgttcggttacggacctgacctaccgtacg

SEQ ID NO: 72467 - DNA, 775 bp, Homo sapiens
  misc_feature: GYAE6OF02I1S79.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacggggacatcgtgatcgacccagtctccagcctccctggctgtgtctcgtgggcgaggacggccaccatacaactggacaacgtccaacgaccgagtagttacgttttaacacgacgtacctaccaaaactaaataaacgaaccttaacgttaacgtacgtttaacggaaacccaaacgaaacggaaaaccgacggaacctaacggttcctaaccgttaaagttcgaccttacgttacgttttaccggtcggactacgttaccggttaacccgggtacggttcccggggtacctaggacgtacgtacgtcgaggtcggcgtaggtccgggtacgtacggacgtattacgtttaccgtaactttaccaccgtacgttaccgaacgacgtccgtccgttaggccgtacggacgtacggaagtaacggtggtacggttaaccttaggtttacttacggtcgtaccgaagtaacgtaactttagttaaacctacgttacccgttaacttacgtttaaccggtttacgggaacccgtacgggtaaccgttaaccggtcggttaacggtaacggtaaacttaacggaaaccggttacggtacggtaccgtaccggtaccggtactaaccgttaccgg

SEQ ID NO: 72468 - DNA, 711 bp, Homo sapiens
  misc_feature: GYAE6OF02I4JLG.14.35.D02.1.454.CMB.1.raw
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtcgtggggctgaggtgaagagccgtgggtcctcggtgaacggtctcctgcgtaaggtttcgtggaggcacgttcgacacctacactatcaacgtgggtgcgacaggcccctgggacgaaggtcgttggaggtggagtaggggaagatcgacgtcccttagttccgttacgtaactaaactaaacttacgacaacaggtagtacttacctaaaggaactacgacctacgacgtaacgttacccggacggtaaacctaaagttaccgaacccggacccacgaacgtcccgtaactaacggtcgggtaaggttcggaacggccggtaccggtagacgtagtttacgaccggtacgtaacccgtcccgttacttaactttaaccgtgtaccggacggtaacgtacggtacccgttacggacccgttaaacgtaaaccgtttaaactaaccgttcggttaccccggtttacgtcccgttactttacccggtaaccgttacgggtcccggggttaaaccccgggg

SEQ ID NO: 72469 - DNA, 558 bp, Homo sapiens
  misc_feature: GYAE6OF02FTW22.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctaccaacaataagaactacttagcttggtaccaacagaaaccaggacagtctacctaagttgctcatttctggcatctacccgggaatccggggtcctgagcgattcagtggcagcgggtctgggacagtatttcactttcaccatcagcagcctgcaggctagaagatgtgctagtttattactgtcagacaatatttaatacgttaacctcccttaactacgttttcggaccgtacgggacctaaggcgtacggaacgtaactaccgaaaaccggtaacgttacggtacggtaccgtacgaccgtacctaacg

SEQ ID NO: 72470 - DNA, 549 bp, Homo sapiens
  misc_feature: GYAE6OF02IUFG9.14.35.D02.1.454.CMB.1.raw
  modified_base (306)..(306): a, c, t, g, unknown or other
  misc_feature (306)..(306): n is a, c, g, or t
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (460)..(460): a, c, t, g, unknown or other
  misc_feature (460)..(460): n is a, c, g, or t
  modified_base (464)..(464): a, c, t, g, unknown or other
  misc_feature (464)..(464): n is a, c, g, or t
  modified_base (475)..(475): a, c, t, g, unknown or other
  misc_feature (475)..(475): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtacgtataacaaattacgcacagagattaccaagacagactcacgattacgcgacaattcacggcacagcctacanggagttgagcggcctgtagatttgacganacggccttctatacgtgtgcgaganactgctaagataatncgtcctagcctctcgactacgtcgggctacggacctcgtccaccgtccncctcncncnccacgacggccactccgtcctccccgngccnccctccaccanacgccacctcgcgggtcacgacgccggcccgtcggtcctcggccgtcggtaccgaacggttacctacgttaccg

SEQ ID NO: 72471 - DNA, 579 bp, Homo sapiens
  misc_feature: GYAE6OF02I4N8L.14.35.D02.1.454.CMB.1.raw
  modified_base (359)..(359): a, c, t, g, unknown or other
  misc_feature (359)..(359): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaagatcatccctattcgtcgtataacaaattacgcacagagattccaagacagactcacgattaccgcggacaaattcacggccacagcctacatggagttgagcggcctgagatttgacgacacggccttctattactgtgcgagngaactcgctacgataaatatgccctttgacctcttgactacgtcggggccagggaacctggtccaccgtctcctcacgcctccaaccagggcccagtccgtccttccccgtcggcctaccctccttccaacgacgcacccgtcttcggggacaccgtacgccggtcccgtcgggtccgtacggtccgtcggttacgaaccggtacttacccgttacccgg

SEQ ID NO: 72472 - DNA, 710 bp, Homo sapiens
  misc_feature: GYAE6OF02IH5L5.14.35.D02.1.454.CMB.1.raw
  modified_base (506)..(506): a, c, t, g, unknown or other
  misc_feature (506)..(506): n is a, c, g, or t
  modified_base (564)..(564): a, c, t, g, unknown or other
  misc_feature (564)..(564): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacggggacatcgtggatgacccagtctccagacctccctggctgtgtctcgtgggacgaggagggccaaccagtaccaactgactaacgtccacgaccagacgttatttttacaacgtacgtacctacccgaaactaaataaaacggtaaaccttaacttacgtactttccggtaaaaccaaacgtaaacgaaaaccgacgggaactaacgttacctaaccgttaaaggtttcgcttacttagttttacgcgggactactaccggttaacccgggtaacgtccccggggtcctaggacgacgtacttacgaggtgcgtaggtcgggtcgtaggacctagttactttcctactttacaccgtanacgtacgctacgcgtcgacgaacggctagaagtcgtgtgtccttaagtttattacgtntacgtaagtactaagttactttaagtacttaccgtacctacgttaaccgtttcggaccggtacgggtaacctagggtaccgtaacggtagttaaccgtaaaccgtaaacggtaccgtagggtcgtacgtccgtaccgtaacctacg

SEQ ID NO: 72473 - DNA, 617 bp, Homo sapiens
  misc_feature: GYAE6OF02JMUE2.14.35.D02.1.454.CMB.1.raw
  modified_base (302)..(302): a, c, t, g, unknown or other
  misc_feature (302)..(302): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggagtgggaaggatcatccctattcgtcgtataacaattacgacacagagtattccaagacagactcacgataccgcggacaaattcacggccacancctacatggacgttgagcggcctgagatttgacgacacggccttctattacgtgtgcgagagaactcgctacgataaatactagcctttgccttccttcgtactacgtcgggccgacgggacctaggtcctaccgtcctcgtcacgccctccaccgacggcccacgtccgtaccctttccccgtacggtccctaccctcccgtaccgaacgtcgacccgtaccgtccggtccggggccgtacgaccggcccggtcccggtacgggccgttcggcccggtcggttacccgaacgggtacccgttaccgttacccgg

SEQ ID NO: 72474 - DNA, 785 bp, Homo sapiens
  misc_feature: GYAE6OF02JSDQQ.14.35.D02.1.454.CMB.1.raw
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
tcagcgtctagtaccacgaccggtgctcgatttagcacacgatagttaggtttgggggcactcacataacaaccagattcctcctctaaaggaagcccctgggagccacagctcatcaccatggactggacctcggaggttccctcgtttgcggtgcaggcagcctacacgctgtccagtcccaggtccagtctggtacgcagtccgtggggccttaggaggtcgaaagagtcccgttgggttcccctaggggtagaacgggtccttcccgtggtacgtaacggtttttcgtgggaggtccgaaccggttttcgaccgtaaaccctcgtaaaccctctaacgtaaccgtttgggtcggacctaacggaacggcccccgttggggaacctaaggtccgttcggaaggttggtacgttaggggaacggattccaacttccccgtagttaccgtaacgtacctaaactaagttaacccgnaaccgagganaacccttaccgaaaggaccttacgctaccgacgttaccgtttacgcggtaaactaacgttacgacggaccctaacgacgaacgtctaagtacggtacgtggacgtacggtaacctggtacctaaggtttccgaaaccggccgtaaacccgtcccgttaccgttaaacgtcccgtttaacgaccgtacggttaaacgaccgtaaccgtccgtaactaacccgggaattaaacctaacgtcccgttaaaccgttcggtaccttaacgttacgtaaacccgttccgggaccgtaacccggg

SEQ ID NO: 72475 - DNA, 702 bp, Homo sapiens
  misc_feature: GYAE6OF02H4RPF.14.35.D02.1.454.CMB.1.raw
  modified_base (240)..(240): a, c, t, g, unknown or other
  misc_feature (240)..(240): n is a, c, g, or t
  modified_base (683)..(683): a, c, t, g, unknown or other
  misc_feature (683)..(683): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagacctcctggctgtgtctctgggcgagacgggccacatacaactgcaagtccagccagagttgttttanacagctaccaaacaataacgaactacttagtacttcggtaacccaactaacgaaaccaaggaacaagtaccttaccgttaacgttggtactaccttatttttcgtcgggtactacgttacccgtaacccggggtaacgtccccgggggttccctggacgtcgtacgttacgtaggtcggcgagggtcggttcggtaggggaacgtaagtacttttctaccttttcaacccgtataccgagcgtaacgtccctagccgtaggctaggaaagtagttcggtcggtattaagttttactacgtacgttacgagtacctaaattaagtttacgtaacttacccttacccgttaacgtttacgttttccgggaaccgtaccggggaacctaacggtcgttaacgggaagtaacgtaacctaaaacggtacgttacggcgggttaaccncggtaccctaccgttaacg

SEQ ID NO: 72476 - DNA, 631 bp, Homo sapiens
  misc_feature: GYAE6OF02ICOVB.14.35.D02.1.454.CMB.1.raw
  modified_base (396)..(396): a, c, t, g, unknown or other
  misc_feature (396)..(396): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggttttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggcacagcctacatggagttgagcggcctggagatttgacgacgacggccttcattactgtgcgagagaactcgctaacgataaatatgtacccttgccctnttcgtactacggtcggggtaccgacggaaccgtcggtaccgaccgtcctcctcacgtccctaccacccgtaacgggccctacgtccgttacccttcccccgtcggtacccgtaccccttcccgtacccaacggtacgacccgtaccgtccgtacgggggtacccacggaccggccgggtcccggtcgggccgtcggcccgtcgggtaccgaacggtacccgttaccgttacccgg

SEQ ID NO: 72477 - DNA, 582 bp, Homo sapiens
  misc_feature: GYAE6OF02GYTKV.14.35.D02.1.454.CMB.1.raw
  modified_base (238)..(238): a, c, t, g, unknown or other
  misc_feature (238)..(238): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctccaacaataagaactacttaagcttggtaccaacagaaaccaggacagtctcctaaagttgctctattttctgggcatcctaccgggaatccggggtccctgacgcgattcagtggcagcgggtctgggacagtatttcgactttcacctatcagcaagcctgcaggtctaggaagtgtcggtggtacctagtttaactttacgtgtacaagtctaaatttagttaatacgttaccctaccttaacttacgttttacggaccggtacggggtacctaaaggtcgtagggtaataacgtaccgaaacgtacgtggtcggtactcggtaccaccgttacg

SEQ ID NO: 72478 - DNA, 783 bp, Homo sapiens
  misc_feature: GYAE6OF02JVX8N.14.35.D02.1.454.CMB.1.raw
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (486)..(486): a, c, t, g, unknown or other
  misc_feature (486)..(486): n is a, c, g, or t
  modified_base (514)..(514): a, c, t, g, unknown or other
  misc_feature (514)..(514): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacggggacatcgtgatcgacccagtctccagacctcccgtggctggtgtctcgtgggacgaggacgggccaaccgatacgaactggacaacgtccacgccaagngtttagttttacacgngtactaccaaataataagaacctacttacgtcttacgggtaaccaacgaacgtaaaccgaggtacagttacctacgtagtttacgacttacctagttttccggacgggtactaacgttccggtaaccgggtacgtacccgggttccctaggacgtcgtaacttcgacgtcggacacgggtcggttcgagggtaactaggtacgttactacgtttccacgtacncgtaacgcaacgtcttcggctaacggtntaggtaagtcggttagtcgaacgttacgttttaaactccgttaataccggtattaaccgttaagtttaaaccgttaacggtttaccggttaaacccctttacccggtaaacgttttaccgggtttacccgggaaaccgggttacgggaacccgttaaaacggggtcggtttaaaccgggtaacggttaacccggttaaaccccgaaaaggttttaccgggacggtttaccggggtacccgtaacggttaaccccgtaacccgtttacgg

SEQ ID NO: 72479 - DNA, 769 bp, Homo sapiens
  misc_feature: GYAE6OF02JQVFU.14.35.D02.1.454.CMB.1.raw
  modified_base (252)..(252): a, c, t, g, unknown or other
  misc_feature (252)..(252): n is a, c, g, or t
  modified_base (314)..(314): a, c, t, g, unknown or other
  misc_feature (314)..(314): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctcgtggtcgccgtacggggacatcgtgatcgacccagtctccagacctccctggctgtgtctcgtgggcgagacgggcccaccatcaactgactaacgtccagccagtagttgttttaanaccagcctaccaaacgaaataaagaaccttacttagtcttacggtaaccaacaacgaaaccnggactacggtactactaagttcgacttactatttcgagggacctagtacccggtaaccggtacgtccccgggggtacctaggacgtaccgtaacttcgacggtcggacgtacggtccgggttcggtaacggacgtaagttaaccgtttccgttaacccttttccggaaaccttcgtaccgtaacgtccgtaacccggtccgtacggtaccgtacgggtaccgttaagggtaaacgacgttggtaccggtaacgttaacgttttacgttaacggtacgtaacgtacgtaaacgttaagtttaacgttacgttaacccgttaaccgttaccccgtttaaagttacccggttttaccgggaccggtaacggggtacccttaaacgggcgtttaacggaaacgtaacccgttaaggaaaccgttagttacgggtctaaccggttaccaccgtacttacg

SEQ ID NO: 72480 - DNA, 530 bp, Homo sapiens
  misc_feature: GYAE6OF02FKS65.14.35.D02.1.454.CMB.1.raw
  modified_base (280)..(280): a, c, t, g, unknown or other
  misc_feature (280)..(280): n is a, c, g, or t
  modified_base (424)..(424): a, c, t, g, unknown or other
  misc_feature (424)..(424): n is a, c, g, or t
  modified_base (494)..(494): a, c, t, g, unknown or other
  misc_feature (494)..(494): n is a, c, g, or t
tcagcgtctagtaccacgaccggtgctcgatttagcacacgatagttgggtttggggacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtncgacaggcccctggacaagggcttggagtggatgggaaggatcatccctattcgtcgtataacaaattacgcacagagattccaagacagactcacgattaccgcgacaattcacggccacagcctacatggagttgagcggcngagattgacgacgacgccttctattactgtgcgagagaactcgactacgtataatatcgcccttgtcctnttacgtactacgtcggggaccacgggtaccctcggg

SEQ ID NO: 72481 - DNA, 622 bp, Homo sapiens
  misc_feature: GYAE6OF02FRNIY.14.35.D02.1.454.CMB.1.raw
  modified_base (238)..(238): a, c, t, g, unknown or other
  misc_feature (238)..(238): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagctcaacaataagaactactagcttgaccaacagaaacagacagtctactaagtcgctctatttcgtggcagtcgtaacccggtagtcccggggtacctgagcgtattcgagtcggcgacggtcgggtacgtggggaactggtactttcctactttccaccgtaatccgaagccgtacgtcccgtgacgaagggccttaggaacgtagttggtacggtcttaaggttttacgttacgttgtaacgtagacctaaagttacttaattaacgtaccttacccgtaacttacgtttcggaccggtacggggaacctaacggtcggacggtaactaagtaaccgaaaacggtacgttacggtagggtactacgactaaccgtacg

SEQ ID NO: 72482 - DNA, 553 bp, Homo sapiens
  misc_feature: GYAE6OF02HSIZ2.14.35.D02.1.454.CMB.1.raw
  modified_base (240)..(240): a, c, t, g, unknown or other
  misc_feature (240)..(240): n is a, c, g, or t
  modified_base (320)..(320): a, c, t, g, unknown or other
  misc_feature (320)..(320): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagagggccaccatcaactgcaagtccagccagagttgttttanacagctacaacaataagaactacttagcttaggtaccaacaagaaaccaggacagtctacctaagttgctctattttcgnggcatccgtacccgggaacgtccccggggtcctggacgcgtattcgagtggcaggcgggtcgtgggacagtatttcactttcacctatcagcagcctgcaggtctaggagagtgtgactagtttatctgtcagactaatattatagttacctcctacttacgtttcggacgtaggggacctaggcgtaggacgtaactacgaaacgtacgtaggtcggacgtcgaccactacg

SEQ ID NO: 72483 - DNA, 594 bp, Homo sapiens
  misc_feature: GYAE6OF02F43H9.14.35.D02.1.454.CMB.1.raw
  modified_base (237)..(237): a, c, t, g, unknown or other
  misc_feature (237)..(237): n is a, c, g, or t
  modified_base (285)..(285): a, c, t, g, unknown or other
  misc_feature (285)..(285): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
tcagcgtctagtaccacgaccggtgctcgatttagcacacgatagttgggtttgtgggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccacatcaactgcaagtccagccagagttgtttanacagctccaacaataagaacttacttagcttggtaccaacagaaaccnggacagtcnctaagtgctnattttcnggcactctaccgggatccggggtcctgacgcgattcagtggcaggcgggtntgggacagtactttcactttcacctatcagcagtcctgctaggctaggaacgagtcggtaggtcctagttttaactcgtgtactagacgtaacttaattagtaacgttacccttaccctaacgttaccgttttcgggacccgtacgggggtaccctaaaggtccgtaacgggtaacgtaacgttaacccgaaacgggtaccttagggtaccggtacgtacgtaccgtaaccg

SEQ ID NO: 72484 - DNA, 769 bp, Homo sapiens
  misc_feature: GYAE6OF02ITG8C.14.35.D02.1.454.CMB.1.raw
  modified_base (246)..(246): a, c, t, g, unknown or other
  misc_feature (246)..(246): n is a, c, g, or t
  modified_base (303)..(303): a, c, t, g, unknown or other
  misc_feature (303)..(303): n is a, c, g, or t
  modified_base (426)..(426): a, c, t, g, unknown or other
  misc_feature (426)..(426): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctgtgcctacggggacatcgtgatcgacccagtctccagacctccctggctgtgtcctgtggcgaggacggccacatcaactgacaacgtccagccgaagtcgttagttttanacgagtcctaaccaaactaataaacgaacttacttagacgtttaacggaacctaaanaacgaaaaccgtaggaacctacgtacttaccgtaaagttcgaccttactagttttacgcgggactacgtacccggtaaccgggtacgtcccgggggtacctagtacgtacgttacgtaaccgnggtacggtacgcgggtcgggtacggtacggtaacacggtttacctttacgtaacctttacccgacgttaactaccggacgtaacggtaccgaccttcggaacgtaacggtcgtaacggtagtaacggttcggttcggtaaccgtttaacgtttaacgttaccgtacgggttaactaacgggtacttaaaacggtttacttaagtaacccgttaaccgttaccccttaaggttccggttaacggtaccccggaaggggtaaccctaaacgggtcgtaaccggtaagtaaaccgtttacggaaccgttacttcgggttacgaccttccggtaaccactttcccgg

SEQ ID NO: 72485 - DNA, 615 bp, Homo sapiens
  misc_feature: GYAE6OF02IKMIG.14.35.D02.1.454.CMB.1.raw
  modified_base (177)..(177): a, c, t, g, unknown or other
  misc_feature (177)..(177): n is a, c, g, or t
  modified_base (216)..(216): a, c, t, g, unknown or other
  misc_feature (216)..(216): n is a, c, g, or t
  modified_base (354)..(354): a, c, t, g, unknown or other
  misc_feature (354)..(354): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtncgacaggcccctggacaagggcttgagtggatgggaagntcatccctattcgtcgtataacaaattacgcacagagattccaagacagactcacgattaccgcggacaaattcacggccacagcctacatggagttgagcggcctgagatttgacgacacggccttctattactgtncggagacgaactcgctacgataaatatcgtacccttgccctcttagtactacgtcgggaccgagggtaccctggtccgtaccgtcctcctcgtacgtcctaccaccgaacgggcccacgtccggttccttcccccgtcggtcctaccccgtcctacccgaacggtacctccgtaccgtcgtcgggggccaccgaccggtaccggtcccgtcggggtcctcggccgttacggtaccgtaacggaccgttacgttaaccccgg

SEQ ID NO: 72486 - DNA, 754 bp, Homo sapiens
  misc_feature: GYAE6OF02IND2R.14.35.D02.1.454.CMB.1.raw
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatcgacccagtctccagacctcctggctgtgtctctgggcgaggacgggccaccatacaactgacacgtccacgccgagagttgttttaacacgagtcctaccaaactaaataaacgtaaacctaacgttacgtacgtttacggtaaccaaacgaacgaaaccgaggtaacctacgttacctaccttaaggttcgtaccttacttagttttcgtcgggactagtacccgtacccgggtacgtcccggggtccgtcgacggtcgtagttaccaggtacggactcgggacggtcggtcgggtaacctaggttactttacgttaccgttttaccaaccgtaacttcgtaacggtcgtaaccggtcccggtacggcggtaaacgggtcgttacggaaggtaggttcgggtacgttaccgtttagggttttaacttcggtacgtacgtacggtacttaaaggtttaacttaacggtttacgttaacccgtttacccgttaaccgtttaacggttccggtaacggtaccggggtaaccaggttacggtaacggcttaacgttacgaaaacgtacgttcgtaggtcctacgttaccgacttaccg

SEQ ID NO: 72487 - DNA, 670 bp, Homo sapiens
  misc_feature: GYAE6OF02GO7GO.14.35.D02.1.454.CMB.1.raw
  modified_base (239)..(239): a, c, t, g, unknown or other
  misc_feature (239)..(239): n is a, c, g, or t
  modified_base (281)..(281): a, c, t, g, unknown or other
  misc_feature (281)..(281): n is a, c, g, or t
  modified_base (497)..(497): a, c, t, g, unknown or other
  misc_feature (497)..(497): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacgggacatcgtgatgacccagtctccagactccctggctgtgtctcgtggcgagaggccaccatcaactgacaagtccagccagtagttgttttanacagctaccaaactaataagaactactagcttaggaaccaanaacgaaacaggacagtactcctaagttgcctcgtattttcgcggacagttcccgtaacccgggtagtcccggggtcctgacgcgtattcaggtggacgtggcgggtctacgggacaggtactttacgaccttttccaacgtactacagcgaacgtcccgtagcgaggtacctagaagtagtcggtagtcgttaagttttacgtacgtgaccgtaanaaccttaattaggttaacttaacgtttaacccttaccctttaaacgttaaccgtttacgggtaaccggtaacggggtaacctaacgggtccggtaacgggtaaacgaacgttaaaccgaaaccgggttaactttaggggtaccggtacctaccgggtacccaaccgttaccgg

SEQ ID NO: 72488 - DNA, 776 bp, Homo sapiens
  misc_feature: GYAE6OF02I39VP.14.35.D02.1.454.CMB.1.raw
  modified_base (631)..(631): a, c, t, g, unknown or other
  misc_feature (631)..(631): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctcgtggtgaccgtacgggacatcgtgatcgaccctagtcctccagtctcccgtggctgtcgtctcgtgggacgagacgggccaaccgatcgaactgacaacgtccagaccagtagttcgttttaacacacggtcctaccaaactaaaacgtaacgtaaccgtacgttaacgtccgttaacggtaaacccaaaacgaaacggtaaaacccgaggacctaaccggttaccttacgttaaacgttcggtacccttacgtttaacgttttccggagggtaccctaacgttaccccgggttaaacccgggtaaccgttacccgggggtccctaaggttaaccggccttaagttccgtaaggttccggtacggacgggttccgggttacgtaacggggtaccgtaactttaccgttccgttaaacctttaccgaccgtaacttaccggaacgtccgtaacgtcccgttgacccggtaggtaccgtagaacgtacgtggttacgtnttaacggtttaatcgtacgtactacgtacttaagttacgtaacttccgtaaccgttccttaagttaaccgttgaacccgtggaacctagtccggtagtactacgtacgaaacgttcggtccgttacgacgacgtacgtacttacg

SEQ ID NO: 72489 - DNA, 759 bp, Homo sapiens
  misc_feature: GYAE6OF02JIIE0.14.35.D02.1.454.CMB.1.raw
  modified_base (146)..(146): a, c, t, g, unknown or other
  misc_feature (146)..(146): n is a, c, g, or t
  modified_base (255)..(255): a, c, t, g, unknown or other
  misc_feature (255)..(255): n is a, c, g, or t
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgnggtggcagcagctacagctgtccagtcccaggtccagctggtgctagtctgggctgaggtgaagacgcctgggtcctacgggtgaacggtcctcctgactaaggtttcngggacgctacgttcgactacctacgactactcgaacgtgggtcgcgtacacgggcccctagggaccgaagggtcgttacggaggtacggtaaggttacggggaaacggtactaccgtaacgttccccttaagtttccgggttacttaaacttaaaccgtaaaacgtttaccgacctaaccgaaggtaacgtaactttaaccgaaaggactaaacgtaccgtacgacgttaacgttaccggaacggtaactaaacgtcgaaccggaccacgtacgacctacgacgtaggtacgttacgtacggcggtacctagtacgtacgtttacggacgtaccgtaccgggtacccttacgttaacgttacgtacgggtacaccggtaacgtacgtaccgtacggacccgtaacgttaacgtaaacggttaccgtttacggtaccccgtttaccggttaccgttaccgtttaacggtacccgtttaaccgggtacccggggttaaaccccggg

SEQ ID NO: 72490 - DNA, 625 bp, Homo sapiens
  misc_feature: GYAE6OF02I0Y71.14.35.D02.1.454.CMB.1.raw
  modified_base (216)..(216): a, c, t, g, unknown or other
  misc_feature (216)..(216): n is a, c, g, or t
  modified_base (459)..(459): a, c, t, g, unknown or other
  misc_feature (459)..(459): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaagntcatccctattcgtcgtataacaattacgcacagagatccaagacagactcacgattaccgcggaacaaattccgacggccaacagcctacagtggagttgaggcgcctgagtatttgacgacgacggtccttctaatttacgtgtacgtcgaagaacgaactcgtactaacgaattaaagtatcgccctttagcctcttcgactacgtcgggccacgggaccctggcctaccgtcctccacnctccctaccgaccacgggccctagtcccgttccttccccgtacggccctaccccgtcctaccgaaacgcgtccctaccgtcggtcgggaccgaccggtacggcccgggtcccggtacggtccgtccggaccgtacggtacgaaccggttaccttaccgttacccgg

SEQ ID NO: 72491 - DNA, 673 bp, Homo sapiens
  misc_feature: GYAE6OF02FTH5Z.14.35.D02.1.454.CMB.1.raw
  modified_base (238)..(238): a, c, t, g, unknown or other
  misc_feature (238)..(238): n is a, c, g, or t
  modified_base (323)..(323): a, c, t, g, unknown or other
  misc_feature (323)..(323): n is a, c, g, or t
  modified_base (360)..(360): a, c, t, g, unknown or other
  misc_feature (360)..(360): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttanacagtctccaaacaataagaactacttagcttggtaacccaacaagaaaccaggacagtctacctaagttgctctaagttttcgngggacactaccgtacccgggaatcccggggtcctagngtcgagttcgagtcggactagtcgggtcgtacgggtacgtacgtactttaccgtacttttacgacctactactacgccgtacgcctaggaccgacggtactaggtaaaggagttaggtacggtacttaagttttacgttacgttacggtacacggtacctaattagtttaagtaccgttaaccgttaccctttaaccgttacgtttaccgggtaccgtaacggggtaccctaaggtccgtaacggtacgtaaccttaaccggaaaccgtaacgttcggtaccgggtaccgttaccggaccgttacccgtaacg

SEQ ID NO: 72492 - DNA, 583 bp, Homo sapiens
  misc_feature: GYAE6OF02JACIY.14.35.D02.1.454.CMB.1.raw
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagaggccaccatcaactgcaagtccagccagagttgttttanacagctaccaacaataagaactacttagcttaggtaccaacagaaaccaggacagtctacctaagttgctctatttcgnggcagtccgtaacccgggtaacgtcccggggtcctgacgcgtacttcgagttcggcaggcgggtcgtagggacagtactttcacttttacacctatcagcaacgcctgcgaggtctagaagtatggtgtacttagtttattactgtacagactaagttattaagtaacttaccttaccttacttacgtttacggaccggtacgggtaacctacggtcgtacggagtaactaacgaaacgtacgtggtacgcgtacgaccacttacg

SEQ ID NO: 72493 - DNA, 741 bp, Homo sapiens
  misc_feature: GYAE6OF02GHGA3.14.35.D02.1.454.CMB.1.raw
  modified_base (177)..(177): a, c, t, g, unknown or other
  misc_feature (177)..(177): n is a, c, g, or t
  modified_base (258)..(258): a, c, t, g, unknown or other
  misc_feature (258)..(258): n is a, c, g, or t
  modified_base (662)..(662): a, c, t, g, unknown or other
  misc_feature (662)..(662): n is a, c, g, or t
tcagcgtctagtaccacgaccggtgctcgatttagcacacgatagttgggtttgggtgccaagctgctggagggcacggtcgaccacgctgctgaggtgaagaagcctgggtcctcggtgaaggtctcctgcaaggtttctggaggcacgttcgacacctacactatcaactgggtncgacaggccccctggaccaagggcttagaggtggatgggaacggatcgactcctagttcgcgtaataaactaaattaccgnaacagtagattaccaagactaagactacacgataccgtacggaacaaagtcaacgccaacagcctaacagtggagttgagcgcttgacgtatttcgaaccggactacggtaccttacgttaactttactaggttaccggcggtaaagaaacgtaacccgtaccggtcttaaaacgaaacgttttaaaaataaaccgttcgttaccccgtttagtccccttacgtttaacggaccttttaaccgggaacggggtaccccgtaaacggggtaaacccggtccggtttaaccggaacccggttcccgtttaccacccgtaccggtacccttacccgtaaaccgaaaccggccccgtaaacgttcccggtaccctttaccccgtcgaccgtacccctcgacccgtaanacgtccaccttacgcggtctaaccggagcccggtaccccggtcgtacggtccctagtacgacggtacctcgttaacccg

SEQ ID NO: 72494 - DNA, 722 bp, Homo sapiens
  misc_feature: GYAE6OF02IAGPM.14.35.D02.1.454.CMB.1.raw
  modified_base (177)..(177): a, c, t, g, unknown or other
  misc_feature (177)..(177): n is a, c, g, or t
  modified_base (516)..(516): a, c, t, g, unknown or other
  misc_feature (516)..(516): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctgggagcacgttcgacacctacactatcaactgggtncgacacggcccctggacaagggcttgagtggagtagggaaggatcacttcctattcgtacgtaacgtaactaaacttacgacacagactataccaagacagacctacaacgtacttaccggacgaactaaacttccgaccggccacgacgtcctaacgagtggtagttggagcgtccgtggagtagtttagaccgactaccggtcttactactttacgtcggtacgacgaagactaaccgtcgactacgtaattaaacgtacgtctacctttcgtccttcttcgtaacgtaccggtcgggaccgacgggtaaccgtggtacctaccgttctacccgtcncgtaccctaccgaaccggaccggtcccgacgtttccccggtacccgtttccccgacgggtccctaccccgtacccttaacccgacgaccgtaccgtaccgttcgggaccgggaccgacggaccggggcccgtaccggttacggtaccgttcgggttacccggtaccgggttaacccaacgggtttacccttaccggttaaccccgg

SEQ ID NO: 72495 - DNA, 649 bp, Homo sapiens
  misc_feature: GYAE6OF02FP2GQ.14.35.D02.1.454.CMB.1.raw
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagacttaccaagacagactcacgattaccgcggacaaattcacggccacagcctanatgagttgagcggcctgagtnttgacgacacggtccttctattactgtgcgagagactcgctacgataaatatgtcccttagcctcttacgacttacgtgggaccgtaacgggtacccgtcggtcctaccgtcctccttcaccgtccctccacccgtaacgggccctacgtccggtcctttcccccgtcgtccctacccccttcccgtaccctaaacggaccgtacccaccgttcgtaccgggggaccgtaaccgaccggtaccccgggtcccgttacggggtcccgtacggtcccggttaccgggtaccgtaacgggtacccgttaccgtttaaccccgg

SEQ ID NO: 72496 - DNA, 853 bp, Homo sapiens
  misc_feature: GYAE6OF02JF41G.14.35.D02.1.454.CMB.1.raw
tcagcgtctagtaccacgaccggtgctcgatttagcacacgatagttgggtttgggggagctacaacaggcaggcaggggcagcaagatgggtgttgcagacccaggtcttcgatttctctgttgctctggatctctggtgcctacggggacatcgtgatgacccagtctcagactccctggcctgtgtctctgggcgagacgggccaccattcaactggctaaacgtcccagacctaggtagttacgtttttactacgacggtccttaccaaactaaagtaaacggtaacttaccgttaacgtctttacgggaaccaaaccgaagtaaaacccgaggacgtaacgtaccgttaccgtaaagttccggtaccttaaccgttaacgttttcgtacgggtacctacgttacccggtaacccgggtaaccggttccccgggggttaccctagggtacgtacgtaacgttcccgtaaagggtcccgggtactacgggtaccgggtttacgtacggggtaaaccgtaacgggttaacttttccgaacccgttttaccgaacccgtaacgtcccggttaagaccggtaaccggtccgtaaccggtacgtaccgggtacccgttaagggaaaccggtagtttacgggtaccggggttaccttaacgggtttttaccgttacggttacggttaaccaacgggttaacttaacgtttaaccttaacgttaaccgttaacccgtttacctaaacgttttaaccggtttacggacccgggtaacggtaacctaaccgggtctaagggtactaacgtaaccgaaacgttaaccggtgtacccggtagtccggacctattaaccgg

SEQ ID NO: 72497 - DNA, 662 bp, Homo sapiens
  misc_feature: GYAE6OF02FUAGQ.14.35.D02.1.454.CMB.1.raw
  modified_base (386)..(386): a, c, t, g, unknown or other
  misc_feature (386)..(386): n is a, c, g, or t
  modified_base (413)..(413): a, c, t, g, unknown or other
  misc_feature (413)..(413): n is a, c, g, or t
tcagcgtctagtaccacgaccggtgctcgatttagcacacgatagttaggtttgggggcatcacataacaaccagattcctcctctaaagaagcccctgggagcacagctcatcaccatggactggacctggaggttcctctttgtggtggcagcagctacagctgtccagtcccaggtccagctggtgcagtctggggctgaggtgaagagcctgggtcctgggtgaacggtcctctgacgtaggtttcaggaggcgtacgtcgaccaccgtactactatacgaacgtgggtcgacgtaccgcggtccctagggaccgagggtcttaggagtggagtacgggagatctacttaccgtagttctacgtaataacgtaatacgacanaggacgtactaaccgaacgacagtacncgtaacgactaccggaccgaaatactacgaccgccgtaacgacgacctacgacgttaggacgttaggacgccggtactggtaagttacgtttacggaccgacggtacccgttcttacgttacttacgtcggtacgacgtaacgtagtacccgtaggaccgttaaacgtaacttaaacgttaccgtacgttccccgttacgttacccttacgttacggttaccgttacccgggttccgggtaaccccggg

SEQ ID NO: 72498 - DNA, 741 bp, Homo sapiens
  misc_feature: GYAE6OF02I70LU.14.35.D02.1.454.CMB.1.raw
  modified_base (217)..(217): a, c, t, g, unknown or other
  misc_feature (217)..(217): n is a, c, g, or t
  modified_base (313)..(313): a, c, t, g, unknown or other
  misc_feature (313)..(313): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggntcatcctattcgtacgtataaactaaattacgcacagagattaccaagacagactacacgattaccggcggaacaattccacggccacacgcctanatgggtagtgacgcggctagagtattgacgacacggtccttctacttacgtgtagtgagaagaacgtcgacgtaagtaactaaagtacttacgtacccgttttcgacccctttgttacgtaacccgttaccggtacggggggtaaccccgtaacggggtaaccccgtttcgggttacccaaccccggttcccgttacccctccggtaaccgtccccgtaacccgaaccccggtaaccggacccgtaacgttccccggtacccgtttcccccgttccgggaccctacccccgttcccgttaacccaacggtaccgcctacccgttccgggtcggggcccgaacggtaaccggccccgggtaacccgttcgggacccggtcgtacccgggttcggtaaccggtaacggtcccgtttaccgtttaccccgg

SEQ ID NO: 72499 - DNA, 604 bp, Homo sapiens
  misc_feature: GYAE6OF02GXBZ7.14.35.D02.1.454.CMB.1.raw
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattacccgacgacaaattcacggccacagcctacatggagttgagcggctgagtattgacgacgaccggccttactattactgtcgcgtagagaactcgctacgataaatatcgtccctgcctcttagactacgtgggccacgggtaccctggtctacccgtctcctcgacgccctccaccgacgggcccacgttcccggtccttcccccgtcgccctaccctccgtaccaacgccaccgtacccttccgggcggggcctaacggccggtcccggcccggttcggacgtccggtccgttcgggtaccgacggtaccttaccgttaccccgg

SEQ ID NO: 72500 - DNA, 722 bp, Homo sapiens
  misc_feature: GYAE6OF02GT7FC.14.35.D02.1.454.CMB.1.raw
  modified_base (242)..(242): a, c, t, g, unknown or other
  misc_feature (242)..(242): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagacctccctggctgtgtctcgtgggcgagaggccaccatcaactgacaacgtccagccagagttgttttanacagcctaccaaacaataaacgaactacttagcttaggtaaccaacaagaaaccaggaacagtacctacctaagttcgtctactattttcgtaggccactccgtaccgggacgttcccggggtaccctggacgcgtagttcgaggtggacgtaggcgggtcgtaggggaactaggttactttaccgtaccttttaccaacctagtaccgacggtaccacggtcccgtaggaccgtacgggtaccgtaaggaaacggtacgttgggtacggttaccgtttaaggttttaaccttacgtacggttacctaaggtacctttaaaagttacgttttaaagttaaccgttacccttacccgtttaaacttccggttttacgggacccggtaacggggtacctaacggtcggttaaggaacgttaaccgttaaccgaaaacggtaccggttacgggtacgtacccggtacgtaccaacgtttccgg

SEQ ID NO: 72501 - DNA, 675 bp, Homo sapiens
  misc_feature: GYAE6OF02JEHWZ.14.35.D02.1.454.CMB.1.raw
  modified_base (294)..(294): a, c, t, g, unknown or other
  misc_feature (294)..(294): n is a, c, g, or t
  modified_base (338)..(338): a, c, t, g, unknown or other
  misc_feature (338)..(338): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgccgtacggggacatcgtgatcgacccagtctccagacctccctggctgtgtctcgtgggcgagacgggccaccatcaactgacaagtccagccagacgttggtttatacagctaccaaactaataaagaactacttagcttacggtaccaacganaaaccgtaggactagtacctacctaagtgcctactaattttcgngggtaccacttaccgtaacccgggaatccccgggggtctcggaggtccgtatcgaggtcggcctaggtcgggtcgtacggggactagtagttactaccgtttccaaccgtactacgacgacgtacgccctggtaccgaacgggtctacggaaagtacgttggtcggacgttaacgtttatttacgcgtacgagtacgtaaatttacctaagttaccgttacctaccgttaaacgttccgttttaccgggaccgtacggggaacccgtaaggttacgtaggtaacaacgttaccaaaaggtaccgttacggtacggtacgtaccgtacgaaccgtacg

SEQ ID NO: 72502 - DNA, 801 bp, Homo sapiens
  misc_feature: GYAE6OF02F9TR0.14.35.D02.1.454.CMB.1.raw
  modified_base (158)..(158): a, c, t, g, unknown or other
  misc_feature (158)..(158): n is a, c, g, or t
  modified_base (759)..(759): a, c, t, g, unknown or other
  misc_feature (759)..(759): n is a, c, g, or t
tcagcgtctagtaccacgaccggtgctcgatttagcacacgatagttgggtttggggacataacaaccagattcctcctctaaagaagcccctgggagcacagctcatcaccatggactggacctggaggttcctctttggtggtggcagcagctacngactgtccagtcccgaggtccgagctggtgcgagtcgtggggctggacggtggaagaacgccgtcgggtcctcgggtagaacggtctccgtgacgtaaggtttcgtgggacgggctacggtttccgaccgtacctacgtacgtaacttcgaaacgtcggggttgaccggaaccgtaccggtccccgttcgggtaaaaccgggaacgggggtcgttttaacggggaaccggttttggggaacgggtttacgggggaaaaacggtctttaaccgggaactttaccccgtagttttcccgggtttaacgaacgttaaaaccgtaaacgtttacccggacgtaaacggtacgaaacggttacgttaacccgaaagttaacgaacggaccttaaccgtaacggttaacgttaaccggaaccgaaacgttaacggttaccggaacgacccgtaaacgcggtaccttaacggtaacgaggttacggtagaccggtcgtacgtagagttagttcgaacgtacgcggtacccgttattcgttaccgtagtaccgtagaagtacgttaacgtctacggataacggtaactcggttactccgtcgtaccttntaaccgacgttcgggtaccggacgttaccgggacccgttcgg

SEQ ID NO: 72503 - DNA, 815 bp, Homo sapiens
  misc_feature: GYAE6OF02GPGL2.14.35.D02.1.454.CMB.1.raw
  modified_base (247)..(247): a, c, t, g, unknown or other
  misc_feature (247)..(247): n is a, c, g, or t
tcagcgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctcgtgggcgagacgggccaccatcgaactgactaagtccagccagtacgttgttttaanacgagtctaccgaaactaataacgaaacttacgttaagtcctttaggtaaccaaacgtaacgaaaaccgaggaacctaacgttacctaaccgttaaaggttcgtaccttacttaacgttttcggacgggtacctaacgttcccggtaaccccggggtaaacgttcccccgggggttaccctagggaccgtacggttaacgttccgaagggttcgggccgaacgggtccggggttaccgtacggggaccgtaagttacgttttccttaccgttttaccaaccgtaacgtccgaaacggccgtaacggtccccgtaggaccgtacggtcgttaacggtaacgtcggttaggttaccggttacgttaacgtttttacgtaccttaggtaacgtagtacctttaaagtacgtttaaaccgttaccgtttaaccctacccgtttaaacgttccgttttaacgggacccggtacgggtaacctaacgggtcttaacgggtaacttaaccgttaaacccgggtaaaccgtacggttaccgggttcggaacctttccgggacccttaacgttcccg

SEQ ID NO: 72504 - DNA, 724 bp, Homo sapiens
  misc_feature: GYAE6OF02GLF0D.14.35.D02.1.454.CMB.1.raw
  modified_base (193)..(193): a, c, t, g, unknown or other
  misc_feature (193)..(193): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
tcagcgtctagtaccacgaccggtgctcgatttagcacacgatagttgggtttgggggagctacaacaggcaggcaggggcagcaagatggtgttgcagacccaggtcttccatttctctgttgctctggatctctggtgccgtacggggacctagtcggtgattggaccctggtcctccgaggaccttcccngggtcctaggtctcgtcgtacgggacgtaggacggcccaccgacttacgaacgtcgacgtaacgtccaacgcgtagtacgttagttttanacgnaccgtaccaataagtaacgaactacgttggacctttaggtaacccaacggtacgaaaccgtacggtaacacgttactaaccgttaaggtcgtaccgtaccttaagttttcgcggtaaccgttaacccggtccgggtaaacggtcccggggtacctcgaacggtccgtattccgaaggttcacgggtacgtacgggttgaaggtaccgagtttacttacccgtcgtttaaccgacctagtaccgacgtcgactccgtacgacggcgtacgtagtacgtacttagggtaccgtgtttacgttaacttaccgtagtacgaacgttacttattacgtattaccgttacctaccgttagtacgtttcggaaccgtacggaactcgaggtacgtacgtaagttacccgaagtaccggttgtaccggagttacaccctataccg

SEQ ID NO: 72505 - DNA, 657 bp, Homo sapiens
  misc_feature: GYAE6OF02FV2YG.14.35.D02.1.454.CMB.1.raw
  modified_base (497)..(497): a, c, t, g, unknown or other
  misc_feature (497)..(497): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaacgtgggtgcgacaggcccctggacaagggcttgagtgatggaaggatcagtcctattcgcgtataacaaattacgcacagagacttccaagacagacgtccacgacttaccgacggacgaaattcacagccacagcctacagtacggagttgacgcggtcctgagtatttcgacgactaccggccttcgtattactgtgcggagcgaacgtcgactacgtaataaactagtcgtccttcgtcctacttcgacgttacgtacgggtccgaacggtacccggtacgtccgaccgtaccttcctcgacgccgtaccgaccacgggacccncgttccgttcccgttcccgttcggcccttacccgtcccgtacccgtaacgaccgtaccgtaccgttcccggtacgggggtacacccgacggtccccggtcccggtacggttaccgtcggtacccgttacgggtaccgtaccgggtaccctttaaccccgg

SEQ ID NO: 72506 - DNA, 663 bp, Homo sapiens
  misc_feature: GYAE6OF02HUJGF.14.35.D02.1.454.CMB.1.raw
  modified_base (258)..(258): a, c, t, g, unknown or other
  misc_feature (258)..(258): n is a, c, g, or t
  modified_base (368)..(368): a, c, t, g, unknown or other
  misc_feature (368)..(368): n is a, c, g, or t
  modified_base (428)..(428): a, c, t, g, unknown or other
  misc_feature (428)..(428): n is a, c, g, or t
tcagcgtctagtaccacgaccggtgctcgatttagcacacgatagttgggtttgggtgcccaagctgctggagggcacggtcaccacgcagctgaggtgaagaagcctgggtcctcggtgaaggtctcctgcaagggtttctggaggcacgttcgacacctacactatcaacgtgggtgcgacacggcccctggacaagggtcttgagtggatggggaaggatcactccctattcgtcgtaataacaaattacgcaanagagattaccaagacaggactcacgattaccgcggacaaattcacggccacagcctacatggagttcgaagtccggcctggacgtatttggaacgacgacggtccgtttntaattcgtggtgacgaggacgtattcgactagtaacttaaatagtcgtccttcgcccttnttgactaggtcggggaccgacgggaaccctggtcccacgttacctcctcgaccgtcctacccaaccgaacggcccagttcccggtccctttaccccgtccgcccgtaccccttccttacccgaagtaccgtaccgtcccgtacggttaccggggcctaacgaccggtccggaccccggttcgggtccgtaccgtcccggtcggtacggtaaacggtccttaacccggtttaccgg

SEQ ID NO: 72507 - DNA, 813 bp, Homo sapiens
  misc_feature: GYAE6OF02G6XL5.14.35.D02.1.454.CMB.1.raw
  modified_base (161)..(161): a, c, t, g, unknown or other
  misc_feature (161)..(161): n is a, c, g, or t
  modified_base (176)..(176): a, c, t, g, unknown or other
  misc_feature (176)..(176): n is a, c, g, or t
  modified_base (203)..(203): a, c, t, g, unknown or other
  misc_feature (203)..(203): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggagcacgttcgacacctanactatcaactgggtncgacacggcccctggacaagggcttgngtggagtgggaagatcactccctattcgtcgtaataactaatacgcaacagacgacttaccgaanacagactanaccgtattaaccgcggaactaaattcgaccggacacgtacgtacctacgaagttcggagttacggacggtccgggtcctaggtaagtacgtttaggaacccggtaaccgtaacccggggtcccttttaacgtaacgttttaccgtacggttacgacggttaacggaacggtaaaccgtccggtaacctaaacggtaaattaaaacgtcgtaaccgtcccgtttagtcccgtttacgttaccggtaaccgttaaccggtaccgggggtaacccgtaaccggggttaacccggtcggttacccgtacccgttacccgttccgttaccgtaccgttcccctaccggtaaaccgaaccgggcccttaacgtaccccgttccccgttaccccgtcgaaccctaccccttcgaaccctaaagacccgaccgtacccggtacggtaccggggaccctaacggaaccgggtcccggtacccggtccgtaccggtccggtccggttaccggtacccgaaacggtttccgttaacccgttacccgg

SEQ ID NO: 72508 - DNA, 613 bp, Homo sapiens
  misc_feature: GYAE6OF02IOCBK.14.35.D02.1.454.CMB.1.raw
  modified_base (217)..(217): a, c, t, g, unknown or other
  misc_feature (217)..(217): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacacggcccctggacaagggcttgagtggatgggaagntcatcctattcgtcgtataacaaattacgcacagagattaccaagacagactacacgattaccgcggaacaaattcacggccacacgcctacatggagttgaggcggcctgagtatttgacgacacggtccttactattacgtgcgacgagagaactcgactaacgaataaatactcgcccttgtcctcttcgactacgtcgggaccacggtaccctggtcaccgtctacctcacgtcctccaccgaccggccagtcccggttccttccccgtcggaccctacccgtcctaccgtaacgaccgtccgtaaccgtccgtacggggacctaacggaccgggcccggtcccgtcgggaccttcggccgttcggtaccgaacggtacctacgttacccgg

SEQ ID NO: 72509 - DNA, 688 bp, Homo sapiens
  misc_feature: GYAE6OF02GFB56.14.35.D02.1.454.CMB.1.raw
  modified_base (323)..(323): a, c, t, g, unknown or other
  misc_feature (323)..(323): n is a, c, g, or t
  modified_base (386)..(386): a, c, t, g, unknown or other
  misc_feature (386)..(386): n is a, c, g, or t
  modified_base (637)..(637): a, c, t, g, unknown or other
  misc_feature (637)..(637): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtgaaggtctcctgcaaggtttctggaggcacgttcgacacctacactatcaactgggtgcgacgacggccctggacaagggcttgagtggatgggaaggatcactccctattcgtacgtaataaacaattacgcacagagacttaccaagtacagactcacgacttaccgacggaacaaacttccacggtaccactagcctaacngtaggagttgagccggcctgacgtatttcgaacggtacgtaccggtccttactatttacgtgngtcgagacgtaacgtcgtactaacgtaataaacttgtacgtcccttgtcctcttagtacctacgtacggggaccgtaacgggtaacccgtcggtacctacccggtcctcctcgacggtccctaccccgaacccggtaacgggccctaacgtcccggttaccctttcccccgtccggtacccctcccttacccttaccacggtaaccgcctaccgtcggtcggggaccaaccgtacgggacccggtcccggnggtacccgtcggtaccgtcggttaaccgacgggtaccttaccgttacccgg

SEQ ID NO: 72510 - DNA, 782 bp, Homo sapiens
  misc_feature: GYAE6OF02JFFF5.14.35.D02.1.454.CMB.1.raw
  modified_base (237)..(237): a, c, t, g, unknown or other
  misc_feature (237)..(237): n is a, c, g, or t
tcagcgtctagtaccacgaccggtgctcgatttagcacacgatagttgggtttgggggagctacaacaggcaggcaggggcagcaagatggtgttgcagacccaggtcttcatttctcgttgttgctctggatctctggtcgaccgtacgggtactatcggtagatacgacctgtcctccgacgtaccgttcccgtggtccgtgtgtcctcggtacgggagacggacggcccaaccngtacctacgtcgacacgtccacgtcgtagtaggttagtttacacgtactccgttaaccaataacgtaacgtaacttaagttacgtcgtaacggtaaccaacgtaaacgaaaccgaggtaactacgtaccgttacgtaacgtttcgaccttaggtttactttacggcgacgttaccgtacccggttaacccgggtacgttcccggggttactacggaacgtcgtacgtccgtaggtccggcggtacggtcggtcggtagtcgtatttcgtaccgttctacgaccgtacgtgaacctccggtacgccgtagtcgtacgggacgttaggacgttggtaccggtttacggttaacgttacgtttacggttacgttacggaccgttaacgaactttacgttaacgttaccgtttacgttaccgttacccgtttaagttacccgggttaacgaaccgggttaccgtaacggttaaggttccggtaaacgtacggtaaacccgtaacgtaagtaccgggtcgttaacgccgtacgttacggtacccttcggg

SEQ ID NO: 72511 - DNA, 709 bp, Homo sapiens
  misc_feature: GYAE6OF02F624F.14.35.D02.1.454.CMB.1.raw
  modified_base (120)..(120): a, c, t, g, unknown or other
  misc_feature (120)..(120): n is a, c, g, or t
  modified_base (252)..(252): a, c, t, g, unknown or other
  misc_feature (252)..(252): n is a, c, g, or t
  modified_base (304)..(304): a, c, t, g, unknown or other
  misc_feature (304)..(304): n is a, c, g, or t
tcagcgtctagtaccacgaccggtgctcgatttagcacacgatagttgggtttgggtgcccaagctgctggagggcacggtcaccacgctgctgaggtgaagaagcctgggtcctcggtnaaggtctcctgcaaggtttctggaggcacgttcgacacctacactatcaactgggtgcgacacggcccctggacagggcttgagtggatgggaagatcatccctattcgtcgtataacaattacgcacaagngattccaagacagactcacgtattaccgcggtacaattcaccggaccacacncctactgtaggagttgacggccggacctggagtcgtttagacgacgaccgtccttctattacgtgtgtcgagagaacgtcacgtaacgataaactagtacgcccgtttgcccttcgttcgtacgtaccggtggggtacccgaacgggtaaccccggttcggtcccgtacccgtcccgttcccttccgaccgccccgttaccctaacccggaaaccgggtccccaacggtcccgttccccgtttccccccgtccgggcccccttacccctcccgtaaccctaaccgacggtaccctaccgtccggtacggggtacccacgggacccggcccggtcccggtacggtccggttccggttcccggttacgggttacccgtaacggtacccgttaccgtttaaccccggg

SEQ ID NO: 72512 - DNA, 500 bp, Homo sapiens
  misc_feature: GYAE6OF01D4OFS.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcggacccaggctatggatgaggctgacttttactgtcaggcgtgggacaccaacactgtggttttcggcggtagggaccaagcgtgaccgtctaggtcagcccaaggctgccccctggtctaccg

SEQ ID NO: 72513 - DNA, 499 bp, Homo sapiens
  misc_feature: GYAE6OF01B1DT2.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcggacccaggctatggatgagctgacttttactgtcaggcgtgggacaccaacactgtggtttcggcggagggaccaaggctgaccgtcctaggtcagcccaaggctcgcccctggtcctaccg

SEQ ID NO: 72514 - DNA, 501 bp, Homo sapiens
  misc_feature: GYAE6OF01B0N31.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtcccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcggaccaggctatgatgaggctgtacttttactgtcaggtcgtggacaccaacacgtgtggtttcggcggaggaccgaagcgtgaccgtctggtcagcccgaaggctcgccccctggtcctaccg

SEQ ID NO: 72515 - DNA, 510 bp, Homo sapiens
  misc_feature: GYAE6OF01AJS5Z.43.72.G06.1.454.CMB.1.raw
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaaacggccctacagggatcctgagcgattctctggctccaactctgggaacacagccactctgaccatcagcggacccaggctanggatgaggctgtacttttangtcaggcgtggactaccgaacactgtggtttcggcggagggaccaaggccgtggacccgtcgtaggtccagcccaaggcctcggccccctggtcctaccg

SEQ ID NO: 72516 - DNA, 555 bp, Homo sapiens
  misc_feature: GYAE6OF01EXU1B.43.72.G06.1.454.CMB.1.raw
  modified_base (416)..(416): a, c, t, g, unknown or other
  misc_feature (416)..(416): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaagttggggaataaatatgcctcctggtatcagcagaagccaggcgagtcccctgtgttggtcatctatcaagatgacaaacggccctacagggactccctgagcgattctctggctaccaactctgggaacacagccactctgaccatcaggcggaccaggctagtgatgaggtctgtacttttacgngtcgagggtcgtcgggaccaccgaactacgttggttacgggtttccggacgggtacgggtaccgaaggtccgtacggtacccggtccggtaggtccgacgacccgtaacggcctaccggcccccctcgggtcctacccg

SEQ ID NO: 72517 - DNA, 535 bp, Homo sapiens
  misc_feature: GYAE6OF01EB5A6.43.72.G06.1.454.CMB.1.raw
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattggggataaatatgcctcctggtatcagcagaagccaggcgagtcccctgtgttggtcatctatcaagatgacaaacggccctacgagggactccgtgacgcgattctctggcctccaactcgtagggaaccacacgccactctcgaccatcaggccgggacccaggcctagnggatggagtctagtacttttacngtcgagggtcgtgggaccaccgaacacgttggtcggtttcggcggacggaccgaagtcgtcgtaccgtcgtaggccacgcccgtaaggctacgcccccgtgtcctaccg

SEQ ID NO: 72518 - DNA, 575 bp, Homo sapiens
  misc_feature: GYAE6OF01AST1Q.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagacagcatcacctgctctggagataaagttggggataaatatgcctcctggtatcagcagaagccaggcgagtcccctgtgttggtcatctatcaagatgacaaacggccctagacgggactccgtagagcgtattcctctggcctaccgaactcgtagggaacacacgccactcgtcgaccatcgaacgccggaacccaggctagtggatggacgtctagtacttttacgcgttcgaggtcgtacgggaccaaccgaactacgttggttacggtttcgggacggacgggaccgtaacggaccgtcggacccgttccggtaacggttcacggacccgtaacggccgtaccgcccccgttcggtccctaccccg

SEQ ID NO: 72519 - DNA, 622 bp, Homo sapiens
  misc_feature: GYAE6OF01BR1YI.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaagttggggataaatatgcctcctggtatcagcagaagccaggcgacgtccctgtgttggtcatctatcaagatcgaacaaaccggccctacgagggactcccgtagacgtcgattctctggcctccaactcgtaggaaccacacgcctactctcgaaccctagtacgacggacccgggaacccgaggtacctagtgggtaagtagggaggtcgttcgttaacttttacgtgtcgtaagggtcggtacgggacctaaccgaacgtacgttagggttacgggtttccggaccgggtacggtacccgaaaggtccgtaccggtacccggttacccgttaggtaccgtaccgaccccggtaacggcccgttacccgcccccgttcggtcccgtacccg

SEQ ID NO: 72520 - DNA, 609 bp, Homo sapiens
  misc_feature: GYAE6OF01B1G54.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaagttgggggataaatatgcctcctggtatcagcagaagccaggcgacgtcccctgtgttggtcatctatcaagatcgaacaaaccggccctacgagggactccgtgacgcgattctctcggcctaccaactcgtagggaacacgacgaccactcctcgaaccatacgacggacccgggacccagggtactaagtgggactggacgtccgttgtacctttttacgcgtcgtaggcggtacggacctaaccgaacgtacgtggttcgggtttacggacgggtaacgggaccgaacggtccgtacggtacccgtaccgtacgggttaccgacggtaccccggaaccggtccgttacccggccccccgttgggtcccttaccccg

SEQ ID NO: 72521 - DNA, 738 bp, Homo sapiens
  misc_feature: GYAE6OF01CQ6EQ.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtcccccaggacagacagccagcatcacctgctctggagataagttggggataatatgcctcctggtatcagcagaagccgaggcgacgtccctgtgttggtcatctatcaagatacgaaccaaacggccctacgaacgggactcccgtgacgtacgtattcctcgtacggcctaccgtaacgtcgtacgggaaactaccgacggacctacctaccgtacggacctacgtaccgacgggaccccgggtacccgaaggtaccgtacgtagggaacgttacgggaacgggtcctttaggttaaccgtttttacgtccggttacggaaccgggtccgggttaaccggggaaccctaacccgtaaacggttaccgtttcggggtttacggggttttacccggggaaccggggtaaccggggtaacccggtaacgggtacccggttaacccgggtaaccccggtttcccggttaaaccgggtaacccgtaccggtaacccccggtaacgggtaccccgttcccgggtacccccccgttcgggtccccgttaacccgg

SEQ ID NO: 72522 - DNA, 747 bp, Homo sapiens
  misc_feature: GYAE6OF01B476J.43.72.G06.1.454.CMB.1.raw
  modified_base (225)..(225): a, c, t, g, unknown or other
  misc_feature (225)..(225): n is a, c, g, or t
tcagtgtgagtagtcacgaccggtgctcgatttagctacgactgcaagggaaaggggctgggcctcaggaagcagcatcggaggtgcctcagccgatggcatggatccctctcttcctcggcgtccttgcttactgcacaggatccgtggccgcctatgagttgactcagccaccctcagtgtccgtgtccccaggacagacagccagcatcacctgctctgganataaagttggggataaatatgcctcctggtatcagcagaagccaggcgagtcccctgtgttggctatctatcaagatgaacgtaaacggccctacgacgggtactaccccgtgacggtacgtattaccgtcgtcggtcctaccgaaaccttccggtaacgggaaacctaccgacggtaccctaacctcttacgaacccgtaagtccgaacgggacccgggaaccccgaggtaccgttaacggttgggtaacgttacgggaaggtcccgttaggttaacccgttttttacgtaccgggttacgagggggtacccgggtagggtaacccgtaaacccgaaccgttaacggtttacggggtttacggggttttacccgggacgggggtaaacggggtaccccgtaaaggtcccggttaacgggtaacccccgttccgggttaacggtacccgtaaaccgggtaccccgtaaacgggcccggttacccccggtccccccggtttaccgggtcccgttaacccccgg

SEQ ID NO: 72523 - DNA, 709 bp, Homo sapiens
  misc_feature: GYAE6OF01CMU8J.43.72.G06.1.454.CMB.1.raw
tcagtgtgagtagtcacgaccggtgctcgatttagctacgactgcaaggggaaagggggctgggcctcaggaagcagcatcggaggtgcctcagccatggcatggatccctctcttcctcggcgtccttgcttactgcacaggatccgtcggccgcctatgagttgactcagccaccctcagtcgtccgtcgtccccaggacagacacgccagcactcacctgctcgtggagtaagttaaaggttagggggaattaaagtatcgtacccttccgtggtactacgagacgaagaacgccgaggccgacgtcccgttggtggttggtcatctatacgaagatacgaacgaaccggccctacgacggtactccgtagacgtcgtacgttcgtacgtcgtacctacctaacgtcgtacggaacacgacgtacctactacgtacgacctacgtaccgacgggacccggtaaccgagtacgtagtagggacgtacggacgtacgttacgtttacgttttacgtcggtacggtaacgggtaccggtaccgggaaccctaaccgtaacgtacggtttacggggttacgggttaccggggaccgggtaacggaaccgtacggtaccggttaccgggtaccccggttacggtcgggtaacccgacccggacccggtaaccggtccccgtacccggtacccccgtcggtcccttacccgg

SEQ ID NO: 72524 - DNA, 644 bp, Homo sapiens
  misc_feature: GYAE6OF01A8UUY.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaagttgggggataaatatgacctcctggtatcagcagaagccaggcgagtcccctgtgttggtcatctatcaagatgacaaacggccctacgagggactccgtgacgcgacttactcgtggcctacccaacttccgttacggggaaaccaacctacggaccctaaccgttcctacggaaccctacgtaccgaacggcccggggaaccccagggtaccgtaagtcggagtggacggtcgtaggttaacttttacgtcgttacgagggtccgtagggaccaccgtaacaccgttaggtacgggttttccggacggggtaggtaacccgaaggccctacgggacccgttaccggttacgggtccgaaccggtaccccgaacgggtcccgtaccggtccccccgtacggttcccgtacccg

SEQ ID NO: 72525 - DNA, 581 bp, Homo sapiens
  misc_feature: GYAE6OF01DBWGJ.43.72.G06.1.454.CMB.1.raw
  modified_base (296)..(296): a, c, t, g, unknown or other
  misc_feature (296)..(296): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccacctcagtgtccgtgtccccaggacagacagccagcatcacctgctctggagataagtggggataatatgctcctggtatcagcagaagccaggcgacgtccctggtgttggtcatctatcaagntagacaaacggccctacgacggtactccgtgacgcgtattctcgtcggtcctacctacgtcgtaggaacacgacgcctactctacgacctatccgacggccggaccaggtacctagtcggatcggagtcttacgtttactttacgcgttacgacgggtcggtacggaacctaccgtaacgtcgttgggttcgggttacggacgggaacggacacggtcgtacgtacccggttacgtcggtaccgacgcccgtaacggtccctcccgtaccccgtggtcctacccg

SEQ ID NO: 72526 - DNA, 623 bp, Homo sapiens
  misc_feature: GYAE6OF01C22RP.43.72.G06.1.454.CMB.1.raw
  modified_base (221)..(221): a, c, t, g, unknown or other
  misc_feature (221)..(221): n is a, c, g, or t
  modified_base (298)..(298): a, c, t, g, unknown or other
  misc_feature (298)..(298): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcacgccaccctcagtgtccgtgtccccaggcagacagccagcatcacctgctcgnggatataagtggggaataaatatcgcctcgtggtatcagcagagccaggcgacgtccctgtcgttgtctgtctatanagatacgaccaaacggcctacgacggactccgtgacgtcgtattcgtctcggcctacctacgtcgtacggaacacagccctactcgtacgaccagtaccgacgggcccggaaccgtacggacgtacgtggtacgtacggtacggtcttacgttaccttttagtcgtacggagggtccggtacggaaccctacctacggttacggtttcggttacgggtttccgggacgggtacgggacccaaggtccgttacggacccggttcggtacgggtaccaccggaccgtaacgggccttaccccggtccccgtccggtaccttccccgg

SEQ ID NO: 72527 - DNA, 658 bp, Homo sapiens
  misc_feature: GYAE6OF01D4C7V.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataagttaggggataaatatgcctccgtggtatcagcagaagccaggcgacgtccctgtgttggtcagtctatacaagatagaacaaacggccctacgaggactcccgtagacgcgtattctcgtcggactaccactcgtacgggaacacgacgccactcgtacgacccagtacgaacgggacccgggaacccgaggtacctaggtggtagtacgggacggtccttaggtttaacctttttaacggtcgtacggtacgggtaccggtacgggaacctaacccgtaaaccgttaccggtttgggttacggggttttaccggggacgggtaaccgggaccgtaacggtccgttaccggtacccgttacggtacggtccgaaccggaccccggaacggtccgtacccggtacccccggttggtacccgttaccccgg

SEQ ID NO: 72528 - DNA, 618 bp, Homo sapiens
  misc_feature: GYAE6OF01C31HG.43.72.G06.1.454.CMB.1.raw
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
tcagtgtgagtagtcacgaccggtgctcgatttagctacgactgcaagggaaagggggctgggcctcaggaagcagcatcggaggtgcctcagccatggcatggatccctctcttcctcggcgtccttgctactgcacaggatccgtggccgcctatgagtgactcacgcccaccctcgagtcgtccgtcgtccccaggaccagacacgccagcactcactgctcgtggagtaagtaaagtggggaataaatatcgacctacgtggtatacagcgagaacgcacggacgcgtcccgtggtgttcgtcatctatacgaagatacggaacaaacggccctacgagggactccgtagacgtacgattcctcgtacggcctaccaacttacgcgggaacacgacncctactactacgaccgtanacgaacgggccggaaccgacggtactaggtagagtgacgttctacgtttaccgttagtcggtacgaacgggtcggtacgggaaccaacccgtaacggttacgtgggtttacgggttacggacgggaccggtacgaacgtacgtcgacgtccggtacggtcgaccgtcgaaccggtctaccggaccccttgcccgtacc

SEQ ID NO: 72529 - DNA, 759 bp, Homo sapiens
  misc_feature: GYAE6OF01C6PTA.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtcgtccccaggacagacagccagcatcacctgctctggagataagtaggggataagtatcgcctctggtatcagcagacgcaggcgacgtccctgtcgtggtcatctatcaagatagaacgaaacggccctagacgggtactcccgtgacgtacgtagttcctcgtcggtaccctacccgtaaacgtccgttaaacggggaaacccaacgtaaccggaccctacctaccgttaccgaaccctaacgttaccgaaaccggggacccggggtaaccccgaacgggtaccgttaacggtacgggtaagttacgggtaacgggttacctttacgggtttaaccgttttttaacgtccgggtttaccggaacggggtaccgggttaaccgggaacctaaccccgtaaacgtacggttttacggggtttacgggttttaccggggaaccggggtaacgggaacccgtaacgggtacccgttacgggtaccccggttaccggtaaccgggttaccgaacccggtaccccgtaaacgggtcccgttaccccggtaccccccgtcgggttcccttaaccccgg

SEQ ID NO: 72530 - DNA, 796 bp, Homo sapiens
  misc_feature: GYAE6OF01EM8RL.43.72.G06.1.454.CMB.1.raw
  modified_base (225)..(225): a, c, t, g, unknown or other
  misc_feature (225)..(225): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacacgccagcatcacctgctctgganagtaagttggggaataaatatgcctccgtggtatcgagcagaacgccaggcgacgttcccctggtgttcggtcagtctatacaagagtacgaaccgtaaacggccctacgacgggtactcccgtagacgtcgtacttctcgtcggtacctccgtaacgttcgtacggggaaaccaccgtacggtaccctaaccttccgtaccgtaaccctacgttaccggaaccggggaccccgggtaacccccgtaagggtaccgttaacggtacggggtaacgtttacgggacgggtaccgtttaaccggtttaaccttttttaacccggtgggttacccggaaggggttaccgggttaacggggtaaccctaaacccggttaaccgtaacggtttaccgggtttacgggggttttacccgggaccggggtaaaccggggtaacccgtaaacgggtacccggttaacccgggtaaccccggtttacccggttaccggggtaacccggaacccggttaacccccgggtaacggtccccgttaccccgggtccccccgttcgggtaccccttaacccccgg

SEQ ID NO: 72531 - DNA, 869 bp, Homo sapiens
  misc_feature: GYAE6OF01AY8RH.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgtagttgactcacgccaccctcagtcgtccgtcgtccccgaggacagacacgccagcactcacctgctctaggagaagtaaggttggggaataaatagtcgtccctccgttaggtactcgacgacgaacgacgaccgacggccgtaccgttccccgtggttcggtttcggtactacttacgtacgtaccgaagtaactacggaaacccgtaaacccggtccccgttaacggtaaccgggtaccctccccggtacggtaccggtaaccggttactttacccggttaccgtccggtaccccttaacccggtaaccgtttaccggaaccgggtaaacccacccgtaaccggtacccctaaccgttacccgtaacccgtaacccgtaaccgtaccggtaaccggggtaaccccgggaaccccggttaacggtaacccgttaagggttaccgggtaaacggtacggggtaacccggtttaccgtttaaccggtttaacccggtttttacggtacccggttaacgggttaccgggtaccgggttaacccggaaacccgtaacccgttaaccggttacggtttaccgggttacgggtttaccgggaacgggtaccggtaccgttaacggtccgtaccggtaaccgtccgtaacgggtaccgtacccggacccgtaacggtccccgttacccggtacccccgttcggcccgtttaccccg

SEQ ID NO: 72532 - DNA, 655 bp, Homo sapiens
  misc_feature: GYAE6OF01EBF9T.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtcgtccgtcgtccccaggacagacagccagcatccactgctctggagaagtaaagttggggaataaagtatcgcctccgtggtactcgagcagaacgccgaggcgacgtccctggtggttcgtctagtctatacaagatacgaacgaaaccggccctacgaacgggtactcccgtagacgtacgtattcgtacgtcggtacctaccctaacgtcgtacggaacctacgacgtccctactacctacgaccagtaccgacgggacccggaaccgacggtacgttaggacggtagtcggacgtcgttaccgttacttttacgtagtacggagggtccggtacgggaaacctaccgtaacggttacggttcggtttacgggttccgggacggaacgggtacaacgggttcgtccgggtaccgtcggtacggaccgaccgaccggtacggtacctcccggtccccgttcggtccctacccg

SEQ ID NO: 72533 - DNA, 626 bp, Homo sapiens
  misc_feature: GYAE6OF01CRFTF.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaagtggggataatatgcctctggtatcagcagaagcaggcgagtccctgtgttgtcatctatacaagatagaacaaaccggccctacgagggactccctgacgcgtattcctcgtggtcctaccaacgttcgtagggaaacctacgacgacccactaccgtacgaccaacgtcgacggaccgggaccctacgggactagtgggagtggagtcttcggttacttttacgtcgtcgacgggtaccggtacgggtaaccaaccgtaacgtacggttacggttcgggttttccgggacggggtaacgggacccgaaggtccgtacggtacccggttccgtaacgggtccgaaccggtcccgaacgggtacccgtccggccccccgttcgggtcccttaacccg

SEQ ID NO: 72534 - DNA, 688 bp, Homo sapiens
  misc_feature: GYAE6OF01BU9SJ.43.72.G06.1.454.CMB.1.raw
  modified_base (313)..(313): a, c, t, g, unknown or other
  misc_feature (313)..(313): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtcgtccgtgtcccaggacagacagccagcactcacctgctctggagtataagtggggtaataaagtagtcgtcctctaggtactcgagcgaagacgccaggcgacgtcccgtgtgtcggtcagtctatacaagntagacgaaccggcctacgacggactcccgtggacgtcgtacttcgtcgtcggtcctaccgtaaaccgtcgtaacgggaaccaacgaccgttacccgaactttaccaccggaacctactaccggaacgggttcccggaacccgaaggtcctaaaggtcggaacgttacgggacgttacgttacgtttacgttttaacgtcggtaccgtaagggtccggtacggaaccgtaacccgtaaacggtgtttaccggggttacggtttaccgggacgggtaccggtaaccgtaacggtcccgtacgggtaccctaaccggttcggaccgaccgtcccgtaaagggtcccctacccggtccccgtcgggtcccttaccccgg

SEQ ID NO: 72535 - DNA, 669 bp, Homo sapiens
  misc_feature: GYAE6OF01A9BTJ.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttcgactcacgccaccctcagtcgtccgtcgtccccaggacagacagccagcatcacctgctcgtaggagaagtaaagtggggataaatatagccttaccgtaggtactcgtagacgaagacgcgaggcgtacgtccctggtgttggtacatcgtatacgaacgagtacgaaccgaaaccggtcccgtacgtaacggaccgttacccgtacggagtcgtacttccgtacgtccggtactacccgtaacgtccgtacgggaacaccgacgtacccgactacgtacgacacgtacgacggacggaccgaggtctagtgagtagacgtacttacgtaacgtttacgtgtacgacggtcggtaccggtacgaaccgtaaccggtacgttacggttcgggtttacccgggaacgggtacgggtaccgtaacggtccgaccggttacccggtacgttacggtccgaaccgtacccgaacgttccccgaccggtccccgtccgggtacttacccgg

SEQ ID NO: 72536 - DNA, 853 bp, Homo sapiens
  misc_feature: GYAE6OF01DTKGE.43.72.G06.1.454.CMB.1.raw
  modified_base (117)..(117): a, c, t, g, unknown or other
  misc_feature (117)..(117): n is a, c, g, or t
  modified_base (136)..(136): a, c, t, g, unknown or other
  misc_feature (136)..(136): n is a, c, g, or t
  modified_base (229)..(229): a, c, t, g, unknown or other
  misc_feature (229)..(229): n is a, c, g, or t
tcagtgtgagtagtcacgaccggtgctcgatttagctacgactgcaagggaaaggggctgggcctcaggaagcagcatcggaggtgcctcagccatggcatggatccctctcttccncggcgtctgcttactgcanaggatccgtcggccgcctatggagttgactcacgcccaccctcagtcgtccgtccgtcccgaggacgacgacacgcagcactcacctgctcgnggaagtaagttaaaggtaggggtaataaactagtcgaccgtcgtgtactacacgacgaaggaacgaccgacggccgtaccgttcccgttggttcgttcggtactacgtactaagtacaagtacgtacgaaaccgtaaccggccgtacggacggtacctccgtaggacgtcgtacttccgtacgtcggtacctaccgtaacgtcgtaacgggaaccaacgccgtacctactacgtaccaacctacgtccggaaacgggtcccgggtaaccgagggttaccgtaggtacggtacgtaacgggtccgttaccgttacggttttaaaccgtttacggtacggtaacgggtacggggtaccggttaaccgggtaaaccccttaacccggtaaacgggttttcccgggtttaaggggtttaccccggggggttttacggggaaacccggggtaaaccggggtaaacccgttaccgggtaacccggtttaccccggggggtaaacccttttcccgggaaaaccgggtttaaaccccgacccgggtaaaccccccgggttaacgggtttccccccggttaaccccccggggttcccccgggttcccgggttttaaacccccttccccccggg

SEQ ID NO: 72537 - DNA, 726 bp, Homo sapiens
  misc_feature: GYAE6OF01BX2I0.43.72.G06.1.454.CMB.1.raw
  modified_base (224)..(224): a, c, t, g, unknown or other
  misc_feature (224)..(224): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctgganataagttggggaataatatgcctcctggtatcagcagaagccaggcgacgtcccctggtcgttggctatctatacgaagtatagaaccaaaccggtccctacgacggtactccgtaggacgacgtacttcctacgtcggtcctacctaacgtaccgtacgggaaaccacgaccgtaccctaccgtcgtacgtaaccctacgtaccgaaccggggacccgggtaacccgagggtaccgttaacggtagggtaacgttacgggacggtacgtttacggttaacccgtttttacgtacggtaccggtacgggtaccgggttacgggaacccgtaacccgtaaaccgttaccggtttcggggtttaccgggttttacccgggacggggtaaccgggtaccgaacggttccgtaccgggtaccccgttacggtaccggtacccgaacggtaccccggtaacgggtccccgtcccgggtacccccgttccggtacccgttacccccgg

SEQ ID NO: 72538 - DNA, 593 bp, Homo sapiens
  misc_feature: GYAE6OF01DGEQT.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtcccccaggacagacagccagcatccacctgctctggagataagtggggataatatgcctctggtatcagcagaagccaggcgacgtccctgtgttcggtcagttctatacaagtatacgaaccgaaaccggccctacgacgggtactccgtgacgcgtattcgtacgtcggacctaccaactcgtacgggaaccacgacgcctactcctacgaccacgtcgaccggaccggaccgacggtctacgtaggagtcggacggtcgtagttacttttcgtgtcgacggtcggtacggacctaccgtacgtacgttggttcgggtttacggcggtacggaccgaagtccgtcgtacccgtcgtacggccacggacccgtacggcccgtccgccccgtccgtccgtacccg

SEQ ID NO: 72539 - DNA, 715 bp, Homo sapiens
  misc_feature: GYAE6OF01BRSWV.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagcccaccctcagtcgtccgtcgtccccaggacagacgacgccagcatcacctgctctggagtaagtaaaggttaggggaataaagtatcgcctcgtggtatcagacagaacgccgaggccgtacgtccccgtggttggttcggtctacgtctactacaagactacgtaaccgaaacccggccctacggacgggtacctaccgtggacgtacgtacttccgtcgtcggtcctaaccgtaacgtcgtacggaacacgaccgacccactcctacgacctactacgacggtcccggaccgacggtactaggtacggtacgtacggacgtcgttacgttaccgttttacgcgttacggacggtacggtaccggaacctaaccggtaacgttacggtttcggggttaccgggtttcggggaaccggggtaaccgggtaaccgtaaacgggtcccgttaaccgggtacccgttaccgggtacggtacccgtaccggaccccggtaccggtaccccgttaccccgggccccccttagggtccccgttaaccccgg

SEQ ID NO: 72540 - DNA, 664 bp, Homo sapiens
  misc_feature: GYAE6OF01CC583.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtcgtccatcgtcccaggacagacagcagcatcacctgctcgaggagtaagttaaagtagggggaataaatagtcgcctcgtggtatcgagcaagacgccgaggcgtaccgtcccgtgttcgttcggtacatctatacaagatacgaacgaaacgtccgtagacggtacctccgtagacgtcgtattcctcgtcgtacctacctaacgtcgtaacggaacacgacgaccacgtctacgactacgtcgacgggaccggaaccaggtactaagggtaggaagtcgggaacgtcgttagtttaacttttaacggcggtacggaacgggtcggtacgggaacccaaccgtaacggtaccggtttgggttcgggtttaccggggacgggtaccgggtaaccgaacggtccggtaccggtcccggttaccgtaccggttacccgaccggtacccgtacggtcccgtcccggtcccccggttcggttaccccg

SEQ ID NO: 72541 - DNA, 669 bp, Homo sapiens
  misc_feature: GYAE6OF01B2VYT.43.72.G06.1.454.CMB.1.raw
  modified_base (246)..(246): a, c, t, g, unknown or other
  misc_feature (246)..(246): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccgaggacagacagccagcatcacctgctctggagataagttggggataaatagtncctctggtatcagcagaagccaggcgacgtccctgtgtggtacatctatacgaagatagaacaaaccggtccctacgagggtactcccgtagacggtacgtacttctacgtcggccttacctaaccgtccgtacgggaacctaacgacgtaccctactccgtacgaacccacgttaccgaaccgggaccccgggaaccccgtacgggtacgttaacgtagggtacgttagggtacggtccgttacgttaacgtttttacgacggttaccgtacgggtcggtaacggggtaacccaaccgttaacgtacgttcggtttagggtttaccgggacgggtaacggaccgaacgggtctacggtacccgtcggtacgaccgaacgcccgtaacgtcccggtacccgtcccccgtcggtcccgtacccg

SEQ ID NO: 72542 - DNA, 725 bp, Homo sapiens
  misc_feature: GYAE6OF01C6AXF.43.72.G06.1.454.CMB.1.raw
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (702)..(702): a, c, t, g, unknown or other
  misc_feature (702)..(702): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtcttgcttactgcacaggatccgtggccgcctatgagttgactcacgccaccctcagtcgtccgtcgtccccaggacacgacacgccagccaactccacctgcctcgaggaagtaagttaaaggttagggggtaataaaatatcgtccttccgtggtactcagacaagacgccaggcgactcccgtggtgtggtctntntancaagatacgaaccgaaaccgtccctacgacggactccgtgacgtcgtacttccgtcgtacgcctacgtaactccggtaacggaacacgaccgtccctacgtccgtacgacctacgtaccgaccggggaccccggaaccgtacgggtaacgtacggttagggtaacggtacgggtaacgggttccttaaccggttttaaccgttttaccgttaccggttacgggtaacgggtaccggggttaaccggaaccctaacccgtaacgttaacggtttcggggttccggggttttaacgggaccggggtaccggaacggtaccggtacgtaccggtacccgtacggtacggtccgaacggtacccgaaccgtcccgtaccccnccccggttccgtccgttaccccg

SEQ ID NO: 72543 - DNA, 775 bp, Homo sapiens
  misc_feature: GYAE6OF01DW2LU.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggactccgtggccgcctatgagttgactcacgcccaccctcagtcgtccgtcgtccccaggacagacacgccagcactccacctgctcgtaggaagtaagttaaggttaggggtaataaatagtcgtccttccgttaggtactacgacgacaagaacgccgaggtaccgtacgttccccgtgttcgttggtactacgttctactacgaaagagtaacgaaccgtaaacccggtccctaacggtacgggtacctccgtacggtacggaccggttacttccgttcgttaccggtacctaccctaacgggtccggttaagggaaaccctaaccgaacccggaccctaccgttaaccgtacccgaacctaaccgtaccgaccggggaccccgggaaacccgtacggtacgttaggttacgaggttacggaggttaccttacggttttacgtttacccgtggtacgggtacggtacggttaaccggaaccctaccgttaacctacgggtttcgggttccgggtttaaccggggaccgggaaccggtacgtacgtacccggtaccgtacccggtaccggttacggaaccgtcccggaaccgtaccggtacccgtccccgttaccccgtcggttccttacccg

SEQ ID NO: 72544 - DNA, 755 bp, Homo sapiens
  misc_feature: GYAE6OF01CVH36.43.72.G06.1.454.CMB.1.raw
  modified_base (117)..(117): a, c, t, g, unknown or other
  misc_feature (117)..(117): n is a, c, g, or t
  modified_base (574)..(574): a, c, t, g, unknown or other
  misc_feature (574)..(574): n is a, c, g, or t
tcagtgtgagtagtcacgaccggtgctcgatttagctacgactgcaagggaaaggggctgggcctcaggaagcagcatcggaggtgcctcagccatggcattgatccctctcttccncggcgtccttgcttactgcacaggatccgtggccgcctatgagttgactcacgcccaacccgtcaggtcgttcccgtcgtcccccaggacaggacacgccagcaactcactgctcgtggaagacttaaaggtcggggtaataaaagttcgtacgtcccttacgttaggtaactacgaaggacaaggaaccgccgaacgggtccgtaacccgttccccggttagggtttacgtttcgggttacaacgttccttaactaaccggtaaagtacttacgaaacccgtaaacggtcccctaggaacgggtcctcccgtaggacgtaccgtagttcctgtccggtcctaccgtaaaccgtccgtaacgggaaacctacgtacccggacttaccgtcgtaacgaccctagtccgaccgggaccggtaccgagtctacggtgagtacgcgtatctttagtttcgngtacgtcggtcgtacgtaccgtaacgaaccgttacggtcggttacgggttaccggacgggttaaccggaaccgtacggtacggtccggttaaaccggttcccgtaacggttcccaaacccggggtaccgtaaccggtaccccgtcccgggttacccccttagggtccccgtttaaccccgg

SEQ ID NO: 72545 - DNA, 757 bp, Homo sapiens
  misc_feature: GYAE6OF01BBMEB.43.72.G06.1.454.CMB.1.raw
  modified_base (134)..(134): a, c, t, g, unknown or other
  misc_feature (134)..(134): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggctctgctactgcanaggctccgtcggccgcctatgagttgactcacgccctaccctcgagtcgtccgtccgtccccaggaccacgaccgacgaccagacactacctacctcgctcggtaggagtaagtaaagggttaggggaattaaatcgttacgtaccctcgttaggtacaccgagacgaagacgcgacggtcgtaccgttcccgtgttcggttacgtactacttctaactacgaacgtacgaacgaaccgaacccgggtctaccggacgggtacctccggtacggtaccgtcgtacttccgtacggtccgtaccttaaccgacccggtttacggaaccggaacctaccggactacccgtaaccgttacggacctaacccggtccgtaaccggaccgggtaacccggcccgtaaggacgttaggtcggtacgtccgggtacttacgttacgtttaaccgttttcggcgttacggacgggtacgtaccggaaccgtaccgttaacgttccggttacgggtttacgggttaccgggcggtaaccggtaccgtaacgtccgtaaccggtcccgttacggtaccggaaccgtaccgacccgtaccggaccgtaccctcccggttctcccggttaccccg

SEQ ID NO: 72546 - DNA, 651 bp, Homo sapiens
  misc_feature: GYAE6OF01AXNNQ.43.72.G06.1.454.CMB.1.raw
  modified_base (452)..(452): a, c, t, g, unknown or other
  misc_feature (452)..(452): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtcccttgcttactgcacaggatccgtggccgcctatgagttgactcagccaccctcagtgtccgtgtccccaggacagacagccagcatcacctgctctggagataaattggggataaatatgcctcctaggtatcagcagaagccaggcgacgtcccctgtgttcggtcatctatcaagatgaacaaacggccctacgagggactccgtagacgcgtatctcgtcggcctaccgtaactcgtacgggaactacgacgccactctcgaccacgtccgacggaccggaccgacggctagtcggagtggacgtcgtacgttacgttttacgngtcgagggtcggtaccggactaaccgtaacgtacgttcgggttacggtttccgggaccgggtacgggtaccgtaaacggtccggtaccggtaacccggttcccggttaacgggtacccggtaacccggtacccccggtaaacgggtcccggttaccccggtttcccccccggttaccggggttcccctttaacccccgg

SEQ ID NO: 72547 - DNA, 931 bp, Homo sapiens
  misc_feature: GYAE6OF01ERYJO.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggactccgtggcccgcctatgagttgactcacgccctaccctcgagttgtcccggtcgtacccccaggaccagacacggcctagcatccaccgtgcttcgaggaactagtaagggtagggtaactaatacgtaccgtcccttcggtagtctcgacggtactaggaaccgccgacggcccggtaccgttcccggttgttcgttcgtactacgttcgtacgaacgaacgtacggtaacgaaccccggtaaccggtcccctaacgggtaacggtaccccgttaccggtaggacggttacccgtacgtttccgtaccgttaccgggttaccccctaccgttaaaccggtttaccgggtaaacgggtaaccccaaccggttaccgtaacccccgtacgttcccgtaacccggtaaccctaacgggttacccggacccgggaccccggtaacccggttaggtaacccgttaggtacgggtacgtacgggtaaccgttaccgtttaccggtttacgttttcggaccgttacggggttacccggtaccgggtaacggttacccctaacccggttaaccggtttacgggttccgggtttttaccggggacccgggggtaacgggttacccgtaaaccggtaacccgggttcccgggttaaccccggttaacccggggttacccttaaaccgggggtccccccgtaaaaaccggggttaccccccgggttacccggtttaccccggttaccccccccgggtaccccccgggtttaaacccgtcccccggttttaacccccgg

SEQ ID NO: 72548 - DNA, 692 bp, Homo sapiens
  misc_feature: GYAE6OF01CGP67.43.72.G06.1.454.CMB.1.raw
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (295)..(295): a, c, t, g, unknown or other
  misc_feature (295)..(295): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
tcagtgtgagtagtcacgaccggtgctcgatttagctacgactgcaagggaaaggggctgggcctcaggaagcagcatcggaggtgcctcagccatggcatggatccctctccttcctcggcgtcctgcttatgcacaggactccgtcggcccgcctagtgtagttgactcacgcccaccctctagtcgtccgtcgtcccgaggcagacacgcanacactcacctntctcgtaggagtaagtaaggttaggggaataaatactcgtacctccgtaggtactcagacagacgacgngccgtacgtccgtgtcgttcgtacgtatnagtacanacgtanaccgacgccgagacgtctcgagacgtctacgttcctagtccggtactacgtaaccgtccgtaacggaactacgaccgtacctacgtacaccggtaccaacgtaccgacgggacccgtccggtaagtacgtacggttacggagtcggtaacgttcgttacgttttaccgtcgtacgggtacgacggtaccggttaacggacccgtaacgttaacggtccgtttaaggggttccggttacgggaaccgggtaccgttacccggagttcccgtacgggttaacccgtaccggttacggtacccgaccgggaccgtacccggttacccgtcccggttaccccggtgtcccgttaccccg

SEQ ID NO: 72549 - DNA, 734 bp, Homo sapiens
  misc_feature: GYAE6OF01EHOA0.43.72.G06.1.454.CMB.1.raw
  modified_base (534)..(534): a, c, t, g, unknown or other
  misc_feature (534)..(534): n is a, c, g, or t
tcagtgtgagtagtcacgaccggtgctcgatttagctacgactgcaagggaaaggggctgggcctcaggaagcagcatcggaggtgcctcagccatggcatggatccctcttcttcctcggcgtccttgcttactgcacgaggactccggtcggcccgccttagtgtagttcgactcacgcccaccctcgtagtcgtccgtccgtcccaggacgacgacacgccagcactccacgtcgtactcgtaggaagtaagttaaagggttaggggtaaattaaaagttcgtccgtacccgtcgttaggtactaacgaggtaacgaacggaacggccggacggtccggtaccggttcccgttggttcggttggtactacgtactaatcgaagtataacgaaccgtaaccggtccctaggacgtactaccggtagcgtactcgttaccgtcgtacgtcctaaccgtacgtacggaacggtaaccaccggacctaccgtacgtacgtaccgacctacgtacgaccggggtacccggaaccgnggttaacgtaggtaggtacgtcggtacgtacgttacgttttacgttacgttggtacggcggttacgggaccgtaacgaccgtacttacgggtcggttacgggttacgggacggtaccggtacggtacgtaccgtccgtacgggtcgtacggaccgaccggtacgtacccggtcctacccggtcccgttcgtcctccccgg

SEQ ID NO: 72550 - DNA, 783 bp, Homo sapiens
  misc_feature: GYAE6OF01BB85W.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatcccgtctcttcctcggcgtccttgcttactgcacgaggatccggtggccgcctagtggtagttcgactacacgccctaccctctagttcgtccggtccgtccccgaggaacacgaccgacgaccgagcctaactccgacctgccttacgtacgggtaagtaagtttaaagggtagggggtaattaaaacgttcgtcgtacccttccgttaggtacctacgacgtacgaaggtaccgaccgacggtccggtaaccgttccccgtgttcggttacggtcctattacgtaataccgaagtacgtacgaacccgaaccgtaccgtacggacggtacctccgtagacgtactacttccgtcgtccgtaccgtaccaccggttaggaacggaccgtacgccgaccctacctacgtaccgtacacgtaccggacggacccggaaccgtacggtcgttacggagggtagtacggttacgtaccgtttgtaaccgttttcgacggttacgagggtaccgtaccgggaaccgtaacccgtaccgttaacggttcgggttacggttaccggggtacggaaccggtacggacccggttacggtaccggtacccggtaaccggtcggtaccgtaccggacccggtaacccggcccgtaccccgtccccggttacgtcccccgtttacccgg

SEQ ID NO: 72551 - DNA, 793 bp, Homo sapiens
  misc_feature: GYAE6OF01B3X0K.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccggtggcccgtcctatgagttgactcacgccaccctcagtcgtccgtcgtcccgaggacagacacgaccagaccacgtaccaccgtcgtcctcgtagggaagtaagttaaagggttagggggtaaattaaagtactcggtacccttccggttaggtactacgaagacaacggaacgtccggacggtccggtaccgttccccggttggttggttcggtctacgttactagtactaagactacggaacctaacccggcctacggaacggtacctccgtagaccgtacgtacttaccttcggtacgtacccgtaaccgtacggttacggaccggaaccaacgtacccgtacctaccgtcctaccgtaccgactaccggaaccgggtaccccgggaacctacgggtacttaggtacgggtactacggggtaacgttccgttacgtttacgttttaccggtcgtaccggtacgggtaccgggtaaccggaaccctaccggtaacgttacggttcgggtttacgggttaccgggggacgtaaccgggacgaccggttcggtacccggttaacccggttacggtaccgtaccggaacccggtacccggtaccggtaccccggtacccggtcccccgttacggttccgttacccccg

SEQ ID NO: 72552 - DNA, 802 bp, Homo sapiens
  misc_feature: GYAE6OF01DBE65.43.72.G06.1.454.CMB.1.raw
  modified_base (787)..(787): a, c, t, g, unknown or other
  misc_feature (787)..(787): n is a, c, g, or t
tcagtgtgagtagtcacgaccggtgctcgatttagctacgactgcaagggaaaggggctgggcctcaggaagcagcatcggaggtgcctcagccatggcatggactccctctcttccgtcggcgtccttgccttatcgcacaggactccgtggcccgctagtgtagttgactcgacgcccacctcgacgttcgtccgtccgtaccccgaagacgaacggacacgacccgagacctacgttaccaccgtcgtccgttcggtaagggtaaggtaaagttaaaaggggttcggggtaaaaattaaacggtcgtaccgtccgttacggttaggttaacctacgacgacgaagaccggacggacggaccgtaaccggttccttggttacggttcgtactacgtactaagtacgaaagacgtacgaaaccgtaccggtaccgtagacggttactccgaggaacgtcggttctaccgtcgtaccgtacctaccgttaacgtaccggaaccggtaaaccgtaccgaccgtaccctacgtttacccggaactacccggtacgtaccggaacccggttaccccgggaagtaccgggtattacgggcggttaagcgggtaacgttccgttaagtttaccgttaggacgttacccgggaggttaccgaacgtaccgtaacccggttagttacggggtttcggttaacccggggttcgggaacgacccggttacgacgtttccggaacgttacccgacggtcgtacggacccgttaccgccgtacccggtcccgttaccncggtcccttacccgg

SEQ ID NO: 72553 - DNA, 894 bp, Homo sapiens
  misc_feature: GYAE6OF01CMJ2K.43.72.G06.1.454.CMB.1.raw
  modified_base (766)..(766): a, c, t, g, unknown or other
  misc_feature (766)..(766): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacgaggactccgtcggcccgcctatggagttcgactcgacgcccaccctcagttcgtccgtcgtaccccaggacacgacacgaccagcaacgtccaccttgcctacgtaggaagtaacgttaaagggttggggaattaaaagtcgtcggtaccccgttacgttagggtaactaccgaacggaccgaaggaacgaccgtaacgggaccggtaacccgttccccgttaggttacgttcggtacgtaaccttcgtaaacgtacgaaaggtacgtaaccggaaaacccgtaaacccgggtccctaacgggtaacgggtaacccttcccggtaaggtaccggtaccgttacgtttccgtcggtacggtccctaacgtaaccgtcgtaaccggaactccgaccggtaccctacggtccctacggtaaccctagacccggacccgggaccccgggaacgtacggtaacctagggtaccggaagtccggtaacggtcccttaacggtttacgttttacgggacgggttacggtaaccggggttaccggtaaccgggaaacctaaccgggttaacgttccgggttttaacgggggtttccgggggttaaccggggaccggtaaaccgggggttaacccncggggtaacccgtttacccggggtacccggtttaaccggtacccggttaccgaaccccgggtaacccggtccggttaccccccgggttccccgtacccccggtttccgggttccctttaacccccggg

SEQ ID NO: 72554 - DNA, 502 bp, Homo sapiens
  misc_feature: GYAE6OF02GZ17T.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgagctgacttttactgtcaggcgtgggacaccaacactgtggtttcggcggagggaccaagctgaccgtcctaggtcagcccaaggcctcggccccctcggtctaccg

SEQ ID NO: 72555 - DNA, 519 bp, Homo sapiens
  misc_feature: GYAE6OF02GZOSV.43.72.G06.1.454.CMB.1.raw
  modified_base (418)..(418): a, c, t, g, unknown or other
  misc_feature (418)..(418): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctacagggatcccgtgacgcgattcgtctcggctccaactctgggaacacacgccactctcgaccatcagccgggaccaggctagtggatgaggctgtacttttcngtcaggcgtgggacacgaacacgtggttggtttcggcggtacgggacaaggcgtgaccgttctaggtcacgacccgaaggcctcgcccctcggtcctaccg

SEQ ID NO: 72556 - DNA, 564 bp, Homo sapiens
  misc_feature: GYAE6OF02IXFXY.43.72.G06.1.454.CMB.1.raw
  modified_base (422)..(422): a, c, t, g, unknown or other
  misc_feature (422)..(422): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgaacaaaccggccctacgagggactccctgacgcgattctctggctccaactctagggaacacacgccactctcgaccatcgacgcgggacccaggctagtggatgaggctgtactttacngttcgaggtcgtacggaccaccgaaccacgttggttcggtttcgggacgggtacgggaccgaaggtcgtacggcccgttccgtaacggttccgacggaccccgtaagggtccctaccggtcccccgttaccggtcctacccg

SEQ ID NO: 72557 - DNA, 526 bp, Homo sapiens
  misc_feature: GYAE6OF02ILQCS.43.72.G06.1.454.CMB.1.raw
  modified_base (393)..(393): a, c, t, g, unknown or other
  misc_feature (393)..(393): n is a, c, g, or t
  modified_base (414)..(414): a, c, t, g, unknown or other
  misc_feature (414)..(414): n is a, c, g, or t
  modified_base (426)..(426): a, c, t, g, unknown or other
  misc_feature (426)..(426): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagcaggcgagtcccctgtgttggtcatctatcaagatgacaaacggccctcacgggatcccgtgagcgtattctctggctccaactctgggaacacacgccactctgaccatcagcgggaccaggctagnggatgaggctgtacttttacngtcgagggtcgnggaccaacaacacttggttggtttcggcgggtagggacaaggcgtcggaccgtcgtaggtccgacgcccgaacggccgtacgcccccgtcggtcctaccg

SEQ ID NO: 72558 - DNA, 611 bp, Homo sapiens
  misc_feature: GYAE6OF02HCOXJ.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatagaacaaacggccctacgagggactcccgtagagcgtattctactggctccaactcgtgggaacacgacgccactctcgaccatcacggccggaccaggctagtggagtgaggtctagtacttttacgtcgtcgagggtcgtacgggaaccaaccgaacgtacgttaggttcgggttttacgggaccggggtaacggggacccgtaaggccgttacgggtacccggttaccggttaacgggttacccgaaccggtaccccggtaacgggtcccttacccgggtcccccccgttcgggtacccttacccgg

SEQ ID NO: 72559 - DNA, 668 bp, Homo sapiens
  misc_feature: GYAE6OF02HGXOO.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagcccaccctcagtgtccgtcgtccccaggacagacagccagcatcacctgctctggagataaagtggggataaatatgcctctggtatcagcagagccgaggcgacgtcccgtgtgttgtcagtactatcaagatacgaacgaaccgcctcgacggactccgtagacgtacgtattccgtcgtcgcctaccaaccgtcgtacggaacctacgacgtaccctacgtctacgacccagtccgaacggtcccgggaaccaggtacctaaggtaggtacgttacggacggtcgttaacggttacttttacgtccgttacggacgggtaccggacggggtaacccaaaccgtaccgtaacgtttcgggtttacgggtttaccgggaccgggttacggacccgtaacgggtccgtaaccggtacccggttaccggtaacggtaccgaaccggtacccgtaaccggtcccgtaccccgggtaccccgttccggtacccttaccccgg

SEQ ID NO: 72560 - DNA, 617 bp, Homo sapiens
  misc_feature: GYAE6OF02H383O.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaagttggggataaagtatgcctctggtatcagcagagcagcgagtccctgtgttggtcatctatacaagatgacaaacggcctacagggactcctgagtcgattctgtcggtctacctactcgtacgggaaacacacgaccctactctacgaaccctagtccgaaggaccgggacccaggacgtacgtgggaactcgggaagtcgttacgttaactttttaacgcgttccgaagggtcggtacgggaacctaacccgaaccgtaacgttcgggttgggttttaccgggacgggaacggtaccgaacggtccgtacggtacccggttacggtaacggtcgaaccgtcccgaaggtcccgttcccggcccccggttccgtccttaaccccgg

SEQ ID NO: 72561 - DNA, 583 bp, Homo sapiens
  misc_feature: GYAE6OF02GQGXA.43.72.G06.1.454.CMB.1.raw
  modified_base (319)..(319): a, c, t, g, unknown or other
  misc_feature (319)..(319): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattggggataaatatgcctcctggtatcagcagaagccaggcgagtcccctgtgttggtcagtctatcaagatgacaacggcctcaggacnccctgacgcgattctctgctcaactctgggaacacacgcctactcgtcgaccactcgacggaccgggacccaggctagtggattgacggtctgtactttactgtcgaggtcgttacgggacctaaccgaactacgttcggttacgggttttcggaccgggaacgggtaccgaacggtacggtacggacccggttacccgtaacgggttaccgacgaccccggtaacggtcccgtaccggtaccccccgttgggtaccctaccgg

SEQ ID NO: 72562 - DNA, 522 bp, Homo sapiens
  misc_feature: GYAE6OF02HBRX8.43.72.G06.1.454.CMB.1.raw
  modified_base (315)..(315): a, c, t, g, unknown or other
  misc_feature (315)..(315): n is a, c, g, or t
  modified_base (438)..(438): a, c, t, g, unknown or other
  misc_feature (438)..(438): n is a, c, g, or t
tcagtgtgagtagtcacgaccggtgctcgatttagctacgactgcaagggaaaggggctgggcctcaggaaacagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctnagggactccctgagcgattctctgctccaactctgggaacacagccactctcgaccatcaggccgggacccaggcctagtggatggaggctgtacttttactgtcaggcgtgggacaccaacnctgttggtttcggcggaggaccagctggaccgtccgtaggtccgagcccgaaggtccgtccgcccccgtcggtcctacgtcccg

SEQ ID NO: 72563 - DNA, 605 bp, Homo sapiens
  misc_feature: GYAE6OF02HR122.43.72.G06.1.454.CMB.1.raw
  modified_base (264)..(264): a, c, t, g, unknown or other
  misc_feature (264)..(264): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataagttggggataaatatgcctcctggtatcagcagaanccgaggcgagtcccctgtgttggtcatctatacaagatagaacaacgcctacgacggactccctagacgtcgtacgttctcgtcgctacctaactcgtacgggaaccacgacgcctactctacgaccacgtacgacggccggacccgaggtcctagtggacgtggtagcttacgtacttttacgtggttacacgggtcggacgggaacctaaccgtaaccgtacgttggttcggtttaccggacgggtacgggtacccgtaaggccgtaacgtacccggtcgttaacggtacccacggtacccgaacggtcccgtccggtcccccgtaccggtcctacccg

SEQ ID NO: 72564 - DNA, 706 bp, Homo sapiens
  misc_feature: GYAE6OF02JC032.43.72.G06.1.454.CMB.1.raw
  modified_base (248)..(248): a, c, t, g, unknown or other
  misc_feature (248)..(248): n is a, c, g, or t
  modified_base (325)..(325): a, c, t, g, unknown or other
  misc_feature (325)..(325): n is a, c, g, or t
tcagtgtgagtagtcacgaccggtgctcgatttagctacgactgcaagggaaggggctgggcctcaggaagcagcatcggaggtgcctcagccatggcatggatcctctcttcctcggcgtcctgcttactgcacaggatcgtggccgcctatgagttgactcacgccacctcagtgtccgtcgtcccaggacagacacgccagcaactcacctgcctcgtcggagataaagttggggaattaaagtntacgtcctccgttagggtactcacgccagaacgaccgaggcgacgttccctaggtcgtggtcattctactacaaggnttacgaacgtaaccggcctacggacggactcccgtgacgcgtattcgtcgtcgccttacgactcgtaggaaccacgctaccgtactaccgtacgacccgtacttaccgacgggacccgggaccgtacggtaccgttaaggtcggtaacgtacggacgttaccgttacggttaaccgttttttacgacgggttaccgtacggggtccgttaacgggaacctaaacccgtaactaccggtttagggtttaccgggttttaccgggaacgggttaaccgggaccgtaacggtcgggtaaccggttacccggttacggttacgaccgtaaccggacccgtaacgggtcccgtacccggtcccccgttacggtacccttacccggg

SEQ ID NO: 72565 - DNA, 619 bp, Homo sapiens
  misc_feature: GYAE6OF02JLNXI.43.72.G06.1.454.CMB.1.raw
  modified_base (267)..(267): a, c, t, g, unknown or other
  misc_feature (267)..(267): n is a, c, g, or t
  modified_base (458)..(458): a, c, t, g, unknown or other
  misc_feature (458)..(458): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagactaagtggggaataaatatgacctcctggtactcagcagaanccgagcgagtccctgtgtgtcatctatcagtatacgacaaacgccctacgaggactccgtgacgacgtattacgtcgtcggtactcctaacgtcgtacggaacgacacgacctacgtctcgaccatccggacgtccgggaccacggacttacgaggtagtacggtacggtcttacggttaacttttaccgnggttacgtacgggtacggtacgggaaccctaaccgtaacgtcgttacgggtttacggtttccgggacggtacgggtaccaggtaccggtcgtaccggttcgtaaccggtcgacgtacccggtaacggtcccgtaccggacccccgttggtaccctacccgg

SEQ ID NO: 72566 - DNA, 497 bp, Homo sapiens
  misc_feature: GYAE6OF02G0NWN.43.72.G06.1.454.CMB.1.raw
  modified_base (294)..(294): a, c, t, g, unknown or other
  misc_feature (294)..(294): n is a, c, g, or t
  modified_base (349)..(349): a, c, t, g, unknown or other
  misc_feature (349)..(349): n is a, c, g, or t
  modified_base (438)..(438): a, c, t, g, unknown or other
  misc_feature (438)..(438): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctgagataatggggataatatgcctctggtatcagcagaagccaggcagtcccctgtcgttggtcatctatcaagntagacaacggccctcagggctccctgagcgattctctggctccaactctggaacncagccactctcgaccatcaggtccgggaccaggctagtggatggagctgtactttctgtcaggcgtggacacacacgtgttcggttcgngggtacggacaagcgtggaccgtcgtaggcacgccgaaggcctagccccgtggcctccg

SEQ ID NO: 72567 - DNA, 704 bp, Homo sapiens
  misc_feature: GYAE6OF02FLCV3.43.72.G06.1.454.CMB.1.raw
  modified_base (226)..(226): a, c, t, g, unknown or other
  misc_feature (226)..(226): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtcgtccgtgtccccaggacagacacgccagcactccacctcgctcgnggagtaattaaggttaggggaataaatagtcgcctcctggtatcacgcaagtaacgccgaggacgtaccgtccccgttaggtcggtttcggtactacttactaactacgtaagagtacgaacgaaaccggtccctaggaacgggaccttacccgtacggacggtaccgtattccgttacgtacggtacctaccgtaacgtcggtaacggtaaacctacgaaccgtcctaccttacgtacgacctaacgaccgtacgggaccccgggaaccacgggtaccttaaggtacgggtaagtacggtacggttacgttacgtttaacgttttcgtacggttacgagggtaccggttacggacctaaccgtaacgtaccgttgggttacggtttcgggacggtacggtaccgtacgtccggtacgacccgttacggacgtaccgaccgacggtcggtacccgtcccgtacccgtcgtacctcccg

SEQ ID NO: 72568 - DNA, 662 bp, Homo sapiens
  misc_feature: GYAE6OF02IZUUW.43.72.G06.1.454.CMB.1.raw
  modified_base (269)..(269): a, c, t, g, unknown or other
  misc_feature (269)..(269): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcacgcccaccctcagtcgtccgtcgtccccaggacaggacagccagcactcacctgctctaggatagtaaagtggggaataatatcgcctcgtggtactcganacaagaacgccgaacggcgacgtcccttggtggtttcggtctaactcgtaatacgaaagtatacgaaccgaaaccgtccctacgacgggtctcccgtaggacgcgtacgttcctcgtacggtcctacctaacgtgacggtaacaacgcggtacccactcgtaccgacctacgtacgacggacccgggaccgacggtacgtacggagtacgttggacggtcgttagttacgttttactcgtacgtcggtcgtacggacctaccgaacgtacgtttacggttcgggtttagggaccgggtacggaccgtacggacggtccggtaccgtaccgggtacgtaccgaccgtacccggtaacggtccgtaccccggtcccggtaccgtacccgtcccgg

SEQ ID NO: 72569 - DNA, 659 bp, Homo sapiens
  misc_feature: GYAE6OF02FSHIV.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaagttgggggataaatatgcctctgtatcagcagaagccaggcgagtccctgtgttggtcatctatcaagatgacaaaccggccctacgagggaactcccgtggacgcggattaccgtctcggccttccaacttcgtagggaacaccgaacgaccctactaccgtcgaaccctatccgaacggccggggaccccaagggtcctaagtacgggattacggagggtcttaggtaacctttttacgtcggtcgacgggtacggttacgggaacccaccgtaacgtaccgttgggtttacgggtttttaccggggacgggtaacgggtaaccgtaacggccgttacggaccccggttacccggttaacggtacccgtaacggaccccgtaacgggtcccgttacccggcccccgtttaccgggcccttaaccccgg

SEQ ID NO: 72570 - DNA, 563 bp, Homo sapiens
  misc_feature: GYAE6OF02F4ZAK.43.72.G06.1.454.CMB.1.raw
tcagtgtgagtagtcacgaccggtgctcgatttagctacgactgcaagggaaaggggctgggcctcaggtaagcagcatcggaggtgccgtcagccatggcatggatccctctcttcctcggcgtccttgcttactgcacaggatccgtggccgcctatgagttgactcagccaccctcagtgtccgtgtcccccaggacagacagccagcatcacctgctctggagataattgggggataagtatgcctcctggtatcagcagaagccaggcgagtcccctgtgttggcagtctatcaagatgacaaacgggccctcgacgggactccctagagcgattctctaggcctccaactctgggaacacagccactctgaccatcagccgggtacccaggcctatgggacttggacggtcctagtaccttttactggtccgagggtccgtagggaccaccgtaactacgtgttacggttttcggacgggtacggaccgagccgtacggaccgttccgtaggtccaacggtcccgaacggtcctccggccccgtcggtacctacccg

SEQ ID NO: 72571 - DNA, 766 bp, Homo sapiens
  misc_feature: GYAE6OF02JNP3C.43.72.G06.1.454.CMB.1.raw
  modified_base (201)..(201): a, c, t, g, unknown or other
  misc_feature (201)..(201): n is a, c, g, or t
  modified_base (221)..(221): a, c, t, g, unknown or other
  misc_feature (221)..(221): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtcctgcttactgcacaggatccgtggccgcctatgagttgactcagccaccctcagtgtccgtcgtcccaggacagacncgccagcactcacctgctcnggatataaacggttgggggaataatatacgtcctcgtggtatcgacgacaggtaacgccgagggaccggaccgttccccgtgggttacgttcgggttaccacttacgttacgtacgtaaacgtacgttacgggaaaccgtaaaacccgggcccccgttacggaacgggtaccgttccccgttaggaccggtacgttacttacccttccggtacggtacctaccctaacgttccggtaaggggtaaaccctacgtaaccggtccctaacgttcctacccggtaactaccgtacgtaccggaccgggtacccgacggacggttacgtaggtaacgtggtaccggtacgttaccggttaacttttccggtgtacggtaccgggtccggttaacgggaacccgtaacccgtaaccgttacggttacggttacgggtttcggggacggacgggttaccgaacggtccggtacggtaccgttaccggtacggtccgtacccggaaccggtaccggtcccgtacccgggtaccccgttccgtccgtacccgg

SEQ ID NO: 72572 - DNA, 721 bp, Homo sapiens
  misc_feature: GYAE6OF02IVQ18.43.72.G06.1.454.CMB.1.raw
  modified_base (229)..(229): a, c, t, g, unknown or other
  misc_feature (229)..(229): n is a, c, g, or t
  modified_base (710)..(710): a, c, t, g, unknown or other
  misc_feature (710)..(710): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtgccgcctatgagttgactcgacgccaccctgagtcgtcccgttcgtacccaggacagacagccagcatcactgctcgagganaagtaacggttggggaacttaatacgtggccttccgtagtacgtacagacgtacgaacgccgaagggtccgtaacggttccccgttggtcggtttacggtacaccggttaacttagactaaaggacgttacgaaacccgaaacgtccccgtagaacgggtccttcccggtagaccgtacgtacgttcctcggtacgtacctaccgtacgtacgttaggaaccctagcccgtacctaacgtcgtacgaaccgtagtacgtaccggtaccgggaccgtacgggtacttacggtacgtacgtacggtacgtcgttaaccgtttacttacgttccgggtagtacgggtcggtaccggtaaccctaacgttaccgtacggttccggttacgggttaccggtacgggtaaccgacgtacgtcgggtaccgtaccggttgtaaccggtaccgttacgaaccggtcgacccggttaccgaccccggttnccgttaccccg

SEQ ID NO: 72573 - DNA, 772 bp, Homo sapiens
  misc_feature: GYAE6OF02JG6ND.43.72.G06.1.454.CMB.1.raw
  modified_base (227)..(227): a, c, t, g, unknown or other
  misc_feature (227)..(227): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggactccgtggccgcctatgagttgactcacgccaccctcacgtcgtccgtcgtccccaggacacgacacgccacgcactccacctcnctacgtcggaagtaattaaacggttagggggaacttaaaatgtccgtaccgtccgtggtactcgacgaccaaggaacgccgtaggtaccgaccggttccctggtcgttggtaccagttacctatacaacgtactacggaacgtaaaccgggtccctaggtaaccgggtactaccgtacggactacggttacttcgtaccgtggtaccctaccggtaaccgtccggtaaacggtaccacgacgtaccctacgtactaccgaacctagtaccggacggacccgggaccaggtaccgtacgtacgggtagtacggtcgtaccgttcgttaaccgtttacgtacggttacggtccgggtacggtacccggtaaccgtaacccgtaaggtaccgggttttcgggttaccgggttaccgggaccggggtaaccgggtaccgtaacgggtccgttaacccggggctttaacccggggtactaccccggtaaccggacccggtaaccggttccccggtaccccgggtcccggttaccggacccctttaccggg

SEQ ID NO: 72574 - DNA, 614 bp, Homo sapiens
  misc_feature: GYAE6OF02GA804.43.72.G06.1.454.CMB.1.raw
  modified_base (280)..(280): a, c, t, g, unknown or other
  misc_feature (280)..(280): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (363)..(363): a, c, t, g, unknown or other
  misc_feature (363)..(363): n is a, c, g, or t
tcagtgtgagtagtcacgaccggtgctcgatttagctacgactgcaagggaaagggggctgggcctcaggaagcagcatcggaggtgcctcagccatggcatggatccctctcttcctcggcgtccttgcttactgcacaggatccgtggccgcctatgagttgactcacgccaccctcagtcgtccgtcgtccccaggacagacagccagcatcacctcgctctggagagttaaaggtagggggaataaatatacgcctcctggtactcacgcagaacncgaggcgtacgtccctgtgttcggtcatctatcaagatgaacaacggcctagacgcncctagancatcctntcgctaccatcncggacacacgacctactcctagaccaacgtcacggccggaccgaggctaggtgacgtgggacgttattcgttaacgtttcacggtcgacggtcggttacgggacctaacccgaacgttgggtttcggtttaccggggttttcgggaccggggtaccgggtacctaacggtccggtacggtaaccggttccggtaacggttacccgaacgtaaccggacggtcccgtccggaccccgttcggtactaccccg

SEQ ID NO: 72575 - DNA, 736 bp, Homo sapiens
  misc_feature: GYAE6OF02IJ3ID.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagtataaagttggggaataaatatacgccctacgtggtatcgagcgagaagccgaggcgaccgtccctgtcgttgtctatctatacaagtatacgaaaccgaaccggtccctacggaacgggtacctccgtacggacgtacgtacttccgtcgttacggtcctaccgtaactcgtacgggaaccaccgacgaccctaccgtcgtacgaccgtagtaccgaacgggtcccgggaacccgaggtcttaacggtaggtaacgttacggtaacggtaccgtttacgtttaacgttttaccgtacgggttacgggtacgggtaccgggtacggtaaacccctaaccgtaaaccgtttccggttacggggttttacggggttttacccggggacggtaaaccggggaccaacgggtcccggtaaccggttaccccggtacgttaaccggtaccgacccgggttacccggaaccggtcccggttacccccggtacccccggttacgtaaccccgttccccg

SEQ ID NO: 72576 - DNA, 766 bp, Homo sapiens
  misc_feature: GYAE6OF02H1T1H.43.72.G06.1.454.CMB.1.raw
  modified_base (157)..(157): a, c, t, g, unknown or other
  misc_feature (157)..(157): n is a, c, g, or t
  modified_base (446)..(446): a, c, t, g, unknown or other
  misc_feature (446)..(446): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctangagttgactcagccacctcagtgtccgtgccccaggacagacacgcgagcactccacctgctcgtaggagtaagttaaaggttggggaattaagtagtcgaccttccgtaggtatcagccgaagacgccgtaggcgtaccgtcccgtgttggttcggtcacgttaccgtataccgaagtaacgtacgaaaccggtaacccggcccgttacggaccggggacctttcccggaggtacgtccgtaagttcctcgttacgggtcctaacctacgttaccggaacggaaaccnccgtaactacccgtaccgtttacgaccgacctacgtaccgccgggaccggacctaggaaccgtcgtaggagtacggttaacgtcggttaacgtttaccgtttacggtaccggtaacggtccgggtaacggttacccgggaacccttaaaccggaaccgtttaccgggttcgggttttccgggtaccggtaaccgggggacggttaccggttaacggccggttaacccggtaccgggtttccgaacggttaccgtacccggacccggttaacccggtcccgtttacccccgggacccgttccggtaccctttaacccccgg

SEQ ID NO: 72577 - DNA, 871 bp, Homo sapiens
  misc_feature: GYAE6OF02JFWLV.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctcttcctcgcgtccttgcttactgcacaggatccgtggccgcctatgagttgactcagcccaccctcagtcgtccgtcgtccccaggacacgacacgccagcactccacctgcctcgtggacgtaagttaaaacgttgggggaataaaacttagtacgccttccgttaggtacttcgaacgcgaagaacgccgaacgggccgtaacgttcccccgttggttacgtttggtaccgtactttaccttacgttacaaacggtacgttaacggaaaccgtaaaaccccgggtcccgtacgaacggggtaccttccccgtacggacggccggtactttcccgtcgttacgggtcccttaccctaaccgttccgtacggggaaaccctaacgaccggccccgtaacgtcctaccggtaaccctaacgtaccggaccgggtcccgggaacccgtaacgggtaccgttaggtacggtaacggttacgggacgttccgttaacggtttaccgttttaccgtttacggttaccggttacggggtaccgttacgggggtaaaccctaccggtaaaacccgtttccggtttacgggttttacggggttttaccgggaccggggttacgggtaacccggtaacggtacccgggttaacggttaaccccgggtaaccgtttaacccggggtacctaaccccggtacccgggttaaccggtccccggtaacccccgggttacccccgttcccgggttaccccgtttaacccccggg

SEQ ID NO: 72578 - DNA, 775 bp, Homo sapiens
  misc_feature: GYAE6OF02JSSFT.43.72.G06.1.454.CMB.1.raw
tcagtgtgagtagtcacgaccggtgctcgatttagctacgactgcaagggaaaggggcgtgggccgtcaggaagcagcatcggaggtgcctcagccatggcatggatccctctcttcctcggcgtccttgcttactgcacaggatccgtggccgcctatgagttgactcacgccaccctcagtgtccgtcgtccccacggacacgacacgcccgagcaactccacctcgctcgtggaagtattaaagtagggggtaataaagtatcgtccttccgtggtaactcgagtacgaagaacgccgacggacgtacgttccctaggttgttcggtactacttcgtactacgacgtattacggaaaccgtaaccggtacctacggaacggtacgtacccgttcggaacgtaccgttaactttccggtaccgttacggtaccgttacctaaccgttaccgtaacgggtaaaccgtaaccaccgtaccgtaccgttacctaccggtaaccaccgttaccgaacgggtacccggtaaccgaacggtacgtaacgggtacgtaggtacgtacggtaccgttccgtttaacgtttacggcgttaacgtcgggtacgggtcgtaacccgtacccgtaacgttacgtttccggttagggtttacccggggaagtaaccgggtacgacgggttaccgtaccggtttaaccgggcgttaaaccgggagtacccggtacccgtaacgggtccccgtaccccggttacccggtcccgttacccgttacccgg

SEQ ID NO: 72579 - DNA, 543 bp, Homo sapiens
  misc_feature: GYAE6OF02F44MN.43.72.G06.1.454.CMB.1.raw
  modified_base (382)..(382): a, c, t, g, unknown or other
  misc_feature (382)..(382): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaatgggggataaatatgcctcctggtatcagcagaagccaggcgagtcccctgtgttggtcatctatcaagatgaacaaacggccctcagggatcccgtgagcggattcgtctcgggctccgaactctacgggaacacgacgccactctgaaccntacgagaccgggacccaggctaacgtggacttggaggcttgtaaccttttagtgtcgacggcgtgggaccaaccgaacactggtggtttcggcgggtaagggaccaagcgtagacccgtcgtacggtcaacgccgaaggtccgacgcccctcggcctaccg

SEQ ID NO: 72580 - DNA, 693 bp, Homo sapiens
  misc_feature: GYAE6OF02FLLEB.43.72.G06.1.454.CMB.1.raw
  modified_base (491)..(491): a, c, t, g, unknown or other
  misc_feature (491)..(491): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcacgccaccctcagtgtccgtcgtccccaggacagacacgccagcatcacctgctcgtggagataaagttaggggaataaagtatcgtcctccgttaggtactcgagtcgaacgtaacgccgagggccgtacgtccccgttggttcggttcggtctatcttaactacaacgtatcgaaaccaaccggtccctacggaacgggtaccttccgagacgacgttacttccgtacgtggtccctaaccgtactcggtaacgggaaccaccgacgacctactccgaccaccgactcgaacggtacccggaacgtacggtactacggtagntacgggagttacgttcggttaacttttacgtcgtacggtacggggtacgtaccggtaccaacccgtacgttaccgttcggtttcgggttacgggacgggttaccggaccgtacggccgttaacggtacccgttcggtaccggtaccgaccggtacccggcggtacccggtccccggtcccccggttagtccccgttacccgg

SEQ ID NO: 72581 - DNA, 704 bp, Homo sapiens
  misc_feature: GYAE6OF02IKU8K.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatccctctctcctcggcgtccttgcttactgcacaggatccgtggccgcctatgagttgactcagccaccctcagtgtccgtgtccccaggacagacagccagcatcacctgctctggagtataaattgggggaataaagtatacgccgtcctaggtatccgagcagaagcccgaggcgaagtcccctgtacgttcggtacctagtcctaagtccaaagacttagaacctaaaaccggccctacgagggtaacctccgtgacgtccgtagttcctcgttcggactccaaacgttcgtacggggaaccaacgtacgaccctaactcggtactacccttaacgcgtacggtacgggacccagggcctagtacggagttacggacggacttacggtaacctttttaccgtacgttacgagggttacccggttacgggaaacccgttaccgaaccgttacgtaacgggtttccgggtttaccggaccggggttaggaacccgtaaggtcccgtaacggttaacccgtaccggttaccgggtaacaacccggtacccggtaacgtcccgttaaccggtccccccggttaccggtacgttaccccgg

SEQ ID NO: 72582 - DNA, 720 bp, Homo sapiens
  misc_feature: GYAE6OF02H63YM.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggatcctctcttcctcggcgtccttgcttactgcacaggactccgtgcccactagtgacgttgactcacgcccaccctcagttgtccgtcgtccccaggacagacacgccagcatccaccgtgctacgtaggaacgtaagttaacggttaggggaaacttaaagtacgttcgtacccgttacgtacggttactacgaacggtaccgaagtaacggaccgacggtaccgtaccggttccccgttggttacggttcggtactacgtcttacgtaacgtaaggtaacgtacgaacgaaacccggtccgtaacggtacgggtaccttaccgtacggacgtacgttactcgttacgtcggtaccttaaccgtaccgttaacgtaacggaacgtaccgtacgtaccctaaccgtacgttccaacccgttaacgtacccggaacggtcccgggtaacgacggtacgtaggtacggacgtcggtacgtcgtacgttacgttgaacgtcgtacggacggtcgaacctcgaacgttagtcgggttcgtaccgggagtaacggtcgacggttacgcgtaccgtcgacgtacgaccgcgtacgtccgtcccgtccgtaccgtacttacccg

SEQ ID NO: 72583 - DNA, 619 bp, Homo sapiens
  misc_feature: GYAE6OF02GPXW3.43.72.G06.1.454.CMB.1.raw
  modified_base (207)..(207): a, c, t, g, unknown or other
  misc_feature (207)..(207): n is a, c, g, or t
  modified_base (294)..(294): a, c, t, g, unknown or other
  misc_feature (294)..(294): n is a, c, g, or t
  modified_base (329)..(329): a, c, t, g, unknown or other
  misc_feature (329)..(329): n is a, c, g, or t
  modified_base (335)..(335): a, c, t, g, unknown or other
  misc_feature (335)..(335): n is a, c, g, or t
  modified_base (436)..(436): a, c, t, g, unknown or other
  misc_feature (436)..(436): n is a, c, g, or t
  modified_base (513)..(513): a, c, t, g, unknown or other
  misc_feature (513)..(513): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggactccgtggccgcctatgtagttgactcacgccaccctcagtcgtccgtcgtccccaggacagacngccagcatcaccgtgctcgtggaagtaattaaagggttgggggtaaataaattatcggtcccttccgtggttactcgagacagaacncgaggcgtacgtccctgtggttcgtactactctanacgaanacgacgaaaccgaacccgtccctaggaacgggtacctcccggaggtacgcgtacgttctacgtcggtacctaaccgacgttaccgagggaacccacgaccncccgttactacctacgaccacgtacgaccgggtcccggaccgtacgtcgtagtcgagtcgacgttctgtactttacngtcgaggcgtacggaccacgtactgttgttcggttacggcgtaggacagtcgcgaccgttcgtaacgcgtaaccggcgtacgccgtcccggcccgttcgcctcccg

SEQ ID NO: 72584 - DNA, 797 bp, Homo sapiens
  misc_feature: GYAE6OF02GPGO0.43.72.G06.1.454.CMB.1.raw
tcagtgtgagtagtcacgaccggtgctcgatttagctacgactgcaagggaaagggctgggcctcaggaagcagcatcggaggtgcctcagccatggcatggatccctctcttccgtcggcgtccttgcttactgcacaggactccgtggccgcctatgtagttgactcacgccctacctcgagtcgtccgtccgtacccaggacacgacgagccacgacactcctacctggtacctcgtaggaagtaaagttaaagggttagggggaaattaaagtacgttcgtcccgttccggtaggttaactacgaacgtacgtaaggaaccgccggtaacgggaccgttacccggttccccgttaggttcggttacggtactacgttctacgacgtaaagacgtaacggaaccgtaacccgtaccgtacggaaccggtaccgttaccggacgtaccgacgtttacttccggtacgtttaccggtaccttaacccgtaacgtacggtaacggtaaccctacgacccgttacctactaccgtaacctacccgtaccgtacggacccggaccgggaaccgtacggtacgtaacgtagggtactacgggtacgttccgttaaggtttacgttacggtacgacgggtaccggttacgggaccgtaacccaacgtacgttacggtttcggggttaccggttacgggacggtaccgggtaccctacggttaccgtccgggtaaccgttccggaacgtaccggacccgtaccgaccggttaccgtccccgaccggttaccgccgttacccg

SEQ ID NO: 72585 - DNA, 761 bp, Homo sapiens
  misc_feature: GYAE6OF02IME0X.43.72.G06.1.454.CMB.1.raw
tcagtgtgagtagtcacgaccggtgctcgatttagctacgactgcaagggaaaggggctgggcctcaggaagcagcatcggaggtgcctcagccatggcatggactccctctcttcctcggcgtccttgcttactgcacaggatccgtggccgcctatgagttgactcacgccacctcagtgtccgtcgtcccaggaccagacacgccagcacgtccactgctcgtcggaagtaataaggtaggggaataaatacgtcgcctccgtggtactcgacgactaagacgcgaggcgacgttcccgtgttcgttacggtctacttactactacgtaagacgtacgaaaccgaaccggtacccgtcggtaaccggtacgtacccgtaggacggtacggttacttccggtacttcgggtacttaccgtaacgtcggttaacggaacaccgtacgcccgtacttacgacgtaactaccgtagaccggggaacccggtaaccgtacggtatttacggaggtacgtcggtaacggttaccgtttacgtttaacgtttacgtacggttcggtacggtaccgggttaccggtaaactaaccgtaacgttccgtttacggggtttaccgtttaccgggggaacgttaacggggaacctacggttaccggtaccggggttaaacccgtccggtttaaccggaacccggtaacggttacccgggaacggtttccccggtaccggtaaccccccgttttgggaaccctttacccgg

SEQ ID NO: 72586 - DNA, 780 bp, Homo sapiens
  misc_feature: GYAE6OF02F70WS.43.72.G06.1.454.CMB.1.raw
  modified_base (138)..(138): a, c, t, g, unknown or other
  misc_feature (138)..(138): n is a, c, g, or t
  modified_base (177)..(177): a, c, t, g, unknown or other
  misc_feature (177)..(177): n is a, c, g, or t
tcagtgtgagtagtcacgaccggtgctcgatttagctacgactgcaagggaaaggggctgggcctcaggaagcagcatcggaggtgcctcagccatggcatggatccctctcttctcggcgtccttgcttactgcacnggatccgtggccgcctatgagttgactcagcccaccctnagtgtccgtgtccccaggacagacagccagcatcgacctgctcgtaggagtattaaaggttgggggaataaagtattcggacccttccgtggttatacgagacaaggacgaccgaagggaccgtacgtaccccgttgggttcgttcggttacgacttacgtactaccgaaaggtctacgaaacgaaaccggtccccgtaggaccgggtaactcccggtagacggtacgtaactttccgtccggtagtccacctaacgtacggtacgggaaacaaccgtaccgaccgtacctcgtaccgacctagtaccgaccgggacccggaccgtacggtacgtacgtacgggagttaggcggttacgttaggtttaccttttacgtacgggtacgtaccggggtacgttaacccggggaaccctaaccgtaaccggttacgtttcgggtttacccgggttaacggggggtaccgggtaaccgggtaaccgtacccgggtacggttaaaccccggggtcccgtttaaccggggtaaccggtttacccggaacggttaaccccgtacggggtcccttccccggggacccggtttccccgtacccgtaaccccg

SEQ ID NO: 72587 - DNA, 674 bp, Homo sapiens
  misc_feature: GYAE6OF02GU9UY.43.72.G06.1.454.CMB.1.raw
  modified_base (535)..(535): a, c, t, g, unknown or other
  misc_feature (535)..(535): n is a, c, g, or t
tcagtgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggcccgcctatgagttgactcacgccaccctcagtgtccgtcgtccccaggacagacagccagcatcacctgctcgtggagaagtaaaggttaggggaataaagtagtacgtccctaccgtaggtactacgagacgaacgaacggaccgacgggaccggtaccgtccccgtaggttcgggttcggtactacgttacttagtaaccgaaagtacgtacgaaaccgaaccggtccctaacggacgggtacctcccgtagacgtacgtacttccgtgtcgtcctaccgtaactcgacggaacgacacgaccactcacgacctacgaccgacggacccggacgtacgggactagtacggtagacggtacgttacgttacgttacgttttacncgggttacggacgggtacgtacggaaccaaccgtacgtacgttcgggttcggttacgggacgggacgacgtacggacgtaccggtaccgttacgcgaccgtacgaccgtacgacccgtcccgtaccgccgtactcccgg

SEQ ID NO: 72588 - DNA, 794 bp, Homo sapiens
  misc_feature: GYAE6OF02HNXUQ.43.72.G06.1.454.CMB.1.raw
  modified_base (131)..(131): a, c, t, g, unknown or other
  misc_feature (131)..(131): n is a, c, g, or t
  modified_base (143)..(143): a, c, t, g, unknown or other
  misc_feature (143)..(143): n is a, c, g, or t
  modified_base (174)..(174): a, c, t, g, unknown or other
  misc_feature (174)..(174): n is a, c, g, or t
  modified_base (469)..(469): a, c, t, g, unknown or other
  misc_feature (469)..(469): n is a, c, g, or t
tcagtgtgagtagtcacgaccggtgctcgatttagctacgactgcaagggaaaggggctgggcctcaggaagcagcatcggaggtgcctcagccatggcatggatcctctctcctcgcgtccttgcttacngcacagatccgnggccgcctagtgagtgactcacgccaccctnacgtgtccgtcgtcccgaggaccagacagaccgagcatacaccgtgtccgacgtaggaacgtaaattaaaggtttagggggaattaaaacgttactcggtaccttccggttacggttactacgagtcgtacgaacggacccgagggtacgtaccggttccccgttcgtcggtttcgtacctacttcgtacgttacgaaagtagaacgaaccgtaacccggtaccgtacggtacggtaccgttaccgaggtacgacgttacttcgtcgtcgtcctaaccgtacgtcgtacggaacncgtctaccgcctacgtacaccgtaacgtaccggccggtaacccggtaacgacggtactacgggttagaaccggttacggtaccgtacggttaccgttttacgttccgttaacggtccggtttacgggtacggtaccgggaacccttaaaccgtaacggtaccggttttacggtttaacgggttaccggggaccgggtaaccggtacccgggaacgttccccgggttacgtccccgggttaacttacggtcccggaaacccggttcccggaacccgtttcccggtaccccccggtccccggtttaccgggtaccccttacccccgg

SEQ ID NO: 72589 - DNA, 890 bp, Homo sapiens
  misc_feature: GYAE6OF02JMOK5.43.72.G06.1.454.CMB.1.raw
tcagtgtgagtagtcacgaccggtgctcgatttagctacgactgcaagggaaaggggctgggcctcaggaagcagcatcggaggtgcctcagccatcggcatggatccctcttcttccgtcggcgtccttgcttactgcacgacggatccggtcggccgcctagtggagttgactctacgacccaccctcagttcgtccggtacgtccccgaaggacgacgacacggccaagcacgtccacctgacctcgtagggaagtacgttaaaggttacgggggaattaaaacgtcgttccggtaccgttcgttaggtacctacgtaacgacgtaacgggtacgaccgtaacgggcctaaccggttcccgtggttacgttcggtactacgttacgtaatactacggtaactaccgggaacgtaaacccggtcccggtacggaaccgggttaccgttacccggtaggtacggtaaccgtttaacttccgggttaacgtcggttaacccttaccctaacgtacccgggtaacgggaaaccgtaccgtaaccgggtaccctaaccgtccgtaaccggtaaccaccgttccggaaccgggtacccggtaccgtacgggtaccgttacggtaagggtaccggtacggttaccgggttacgttaccggtttaaccgttacggtccgggttacgtaccggggttacgtacccgggtaacctaacccgggttaacgttacggggttaccggttttaccggggttaccgggtaacgggacccgggtttaccaacgggtacccggttacccggtaacccggttgggttaacccggtaccgtaaccgggtccccgtacggggtacccctcccgggttacccccggttacgttccccgttaacccggg

SEQ ID NO: 72590 - DNA, 428 bp, Homo sapiens
  misc_feature: GYAE6OF01CGPYR.34.70.G04.1.454.CMB.1.raw
  modified_base (422)..(428): a, c, t, g, unknown or other
  misc_feature (422)..(428): n is a, c, g, or t
tcagtacacgtgatcacgaccggtgctcgatttagtgtagtgtgaagggaagggactggagtggattgggtatgtcgatcacagtgggagcaccaactacaacccctccctcaagagtcgactcaccatctccgtacacacgtctaagaagcaattctccctgaggctgacttctgtgaccgctgcggacacggccctgtattactgtgcgagagggctttcggacatctatggttactctttaggctactggggccagggaatactggtcaccgtctcctcagcctccaccaagggccccatcggtcttccccctggccaccctcctccaagacgcacctcgtggggcacgagcggccctgggctgcctggtcaaggctacttccatcacgtgtactgagcgggctggcaaggcgcatagnnnnnnn

SEQ ID NO: 72591 - DNA, 423 bp, Homo sapiens
  misc_feature: GYAE6OF02HRNA8.34.70.G04.1.454.CMB.1.raw
  modified_base (416)..(423): a, c, t, g, unknown or other
  misc_feature (416)..(423): n is a, c, g, or t
tcagtacacgtgatcacgaccggtgctcgatttagtgtagtgtgaagggaagggactggagtggattgggtatgtcgatcacagtgggagcaccaactacaacccctccctcaagagtcgactcaccatctccgtacacacgtctaagaagcaattctccctgaggctgacttctgtgaccgctgcggacacggccctgtattactgtgcgagagggctttcggacatctatggttactctttaggctactggggccagggatactggtcaccgtctcctcagcctccaccaagggcccatcggtcttccccctggccaccctcctccaagagcacctctggggcacagcggccctgggctgcctggtcaaggctacttccatcagtgtactgagcgggctggcaaggcgcatagnnnnnnnn

SEQ ID NO: 72592 - DNA, 663 bp, Homo sapiens
  misc_feature: GYAE6OF01DTJGG.26.11.A11.1.454.CMB.1.raw
  modified_base (276)..(276): a, c, t, g, unknown or other
  misc_feature (276)..(276): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
tcagagactatactcacgaccggtgctcgatttagctacgactgcgaaggggaaaggggcagcaagatggtgttgcagacccaggtcttcatttctctgttgctctggatctctggtgcccgcgggacatcgtgatgacccagtctccagtactcccgtggctgtgtctcgtgggcgaggaggccacatcaactgcaacgtccgagccagtagtcgttttacgacaggtccgaacaataagaactacttagcttacgtaccagcaacgtaaaccgnggacagcctactaatctactctatttacgcggcctcgtacccggtaagtccgggtctcgtcggctattcaggtcnccgaggcgggtcgngggacnggtacgttacactcctacgacctactcgacgcgtaccgcctaggacgtaacggtctaaggaaagtagtacgggtagtacttaaggttttaactacgtcgtactaaggtacttaaagtttacgttttcgtacgtacccgttaccgtaacgtttaccggtttacggaccggtacggggacccgttagggtacgtagtacgtacgaacgacgtaacgttgggtcgtagtacgtaccgtaaccgtacgttccgttaacgttaccctttactaccgtttccccgttccccggtaccg

SEQ ID NO: 72593 - DNA, 877 bp, Homo sapiens
  misc_feature: GYAE6OF02IN1XD.26.11.A11.1.454.CMB.1.raw
tcagagactatactcacgaccggtgctcgatttagctacgactgctaaggggtaaagggggcagctaacgatcggtggttgccagacccaggtcttccatttctctgttcgctcgtggtatctcttggtgcccggcggggtacactcgtgactcgacccgacgtcctaccacgacctcccgtggacggtgttgtcgtcgtgggcggaggacgggtccaccgatactaacgtgacgaaagtccaagtacctaggtacgttagttttaagaccgtacggtacccgaagaaacggtaacgtaacttaccttacgtctttacggtaccaggacaaacgaaacctacggaacaacgacccttaccttaattccttaactactaaattttaccgcgggtacccttaccggtaaccccgggtaaggtacccggggtactacgtcgggaccgtattacgtagttaccgaccgtagggtccgggtcgtacgggaaccgtaacggtttaacgtttacctaaccgtttccggttacccgaaaccgtacttaaccgtacggtacctacggtcccggtacgaccggtaaccgggtcgtacggtaacgtacgttcggtacggtacgttacgtttaacgttaccgtacggttaccgaacgttaccgttaacttttaccgtttcggtccgtacccgtttaccgttaccgtttaccggtttaccgggacccggtaaccggggtaacccggtacggggtacggtacggtaccgtaccggaacggtaccggtaaccggttcgggtccggtaccggttccggtaacccggtacccgttaacggttcccgtttaccgtttcccgttaccgtttaccttaccccgttaccccgtaccgg

SEQ ID NO: 72594 - DNA, 518 bp, Homo sapiens
  misc_feature: GYAE6OF01D6ZHL.9.15.B04.1.454.CMB.1.raw
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
  modified_base (339)..(339): a, c, t, g, unknown or other
  misc_feature (339)..(339): n is a, c, g, or t
  modified_base (446)..(446): a, c, t, g, unknown or other
  misc_feature (446)..(446): n is a, c, g, or t
tcagtgatacgtctcacgaccggtgctcgatttagacagtatatatccgcggggggattagaaagctgggggtctgatttgcatggatggaccctcccactctcagagtatgaagaggggcagggagagatttggggaggctctgcttcagctgtgggcacaagcggcagcactcaggacaatctccagcatggcctggtctcctctcctcctcactctcctcgctcactgcacagagtcctgggcccagtctgtgctgacgcagccgccctcagtgtctggggccccagggcagaggtcaccatctcctgttctggancagctccaacngtcgggganactctgatgcacattggtatcagcagcttaccagaagcacgcccccaaactcctcatctatgcctaacaccaatccggccctcgacgggtccctgacccgtattccnctcggccttaccgaacgttccgtcggcccaaccctccaccgtcccttaccccctagacccctagtctaacgg

SEQ ID NO: 72595 - DNA, 611 bp, Homo sapiens
  misc_feature: GYAE6OF01CXU41.9.15.B04.1.454.CMB.1.raw
  modified_base (337)..(337): a, c, t, g, unknown or other
  misc_feature (337)..(337): n is a, c, g, or t
tcagtgatacgtctcacgaccggtgctcgatttagacagtatatatccgcggggggattagaaagctggggtctgatttgcatggatggaccctcccactctcagagtatgaagaggggcagggagagatttggggaggctctgcttcagctgtgggcacaagcggcagcactcaggacaatctccagcatggcctggtcctcctctccctcctcactctcctcgctcactgcacagagtcctgggcccagtctgtgctgacgcacgccgccctcgagtcgtccgtcggggccccagggccaggacgggtccaccagtcctccgtgttcgtgggacncgacgcctaccaacgacgtcgggggacacgttcgtgactcgactacgtagtttggtactcgacgccgtacgccttaccgaagaacgaccacccgacccccaaacttccctactacttacctataccgacctaaaccaaccctaacgtcccggtacccgtcggtacccgggttccctacggacccgttacttccgtcgtcggtccctaccgtaacgttccgtacggccctacccctcgacccgtcccctaccctacgaccccagttccgtaacgg

SEQ ID NO: 72596 - DNA, 621 bp, Homo sapiens
  misc_feature: GYAE6OF01CTJ7V.9.15.B04.1.454.CMB.1.raw
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
tcagtgatacgtctcacgaccggtgctcgatttagacagtatatatccgcggggggattagaaagctgggggtctgatttgcatggatggaccctccactctcagagtatgaagaggggcagggagagatttggggagctctgcttcagctgtgggcacaagcggcagcactcaggacaatctccagcatggcctggtcctcctctcctcctcactctcctcgctcactcgcacagacgtccgtcgggccctagtctgtcgctcgacgcacgccccgccctcaggtcgtcgtcggggccccgaggcaggacggtcacctactctccgtgttcgtgggacncgacgctacaacgngtacgggganactcgtgactgctacgtagtttgtactcgacgacctagtccttaccgaagtaacgtccaacccgtaccccctaaacttccctacgtacttacctacgtaccgtaacctaactaaccctaacgtccccggtacccgttccggtaaccgggttcccctaacggtacccgtactttccgtccgttcggtacctacccgtaacgtcgtaccggtccctacccgtaccaccgtcccctacccgtacaccctagtcgtaacgg

SEQ ID NO: 72597 - DNA, 673 bp, Homo sapiens
  misc_feature: GYAE6OF01DRZMW.9.15.B04.1.454.CMB.1.raw
  modified_base (238)..(238): a, c, t, g, unknown or other
  misc_feature (238)..(238): n is a, c, g, or t
tcagtgatacgtctcacgaccggtgctcgatttagacagtatatatccgcgggggggattagaaagctgggggtctgatttgcatggatggaccctcccactctcagagtatgaagaggggcagggagagatttgggggagctctgcttcagctgtgggcacaagcggcagcactcaggacaatctccagcatggcctggtcctcctctcctcctcactctcctcgctcactgcacgngggtcctgggccagtcctgtcctgaccgcacgcccggctcgagttactccgtcgggtccccagggccaggacggtccacctattcctcccgtgcctaacgtggaccgaaacgtcggtaccctcccgggaacgtccggaccgtaacttaccctttaagtactttcggtaaacctcgtttaggtaacttacgtaacgttacccgttaccgaacgggtaacccaccgacccccgtagtacccttcctactacttacttacttaccctaacctacccgtttacccgtacccgtcggtacgggtttcctacgtacctacgttccgtcgtcgtccctaccgtacgtccgtcggtaccctacccgtaccgtacccgtccccgttcccgtccggtccccgtacgtaccggtccgggtccctaccgacgttcgtaggaggtacg

SEQ ID NO: 72598 - DNA, 824 bp, Homo sapiens
  misc_feature: GYAE6OF01CUPBO.9.15.B04.1.454.CMB.1.raw
  modified_base (228)..(228): a, c, t, g, unknown or other
  misc_feature (228)..(228): n is a, c, g, or t
  modified_base (280)..(280): a, c, t, g, unknown or other
  misc_feature (280)..(280): n is a, c, g, or t
  modified_base (356)..(356): a, c, t, g, unknown or other
  misc_feature (356)..(356): n is a, c, g, or t
tcagtgatacgtctcacgaccggtgctcgatttagacagtatatatccggcgggggggattaagaaagctgggggtctgatttgcatggatggacccctcccactctcagagtatgaagaggggcagggagagagtttggggagctctgcttcagctgtgggcacaagcggcagcactcgaggacaatctccagcatggcctggtcctcctctcctcctcactctccncgcctcactgcacagcgtccgtcgggccagtctgtcgctagacgcacgcccnccctcgagtcgtcgtccgggaccccgaggccgaggtacggccaacctcgttcctaccgtcggtttcggacgggacncgacggtacctacccgaaacgtaccggggtacgggggaactacgttccgtagtacggtcggtacctaacgttaggtttacggtaacttaccgaacgtccgtacgttacccgttaacccggaaaggtaaccgtaaccccgaacccccggtaaacccccctaaaacccgtttccccgttaaccgtaaccttacccggtaaacgttacccggaaacccttaaaaccccgtaaacccccggttaacccggttaccccccggggtacccccgttaacccggggttaacccggggttacccccgttaacgggttaccccgtttaccggtttaccgttaccccggtaccgggttccccttaaacccggtcccggtttaacccggttacccgggtaaccccctacccggttaccccgtacccggttaccccccttacccgttacccgaaaccccgtagtttaaccccggtaaaggg

SEQ ID NO: 72599 - DNA, 722 bp, Homo sapiens
  misc_feature: GYAE6OF01C2FHF.9.15.B04.1.454.CMB.1.raw
  modified_base (714)..(714): a, c, t, g, unknown or other
  misc_feature (714)..(714): n is a, c, g, or t
tcagtgatacgtctcacgaccggtgctcgatttagacagtatatatccgcgggggggattagaaagctgggggtctgatttgcatggatggaccctcccactctcagagtatgaagaggggcagggagagagtttgggggaggctctgcttcagctggtgggcacgaagcggcagcactcgagacaatctccagcagtggcctggtctcctctcctcctcactcctcctcgctcactgcacagacgtccgtcggccagtctgtcgctcgaccgcacgccgtccctctaggtcggtccggtccggggaccccgacgggacgaggtacgggtccacctacgttccttccgttggttccggtgggaacgcgaacggtacctacccgaaacggacggggtaaccggggaacgtactccgtagtacgtcggactaacgttagtttacgggtaactcggaacgtaccgtacggttaccgttacccgaaacggaaaccggtaaccccgaaccccgtaacccccctaaacctttcccccgtaacgttaccttaccgttaacgtaccgtaaacccctaaacccgtaaacccgttaacccggttaccccggtacccggttaaccggtacccggggttccctaacggtacccgttacgttcccgtacgtcgtaccctaaccgtacggttcaccggcctaccgtccaccgtccctactcaaccgtntacgtacg

SEQ ID NO: 72600 - DNA, 723 bp, Homo sapiens
  misc_feature: GYAE6OF01DARSR.9.15.B04.1.454.CMB.1.raw
  modified_base (712)..(712): a, c, t, g, unknown or other
  misc_feature (712)..(712): n is a, c, g, or t
tcagtgatacgtctcacgaccggtgctcgatttagacagtatatatccgcgggggggattagaaagctgggggtctgatttgcatggatggacccctcccactctcagagtatgaagaggggcagggagagattggggagctctgcttcagctggtggcacaagcggcagcactcaaggacaattcgaccagcagtcggtcctggtctcccgtctcctcctcaccgtcctccctcgctccactcgacacaggtacgtccgtcggtccctagtcgtgtcgcgttacgaccgctacgcccgtccctacgtgtcgtccggtccgggcccggcggacgacggtacgggtaccacccgttacgtccttcccgtacggtttcgtacgggacgtaccgacggtaccctaaacccgtaacggtaccggttacggggggtaactaacgttccgtaggtaccgtccggtactaaccgttaggtttacggttaaccgtcaccggtaccgtacggtacccttaacccgaaaccgaaccgtaacccgaccccgaaccccctaccgtacccttacacgttactacgtacacctaacaccctaaccgcccggtacccgttccggtaccggttccctacggttccgtacgttccgttcgaccgtccgtacggtaccgtaccgttacggcccttacccgtcgtacccgtcccgtacgacctaacccgtntacgtaaccgg

SEQ ID NO: 72601 - DNA, 697 bp, Homo sapiens
  misc_feature: GYAE6OF02GHSPS.9.15.B04.1.454.CMB.1.raw
  modified_base (227)..(227): a, c, t, g, unknown or other
  misc_feature (227)..(227): n is a, c, g, or t
  modified_base (352)..(352): a, c, t, g, unknown or other
  misc_feature (352)..(352): n is a, c, g, or t
tcagtgatacgtctcacgaccggtgctcgatttagacagtatatatccgcgggggggattagaaagctgggggtctgatttgcatggatggacccctcccactctcagagtatgaagaggggcagggagagattttggggaggctctgcttcagctgtgggcacaagcggcagcactcaggacaatctccagcatggcctggtctcctctcctcctcactctcctcnctcactgcacacgacgtcctcgggccctagtctgtcgctgacgcacgcccgccctcagttcgtccgtcggggcccccgagggcaggacgggtccaacctattcctccgtcgccgacgtggggacncgacgcctaccaacacgtacgggaatccgacttagttcggtttacgtaacctacgtccggtaaccagtccgacgtccgtttacccgaacggaaccctaacccgtaacccccctaaaacccctctaacttacctaacgttaacggttaaacttaacggtaaaccttcccgggtaccccttacgggtacccgggttccccttaccggtaacccgttacgtttcctaccgtcggtaccttacccgttaacggtccgtaccgggtaccctaccggaccgttcccctcccgtaccggtaccctacgttcccgtaaccggttcgggttacccctttacggacggttacccg

SEQ ID NO: 72602 - DNA, 768 bp, Homo sapiens
  misc_feature: GYAE6OF02GOFFI.9.15.B04.1.454.CMB.1.raw
tcagtgatacgtctcacgaccggtgctcgatttagacagtatatatccgcgggggggattagaaagctgggggtctgatttgcatggatggaccctcccactctcagagtatgaagaggggcagggagagatttggggaggctctgcttcagctgtgggcacaagcggcagcactcaggacaatctccagcatggcctggtctcctctcctcctcactctcctcgctcactgcacagacgtccgtcggcccagtctgtgctgacgcacgcccgccctcgagtcgtccgtccggggcccccgaggggccgacgggtacgggtcccaaccgtacttccgttccgttggttccggtaggggacgccgacggtccctaccgaaacgtacggggttccgggggaactaccgttcgtaggacgtcggacctaacgttagtttacgggtaactaccgaggtaccgtacgtaccttaccgaaacgtaacgacccgtaaaccccggaacccccctaaaaccgttcccgtaaccttacgttaccttaacgtaccgtaacctaaaccctaaccccgtaaccggttaccccggtaccccgttacccgggtaacccggggttaccccgtaccgggtaaccccgttaacgtttacccgttaccggttccggtacccttaacccggtaacggttacccggttaccggtaccccttaacccgttacccgtaccccggttacccccttaccccgtaccggaaccccttacgtacccgttaacggg

SEQ ID NO: 72603 - DNA, 624 bp, Homo sapiens
  misc_feature: GYAE6OF02GE210.9.15.B04.1.454.CMB.1.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
  modified_base (387)..(387): a, c, t, g, unknown or other
  misc_feature (387)..(387): n is a, c, g, or t
  modified_base (409)..(409): a, c, t, g, unknown or other
  misc_feature (409)..(409): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (446)..(446): a, c, t, g, unknown or other
  misc_feature (446)..(446): n is a, c, g, or t
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
  modified_base (607)..(607): a, c, t, g, unknown or other
  misc_feature (607)..(607): n is a, c, g, or t
tcagtgatacgtctcacgaccggtgctcgatttagacagtatatatccgcggggggattagaaagctggggtctgatttgcatggatggaccctccactctcagagtatgaagagggcagggagagatttgggggagcgtctgcttcagtctggtacgggcaacgaacgcggacacgcaactcgaaggacaatcctccagcatcggcctggtctcctcctcctctcactcctcctcgcttcactnaccganaggacgttccgcggcctgttcgtgtcgtacncgacgccgngcccccgcctgtacgtcgtccggtccggggacccagggccaaggcggtaccacgtctcgttccgttaggttcgcgggatcacgtcctacgaaacgnggtcgggaacgtctgtagctanacattagtcgtatcganacncgtacgtacacgtaacnccgacctacccaaacctcctacncttacncgtactaacctaactaccgacggttacccgccgttccggaaccggttcccgtaccgtacttacccttgtcccgtacgtccctacggtaacgtcccgtacgaaccctacgtccaccccgttccgtaccccgtnaccctaagtcgtaaacg

SEQ ID NO: 72604 - DNA, 659 bp, Homo sapiens
  misc_feature: GYAE6OF02GFPQP.9.15.B04.1.454.CMB.1.raw
  modified_base (224)..(224): a, c, t, g, unknown or other
  misc_feature (224)..(224): n is a, c, g, or t
tcagtgatacgtctcacgaccggtgctcgatttagacagtatatatccgcggggggattagaaagctggggtctgatttgcatggatggaccctcccactctcagagtatgaagagggcagggagagatttggggaggctctgcttcagctgtggcacaagcggcagcactcaggacaatctcagcatcggctggtctcctctcctcctcactctcctcgctcnctgcacagcgtccgtcggcccagtctgtcgctgaccgcacgccccgtccctcacggtcgtccggtccgggcccccgagggccgaagggaccgggtccaaccgtacgttccgttccgttcggtttccgtaggggactaccgacgtacccgtaacccgaaacgtacggggtaccgggggaaccttaccgttcgtagacgttcgaccgtacgtagtttcggtactcgacgctacgtcctacgagaacgacccgaacccgtaccccctacttccctactacttactacgcctacctaaaccacctaccgtccgcccgtacggtacccgggttcccacgtacccgttaccttctccggtccgtaccctaccgtagtcccgtacggtccccaacccgtcgtaccccgttccctaccctaccgtaacccttgtaccgtacgg

SEQ ID NO: 72605 - DNA, 692 bp, Homo sapiens
  misc_feature: GYAE6OF02H4KY3.9.15.B04.1.454.CMB.1.raw
  modified_base (214)..(214): a, c, t, g, unknown or other
  misc_feature (214)..(214): n is a, c, g, or t
  modified_base (261)..(261): a, c, t, g, unknown or other
  misc_feature (261)..(261): n is a, c, g, or t
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
tcagtgatacgtctcacgaccggtgctcgatttagacagtatatatccgcgggggggattagaaagctgggggtctgatttgcatggatggaccctcccactctcagagtatgaagaggggcagggagagatttggggaggctctgcttcagctgtggcacaagcgcagcactcaggacaatctccagcatcggcctgtctcctctcctcctcnctcctcctcgctcactcgcacgagacgtcctcgggcccagtcctgtnccgtgacgcacgcccgcctcagttcgtccgtcggggccccagggcaggcggtccacnctcctctgttcgngggnccngcctaccaacgnggtacggggactactcgagtagcgtacctagtaagtttcggtatacgcgacgtacgtccttaccgaagaccgaccaccgtaacccctaaacctcctacctacgtacctaacgttaccgaaccttaaaccacccgtaaacgtacccggtacccgttacccgggtaacccggggttcccgtaacccggtaaccgtttaaccttccggttaccgttaccggttacccggtaacccgtttaaccgggttaccggttacccggtaacccgtaaccccgttacccgtaacccgttcccccgttaacccggtaacccctaaccccgttacgttaacccccggttaaggg

SEQ ID NO: 72606 - DNA, 500 bp, Homo sapiens
  misc_feature: GYAE6OF01AE9V2.40.69.G03.1.454.CMB.1.raw
  modified_base (497)..(497): a, c, t, g, unknown or other
  misc_feature (497)..(497): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatcccacccgggccactggtatcccagtcaggttcagtggcagtgggtctgggacagagttcactctcaccatcagcagcctgcagtctgaagtatgttgctagtttattcctgtcagcagtacaatgtactcggccgtactacgtttcggccgagggaccaagcgtggagatacgaaacgactgtgctgcacntcg

SEQ ID NO: 72607 - DNA, 611 bp, Homo sapiens
  misc_feature: GYAE6OF01DAMSV.40.69.G03.1.454.CMB.1.raw
tcagtctagcgactcacgaccggtgctcgatttagtcgctgcgtaaaggagaaagggggaggaactgctcagttaggacccagacggaaccatggaagccccagcgcagcttctcttcctcctgctactctggctccagatagcgctggagaaatagtgatgacgcagtctccagccaccctgtctgtgtctccgaagggaaaagacgccacctctcctgcagggccagtgagagtgttcgacaccttacttgcctacggtaaccaacacagacctggccaggcctccaggcctcctcactctcgtggtcactacgtcccgacccggcacgtggtactccagtcacggttcagtgactaggtcggtcgtgggacaggtacgttacacgttctacacctagtacacgcgagcccgtgacgtaggttaccgtaaggtaacggttagttacggttcgtaccttaagtttttacgttccgtgtttacaggtacctaagtaacctagtacgtacgtcggttacccgttacgttacggttcgggaacccgtagggtacccaaggtaccgtagggaatacgtacgaaacgtcgtagcggtactcgacctacgattccg

SEQ ID NO: 72608 - DNA, 555 bp, Homo sapiens
  misc_feature: GYAE6OF01C8OWZ.40.69.G03.1.454.CMB.1.raw
  modified_base (269)..(269): a, c, t, g, unknown or other
  misc_feature (269)..(269): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctccagatagcgctggaagaaatagtgatgacgcagtctccagtcaccctgtctgtgtctccgaaggggaaaagagcccaaccctctcctgcagggccagtgagagtgttgacacctattagcctggtatcaacanagacctggccaggcctccgaggctcctnatctctggtncatcccgaccgggcacgtggtaactccagtcaggttcagtggcagtgggtctgggacagtagttcatcctacacctatcagacacgctgcagtctagaagtagtgttgcttagtttacttcgtgtacagtcaagtacaagtgtacgttggtacctacgttacgtttcggaccggtaacggggaacctaaggcgtaggaagtacgtaacgaaaacggaacgttagggtacgtacgtacgaccacctacg

SEQ ID NO: 72609 - DNA, 568 bp, Homo sapiens
  misc_feature: GYAE6OF01DIAU6.40.69.G03.1.454.CMB.1.raw
  modified_base (303)..(303): a, c, t, g, unknown or other
  misc_feature (303)..(303): n is a, c, g, or t
  modified_base (562)..(562): a, c, t, g, unknown or other
  misc_feature (562)..(562): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctccagatagcgctggagaaatagtgatgacgcagtctccagccacctgtctgtgtctccaagggaaagcgccaccctctcctgcagggccagtgagagtgttgacacctacttacgcctaggtacccaacacagacctggccaggctcccaggctcctcatctctggtncactcccgacccgggcactggtactccagtcaggttcagtggctaggtgggtctgggacagtacgttcacgtctacaccatcagcacgcctgcagtctagaagtatgttgcgttagtttacttccgttgtcgtagtcgaagtaactaagttcgtacgtcggtaccgttaacgttacgtttacgggacccgtaacgggggacctaaggtcgttagggacgtaagtaccgaaaacgtacgtaggtcggactgaccaccgtnttaccg

SEQ ID NO: 72610 - DNA, 601 bp, Homo sapiens
  misc_feature: GYAE6OF01CCJAH.40.69.G03.1.454.CMB.1.raw
  modified_base (203)..(203): a, c, t, g, unknown or other
  misc_feature (203)..(203): n is a, c, g, or t
  modified_base (350)..(350): a, c, t, g, unknown or other
  misc_feature (350)..(350): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaanagccacctctcctgcagggccagtgagagtgttgacacctacttagcctggtaccaacacagacctggccaggctcccaggcctcctcatctctggtcgcatcccgacccgggccacgtggtactcccgagtccaggttcagtggcnggtggtctgggacagattcacgtctaccaccatcagcagcctgccagtctagaagtagttgttcgctagttttacttccttgtacacggtactaagtacaaacgttcgaccgttgggtacccgttacgttacgttttccgggaccggtaacggggacccgtaaacggtcggtacgggaaggtaaccgttaacgtaaaaccgggtaaccttacgggtacggtaccgttacggacctaacccgtgttacccgg

SEQ ID NO: 72611 - DNA, 629 bp, Homo sapiens
  misc_feature: GYAE6OF01AU8YB.40.69.G03.1.454.CMB.1.raw
  modified_base (203)..(203): a, c, t, g, unknown or other
  misc_feature (203)..(203): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctccagatagcgctggagaaatagtgatgacgcagtctccagccaccctgtctgtgtctccagggaaaangccaccctctcctgcagggccagtgagagtgttgacacctacttagcctggtaccaacacagacctggccaggcctccgaggcctccncatctctggtncactcccgacccgggccacgtggtactcccgagtcaggtttcaggtggctaggtgggtcgtggganaggtagttccacgttctcacctatcagcagccgtgctagtctaggaacgtagttgttacgtcgttagttttacttccgtgtacacgtacgtaagtaaccagtacgtaccgttacgggtacccgttaaccgttaccgttttccgggaccggtaacgggggtaaccctaacgggtaccgtagggtaagtaccgttaaaccggaaaaccggtaacggttacgggtacgggtaccgtacggacccgtacccgtaacgtttcccgg

SEQ ID NO: 72612 - DNA, 552 bp, Homo sapiens
  misc_feature: GYAE6OF01B41T2.40.69.G03.1.454.CMB.1.raw
  modified_base (204)..(204): a, c, t, g, unknown or other
  misc_feature (204)..(204): n is a, c, g, or t
  modified_base (546)..(546): a, c, t, g, unknown or other
  misc_feature (546)..(546): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaangccaccctctcctgcagggccagtgagagtgttgacacctacttagcctggtaccaacacagacctggccaggcctcccaggcctcctcatctctggtcgctactcccgacccgggcctacgtggtactcccgagtcgaggttcaggtcggcgtaggtcgggtcgtgggacaggtacgttcactctaccaccatcagcacgcctgacagtctaggaagtagttgtgtactagtttactctgtcagtcagtacagtgtacgtcggacctacgttcgttacggccggtagggaccaaggtcgtacgggatacgtacgaaacgtacgtggtacgctagccacgtnttaccg

SEQ ID NO: 72613 - DNA, 561 bp, Homo sapiens
  misc_feature: GYAE6OF01BNUG5.40.69.G03.1.454.CMB.1.raw
  modified_base (206)..(206): a, c, t, g, unknown or other
  misc_feature (206)..(206): n is a, c, g, or t
  modified_base (423)..(423): a, c, t, g, unknown or other
  misc_feature (423)..(423): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccgagggaaaagngcccaccctctcctgcagggccagtgagagtgtgacacctacttagcctggtaccaacacagacctggccaggcctcccgaggcctcctcatctctggtcgcactcccgacccgggccacgtgggtactcccgagtcgaggttcaggtggctagggtcgggtcgtgggactaggacgttccacttctcaccatcagcacgcctgcagtctagaagtnttgttgtcttagtttacttcctgtcagctagtacagtcgtacgtcggtccgttacgttacgtttcggaccggtacgggaccgtaagtcgtaggagaactacgaaacgtacgtggtcggtactacgcctacgtgttccg

SEQ ID NO: 72614 - DNA, 753 bp, Homo sapiens
  misc_feature: GYAE6OF01CS9IE.40.69.G03.1.454.CMB.1.raw
  modified_base (151)..(151): a, c, t, g, unknown or other
  misc_feature (151)..(151): n is a, c, g, or t
  modified_base (171)..(171): a, c, t, g, unknown or other
  misc_feature (171)..(171): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctccagatagcgctgganaaatagtgatgacgcagtcnccacgcccaccctgtctgtcgtcctaccgaagggaaaacgcgcccaccctctcctgcgagggccagtgagtagtgttgacctacctacttacgcctacggtaacccaacgacgacgaccgtcggaccgacggtccctacccgacggtcccttacctcaaccttccgttcggtacgggttccgacccgtacccgttacccccggaccccggtacccgtaacgtttaccggtaacccttaccccgtacggttacggtacgggtttacacgggtttcggaccggttacgggttcggggtccggtaacggggtaaaccgtagggttaccgtttacccgaccgtttccctaaccgaaccttacgtccgaacggtaccaccggtccgtacgtacgtacgttacgtaaggtaacggttacgttcgggttacgtacgtttacgtttacttccgttacggtacgtacgacgtaacgtaactacgtacgtacgtccggtaccgttacgtcggttaccggacggtaaccggtacacggacgtcggtaagtaacgtacaaacgtacgtacgtcggactacgctacgtcgtaccg

SEQ ID NO: 72615 - DNA, 838 bp, Homo sapiens
  misc_feature: GYAE6OF01DMZH5.40.69.G03.1.454.CMB.1.raw
  modified_base (205)..(205): a, c, t, g, unknown or other
  misc_feature (205)..(205): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagcccacctgtctgtgtcctcgaagggaaancgcccaccctctcctgcgacgggccagtgagagttgttcgacctacctacttacgcctacggtaacccaaacaccgacgacccttcgggacccaacgggcctaccccgaggtcccttcccctacgactttcctacgttcgggtacgccctaaccgttcccccggaccccgggggccctacggtttacgggtaacccttcccccgtaaaggttccggttaacgggttaccgagggttccggggccgttaagggggttcggggttaccggtacgggggaaacctagggttaccgtttaccctacccgtttccgtaacccaacctacgtaccgaacggaccgtacccggtccgttcggaccgtacggtttacgtaaggtaaaggttacgtttcggttacgtaccgttttaacgttttaccgtttcccgttgtacgacggtacaacggttaacgtacgttaccggtaccggttaccgggttacccgtttaacggtttacccggttttacgggaacccgggtaacggggtaaacccgtacgggtaccggttacgggtaaacgtaacggtaaacccggtaaaaccggtacggttacgggtacggttacccgaggtaacccctacgttccggtttaaccg

SEQ ID NO: 72616 - DNA, 697 bp, Homo sapiens
  misc_feature: GYAE6OF01AXXOT.40.69.G03.1.454.CMB.1.raw
  modified_base (209)..(209): a, c, t, g, unknown or other
  misc_feature (209)..(209): n is a, c, g, or t
  modified_base (673)..(673): a, c, t, g, unknown or other
  misc_feature (673)..(673): n is a, c, g, or t
  modified_base (693)..(693): a, c, t, g, unknown or other
  misc_feature (693)..(693): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagcccaccctgtctgtcgtctaccgaagggaaaancgccaccctctcctgacgacggcaggtgagtagtgttacgacctaccttacttacgcctacggtaaccaacacgacgaccgtcggaccacggtccctacccgacggtcctccctactacgttccgtcgttacgggtcaccgtaccgttaccccggaaccccggggtccctacggttcggttaacccgttaccccgtacggttacgtaacgggtttccgaaggttcggacggtaggggttcgggtacggtacgggaacgtaggtacgtttaccgaccttctacccgaccgtatccgaacgtccgacgtcccgtagacgtacgttactaggtaacgtagtttgttacgttacgttacgttttaccttcgtcgttacgagtacgtaagtactacgtcgtacgttcggtaccttacgttacggttcggaaccggaggaccgtagacggtagagacgtaacgaagtcgnggtacacgtacacttaccgnttcg

SEQ ID NO: 72617 - DNA, 640 bp, Homo sapiens
  misc_feature: GYAE6OF01BNQ3Z.40.69.G03.1.454.CMB.1.raw
  modified_base (206)..(206): a, c, t, g, unknown or other
  misc_feature (206)..(206): n is a, c, g, or t
  modified_base (315)..(315): a, c, t, g, unknown or other
  misc_feature (315)..(315): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccgaagggaaaangccaccctctcctgcagggccagtgagagtgttgactacctatacgcctaggtaaccaacacagacctggaccaggcctcccgaggtcctcctacactcctcgtggtcncactcccgacccggctacgtggtactccgagtcgtaggttcaggtcggactaggttgggtcgtagggaactaggtacgtttcgaccttccgtaccaacctagttaccgagccgacgtccgtgactagtacgtagaaagtagttgttcgtacttagttttacttccgttagtacgagtctaacgtaacaagttcgtacgttcggtaccgttacgttacggtttacggaccggtaacgggtacctaaggtaccgtagggtaacgtaacgttaaccggaaaaccgtacgttaggttacggtacgttacgacctaaccgtacgttaccg

SEQ ID NO: 72618 - DNA, 706 bp, Homo sapiens
  misc_feature: GYAE6OF01A3KQK.40.69.G03.1.454.CMB.1.raw
  modified_base (416)..(416): a, c, t, g, unknown or other
  misc_feature (416)..(416): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggcctcccagatagcgctggagaaatagtgatgacgcagtctccagcccacctgtctgtcgtctaccgaagggaaaagcgcccacccctctcctgcgacgggccagtgacgtaggtgttcgacctaccttacttacgccttacggtaacccaacacgacgaccgtacgggcccgtacggccttccccgacggtccttcctactacttccgttccgttcgggttcgcctacgtaccccggacccgggcctaacgttcggtacctccccgtagtaccgtacggttcncggtggcgtagggtcggtcgtacgggtacgagtacgttacaccttcgtaccaacctagtccgagtccgacgtccgagtacgtcgtacgtaggtaacgtagttgttacggtacgtttacgtttactccgttagtacgtagtacacgttaagaacgttcggtacttaccgggttaccttaccggttacgttaccgggaccgggtacgggtaaaccgacggtccggtaggtaacgtacgttaaacgtaaacgtcggtcggtacgggtctaaccggactaccgttacgttaccg

SEQ ID NO: 72619 - DNA, 824 bp, Homo sapiens
  misc_feature: GYAE6OF01DTWNC.40.69.G03.1.454.CMB.1.raw
  modified_base (203)..(203): a, c, t, g, unknown or other
  misc_feature (203)..(203): n is a, c, g, or t
  modified_base (217)..(217): a, c, t, g, unknown or other
  misc_feature (217)..(217): n is a, c, g, or t
tcagtctagcgactcacgaccggtgctcgatttagtcgctgcgtaaaggagaaaggggaggaactgctcagttaggacccagacggaaccatggaagccccagcgcagcttctcttcctcctgctactctggctccagatagcgctggagaaactagtgatgacgctagtcctcgagccacctgtctagtgctcgaaggaaancgccacctctacgngacgtacgggcctaggtacgagtacggttgttacgacctaaccgttacgtttaacggccgttacggtaaaccaacgaaccgtaacggtaccgtcggacctacggtcctacccgagtcctcctcgaacttccgtagtcggtacgctaccgtcccggaaccggtcctacggtcgtaacctccagttaccgtaggtactacggtgtaccgggtaggtcgggttaccgtagggtaaccgaggttaacgtaccttaccgttcgtaaccgtaacccgtacgttaaccgaacggtacccgtaaaccggtttccgtaacggtacccgtttaaaggttaacccggtaaggtaaaaccggttgttttacgggttacggttaaacgtttagttttaacccgttccggttaagtaccgtaacggtacgtaacgtttaaccgtaacgttaccgggaacgttccggttaaccgttacggtttacggttaacccggggtaccgttaaacggggaccttaacgggttcggtaaccgggttaaacccgtaacggtaaccgaaaacccggtttacggtaaggttaccgggtaacctaccggtaccgtaccgttacggttaacccg

SEQ ID NO: 72620 - DNA, 774 bp, Homo sapiens
  misc_feature: GYAE6OF01A0R5J.40.69.G03.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaangccaccctgtcctgcagggccagtcgagagtgttgacactacttagcctggtacccaancagacctggccaggctcccaggctcctcagtctcctaggtcgaccacgtccccgacccggggcccaacgttcgggtaacttccccgaaggttccgtaacgggtttccaaggtttggggacctacgggtttcggggtcctagggggtaccaggtacggttttcaccgttcgtcccgaacccgtaattccgtaacggccaacggtacccgttacggccgtaaacgttcccgtttacggaaaacgggtaagtttaggtttcgggtacttaacgggttttttaactttaccccgttccgggttttacaaccggttaccgtaacggttttaacccaaagttaacgggttaacccgtaccgggtttacccggttaaccgttaccgtttttaccggggaccccggaacgggggtaaccgtaaacgggacccgttagggtaaccgggttataaacccggtaaaccgtaaacccgttcgggttaccgggcccgttaggcccgtaacccgtaaggttcccg

SEQ ID NO: 72621 - DNA, 675 bp, Homo sapiens
  misc_feature: GYAE6OF01DZ71W.40.69.G03.1.454.CMB.1.raw
  modified_base (250)..(250): a, c, t, g, unknown or other
  misc_feature (250)..(250): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggaagaaatagtgatgacgcagtctccagcccaccctgtctgtgtcctaccgaaggaaaagcgcccaccctctcctgcgacgggccagtgagtagttgttanacctacctattacgccgtcgtaaccaacacacgacccgtggcccaggcctaccccaggtccctcctcattcctggtcggtcgacctaccgtcccggaacccggcctagttgtacctccaggtcagggttccgaggtcggcgtaggtcgggtctagggaacgtggtactccgacttccacgaccagtaccacgcacgcctgactagtcgtagaagtacgttgttcgtactttacgtttacttccgttgtacgtacggtacgtagtaacgtagtacgggtaacgttcggttaaccgtttaaccttaccgggtttccgggaacccggtaacgggtaccggaacggttccggtacgggaaacgtaacgtaaaccggtaaacggttacgttgggtaccggtaccgtcgtaacccgtaccgtagttcccgg

SEQ ID NO: 72622 - DNA, 613 bp, Homo sapiens
  misc_feature: GYAE6OF01EX3JX.40.69.G03.1.454.CMB.1.raw
  modified_base (237)..(237): a, c, t, g, unknown or other
  misc_feature (237)..(237): n is a, c, g, or t
  modified_base (322)..(322): a, c, t, g, unknown or other
  misc_feature (322)..(322): n is a, c, g, or t
  modified_base (351)..(351): a, c, t, g, unknown or other
  misc_feature (351)..(351): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctccagatagcgctggagaaatagtgatgacgcagtctccagccaccctgtctgtgtctccgaagggaaaagacgccaccctctcctgcgacgggccagtgagngtgttagacctacctacttacgccttaggtaacccaacacagacctggccaggcctacccgacggcctcctcatccgtctggtcnctacgtcccgacccgggctacgtggtacncccgtagtcgtacggtcagtcgacgtggtgggctgggacaggtcgttaccactccgcctaacgtactcgacgctacgccgtcgacacgtcgtagtagtagttgtacgtcttagttttacttccgtgtacgtacgacgtacgtaactagtcgtacgttaccggtaccgttacgttaccgtttcgggacccgtacgggaccgtagtacggtaggacgtaataaccgaaacgtacgtggtacggtacgtacacgtactcgttacg

SEQ ID NO: 72623 - DNA, 806 bp, Homo sapiens
  misc_feature: GYAE6OF01C8XXQ.40.69.G03.1.454.CMB.1.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (327)..(327): a, c, t, g, unknown or other
  misc_feature (327)..(327): n is a, c, g, or t
  modified_base (417)..(417): a, c, t, g, unknown or other
  misc_feature (417)..(417): n is a, c, g, or t
tcagtctagcgactcacgaccggtgctcgatttagtcgctgcgtaaaggagaaagggggaggaactgctcagttacggacccagacggaaccatggaacgccccagcgcagcttctcttcctcctgtcctactctggcctcccgagatacgcgtcctagggaagaaaattaggtgtataggaccgctacggttccaccaacggccctacccttggttcctggttcgtcctacggaaaggggaaaacgtccncccctaacccttccttccgnggaccggtacggggtccctaagtcggacgtaaggttcgttacggacctaaccgttnttacggccgtagtaacccaacactacggacctcggaccaacggtccctacccgaggtaccccttcctctaacgtttccgtcgtcggtacnccgtacccgtaccccggccggtctaacggtcgtacgtcccgtaagttccggtaggttccagggtcgtacgtaaggggttcgggtacgttagggaaccctagggttactccaccgtttccaacctaccggtaactcgacgtacgaccgtcttacggataccgttagaacgtacgttagttacttacgtagttacgtttcggtttcacgtaccgtacgtaccgtaaggttaacttacggacggttacgttccggtaaccgtttaccggttacgttaccgggccgggtaaacgggtaacgaccgtagggtttacgaacgtaaccggtaaaccgtaacccgggttaactgggtttcccgaaacgacccggttaactccgtaaaccggttttcg

SEQ ID NO: 72624 - DNA, 704 bp, Homo sapiens
  misc_feature: GYAE6OF01DHPCX.40.69.G03.1.454.CMB.1.raw
  modified_base (341)..(341): a, c, t, g, unknown or other
  misc_feature (341)..(341): n is a, c, g, or t
tcagtctagcgactcacgaccggtgctcgatttagtcgctgcgtaaaggagaaaggggggaggaactgctcaggttaggacccagacggaaccatggaagccccagcgcagcttctcttcctcctgctactctggctcccagatagcgctggaagaaatagtgatgacgcagtctccagccacctgtctgtgtctccgaaagggaaaagacgcccaccctctcctggccgagggccaggtgaggtagttgttacgaacctaccttacttacgccgtacggtaccaaccacacgacctcggccaggtctcccgaggcctcctcactctcgtggtcgaccacncccgacccgggacctacgtacggtaactcccgagttacgacggttcgaggttggacgtagggttcggtcgtagggacgagtacgtccacgtcctataccatcgaagtccgacgtccgtacgtcgtaacggttacgtaagtaaagtacgttaggttcggtaacgtttacgtttactttacccgttgtaccgtacgtacgttaacgtaacgtaacgtacggtacgttaccgggtacccgttacgtttaccggttttcgggaaccgggtaggggaaccggtaagtaccggtaagggtaacgtaacgtaaaccggtaaaacgtacggttacggtacggtaccgtacgtaccgtaacgttcgtaccgg

SEQ ID NO: 72625 - DNA, 853 bp, Homo sapiens
  misc_feature: GYAE6OF01D5N9G.40.69.G03.1.454.CMB.1.raw
tcagtctagcgactcacgaccggtgctcgatttagtcgctgcgtaaaggagaaagggggagaactgctcagttaggacccagacggaaccatggaacgccccagcgcagccttctcttcctcctgctactctggcctcccagatacgcgtcgtaggaagaaattgtgagtcgacgtacagtcctccacgccctacctgtcgtgtcgtcctaccgaaagggaaaagtccgcccacccttcgtaccgtgaccgaacgggtcctaggttcggaggtaggttacgtacgaccctaacctttacgttacgaccgttaacggtaacccaacgtaccaccggaccgttccggaccgacggtccctacccgtcgtacccttccctactaccgtttccgttcggttcgggtaccgtaccgtacccgttaccccgggaccccgggtacctacggttaccggtaccctaccgtacgttaccgtggttaccgtagtcgggtacgttgggtcggtaccggtagggtaactacggttaccttacccgacccttactaccctacgtacgttacgacgaccgacccgtcccgtacgtaccgttaacggtaggttaacgtaggttacgtttcggtttaccgtttaccgtttaaccgtttttccgtaccgtttacgacgtacggtaacgtacgtaaccgttaagttaccgtaccggttaccgttaccgttaaccggtttccgggttaaccgggtccgggtaaaccgggtacgtacccgggtaaggttaaccggtagtaaaaccgtttaacccgggaaaccgttcgttacgggtaccgttaccgtaacccgtaccctacggttctttcccgg

SEQ ID NO: 72626 - DNA, 515 bp, Homo sapiens
  misc_feature: GYAE6OF02G0QYK.40.69.G03.1.454.CMB.1.raw
  modified_base (426)..(426): a, c, t, g, unknown or other
  misc_feature (426)..(426): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggcctcccaggctcctcatctctggtgcactcccacccgggccactggtactccccagtcaggttcagtggcaggtggtctgggacagagttcactctcaccatcagcagcctgcagtctagaagtatgttgctagtttacttcctgtcngcagtacatgactggcctactacgtttggccgtagggaccaggcgtaggacgatacgaaacgtacgtaggtcggtctcgctacctatcg

SEQ ID NO: 72627 - DNA, 675 bp, Homo sapiens
  misc_feature: GYAE6OF02GQH1G.40.69.G03.1.454.CMB.1.raw
  modified_base (325)..(325): a, c, t, g, unknown or other
  misc_feature (325)..(325): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccacctgtctgtgtctcgaagggaaaagcgcccaccctctcctgcgagggccaggtgagtagtgttgaccaccttacttagccgttaggtaaccaacacacgaccgtcggaccaggcctacccgaggcctccctcactcctcgtggtcnccacgtccccgaccccgggtccacgttcggtacctccccgtaggttccgaacggttctaggtcggccgtaggtcggggtcgtaggggaacctaggtacgttcacttcctacgacctagtccgacgacgacgtccgtcgaccgtaacgtaccgtaggaacgtagttagttcgtacgtttacgttttacttccgtgtacgtacgtacgtaacgtactagtacgtacgtacggttaccgttaacgttcggtttacggaccggtaacgggaccgtaacggtccgtaacggaacgtaacgtaaccgtaaacggtacgttcggtacggtaccgtaggtacccgtacgtacttaccg

SEQ ID NO: 72628 - DNA, 714 bp, Homo sapiens
  misc_feature: GYAE6OF02GVUXS.40.69.G03.1.454.CMB.1.raw
  modified_base (207)..(207): a, c, t, g, unknown or other
  misc_feature (207)..(207): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggcctcccagatagcgctggagaaatagtgatgacgcagtctccagcccaccctgtctgtgtctccaagggaaaangcccacctctcctgcagggccagtgagagtgttgacacctattagcctggtaccaacacagacctggccaggctcccgaggcctcctcatctcgttggtcgcctactccccgacccgggccctacgtcgggttaactccccgaaggttccgtacggtttccaaggttcggacgaggttcggggtactcggggacaggtacgtttccaactcctacgaccaagttccgacgaccgtacgccgttagtctaggtaccgttaggaaacggttacttacgggtttagtacccgttaagtttttaaccgttccgttcggtacctaggtacgtaaacgttaacgtaaacgttacgttaccgtacgggttaacccgttaaccgtttaccgtttttacgggacccggaacggggtaccgaacggttaccggtaagggtaccgttaacgttaaccgaaaaccggttaacgttacgggttaccggtaccgttcggaaccgaccgttaacgttacccg

SEQ ID NO: 72629 - DNA, 814 bp, Homo sapiens
  misc_feature: GYAE6OF02JSKFQ.40.69.G03.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (328)..(328): a, c, t, g, unknown or other
  misc_feature (328)..(328): n is a, c, g, or t
  modified_base (773)..(773): a, c, t, g, unknown or other
  misc_feature (773)..(773): n is a, c, g, or t
tcagtctagcgactcacgaccggtgctcgatttagtcgctgcgtaaaggagaaaggggaggaactgctcagttaggaccagacggaaccatggaagccccagcgcagcttctcttcctcctgctactctggcctcccagatacgcgctggagaaatagtgactgacgcagtctccagccaccctgtctgtgtctccaggaaaancgccaccctntcctgccagggtcccaggtgagagttcgttacgactaccgtacttagccgtagtaccaaccaacgacgaccgtggaccacggtctacccccgaggccttaccgactacgttccncgttcggtcacccgtaagtcccccggtacccgggaccctagttaccgggttaactcccctaggttcccgtacgggtttaccgaggttaccggactacggttcggggtcctacgggggtacctacgttaccgggttccaaaccgtttcgacccgtaaccgtacttaccggaacttcccgaacgggtcccctttggaaccggtacgtttaccgaggttaaacggtagttttccgggtaagttaacccggttcgttttttaaccgccggttttaaagccctaacgggtccgttaaaacgtttaacccgaaagtcggtttaaacccggtccggggtaacccgttaaacccgttttcgggtttccaaccccggggtaagggtacccccgttaaggtaccgggtttaacgaagttaaaccggtacccgtttaaacggacgtttaaccgggnggtcccggtaaacctttaccggaccgtttactttccccggg

SEQ ID NO: 72630 - DNA, 664 bp, Homo sapiens
  misc_feature: GYAE6OF02GPGBP.40.69.G03.1.454.CMB.1.raw
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagcccaccctgtctgtgtctccgaagggaaaagagccaccctctcctgcgagggccagtgagagtgttgactacctactacgcctcggtaaccaacacagacctggccaggcctcccacggtcctcctcactcctcgtggtgcacgtcccgacccgggccgtacgttcggtacctacccgtagtctacggtcgtaacggtggcgtagggttcgggttacggtcgggacaacggtacgttactaaccttctaccacctactcgacgacacgtaccgtcgacgtgtactaggaagtagttggttcgacgttagtttacttacgttcgtacgtacgtacgtacgtaactaagtacgtacgtcgggtaccgttacgtaccggtttacggaccgggtaaccgggtaccgtaacgggtcgtaacgggtaacgtaacgtaaccgtaaacgtaacggttacggtacgggtaccgtaccgtaacgtaccgtacttaccg

SEQ ID NO: 72631 - DNA, 560 bp, Homo sapiens
  misc_feature: GYAE6OF02GXK37.40.69.G03.1.454.CMB.1.raw
  modified_base (306)..(306): a, c, t, g, unknown or other
  misc_feature (306)..(306): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagcccaccctctcctgcagggccagtgagagtgttgacacctattagcctaggtaccaacacagacctggccaggcctcccgaggcctcctcatctctggtncactcccgacccgggccactggtactcccagtcaggttcagtggcaggtgggtctagggacagtagttcactcttccaacctatcacgctacgcctcgctagtctagaagtagtgttgtactagtttacttcctgtcagtactagtacatacgtacgtcgtaccgtactcttttacggaccgagggaccagtacgtaggaacgtagtaaccgaaacgtaagtcggtacggtaccgtcggacctacgtattaccg

SEQ ID NO: 72632 - DNA, 723 bp, Homo sapiens
  misc_feature: GYAE6OF02I4RV0.40.69.G03.1.454.CMB.1.raw
  modified_base (127)..(127): a, c, t, g, unknown or other
  misc_feature (127)..(127): n is a, c, g, or t
  modified_base (203)..(203): a, c, t, g, unknown or other
  misc_feature (203)..(203): n is a, c, g, or t
  modified_base (505)..(505): a, c, t, g, unknown or other
  misc_feature (505)..(505): n is a, c, g, or t
  modified_base (534)..(534): a, c, t, g, unknown or other
  misc_feature (534)..(534): n is a, c, g, or t
  modified_base (572)..(572): a, c, t, g, unknown or other
  misc_feature (572)..(572): n is a, c, g, or t
  modified_base (592)..(592): a, c, t, g, unknown or other
  misc_feature (592)..(592): n is a, c, g, or t
tcagtctagcgactcacgaccggtgctcgatttagtcgctgcgtaaaggagaaagggggagaactgctcagttaggaccagacggaaccatggaagccccagcgcagcttctcttcctcctgctacnctggctccagatagcgctggagaaatagtgatgacgcagtctccagccacctgtctgtcgtctccgaagggaaaancgccctacccttctacccgtgccgaaggggcctaaggtggagtacgttgttacgacctaccgttattacggccgtttacggtaaccctaaaacgaccgtaacggtaccccgttcgggcccaaacgggggtcccccttacccgaggggcccttaccccgttaccgaactttccgttcgtcggggttcacccgtacgttacccccggaacccccggggacctacgttcgggtacctacccgtaggttaccgtacgggttcgaacggtcggaccgtaggggttccggttcgggaacgggtaacgnggttaacgtcctactcgtaccaccgtacncgacgacgcgccgtgcaagtcgtgaagtgtcgttacgnttaacgttcttcctgtaccntacgaagtacctagcgtacgtacgtccgttaactacggtttcggaccgtacggggtacacggttgacgggttaactaacgtaccggaaccgtaagtttcggacggtactaacggccctaagctttacccgg

SEQ ID NO: 72633 - DNA, 778 bp, Homo sapiens
  misc_feature: GYAE6OF02G8W57.40.69.G03.1.454.CMB.1.raw
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccgaagggaaaagacgccaccctctcctgcagggccagtgagagtgttgactacctacttagcctggtaaccaacacacgaccgtggaccaggcctcccgaggccttccctcattcctcgttacgggtcgccacgttccccgaccccgggcctaacggttggttacctcccgtaggtccgtagggttttccaaggttcggccgtaagggttcggggttaccgtgggggtaaactagggtaacgtttccaaaccgttcccttacccaaccctaacgtaccgtaacgtccgaacgtacccgttcgaccgtacggtaccgtaaggtaaaggtagttacgggtttacgtaccgtttacgtttttaccgtttacccgttacggttaccgtaacgtaccgtaacgttaaaccgtaacgttaaccgtaccgggttacccggtaacccgtttaccggtttaacccggtttttaccgggaacccgggtaacggggtaacccgtaacgggtaccggtaaggaacggttaaaccgtaaaccgaaacggttaaccggttagggttaccggtacgtacggtaccaccgtatttaccgg

SEQ ID NO: 72634 - DNA, 596 bp, Homo sapiens
  misc_feature: GYAE6OF02IHXBD.40.69.G03.1.454.CMB.1.raw
  modified_base (207)..(207): a, c, t, g, unknown or other
  misc_feature (207)..(207): n is a, c, g, or t
tcagtctagcgactcacgaccggtgctcgatttagtcgctgcgtaaaaggagaaagggggaggaactgctaagttaggacccagacggaaccatggaagccccagcgcagcttctcttcctcctgctactctggctcccagatagcgctggagaaatagtgatgacgcagtctccagccaccctgtctgtgtctccgagggaaaagngccacccgtctcctgcagggccagtgagagtgttgacacctattagcctggtaccaacttacagacctggccaggcctcccaggcctcctcatcctcgtggtgccacgtcccgacccgggccacgtggtactcccagtcaggttcagtggctaggtgggtcgtgggactaggtacgttcactctacaccatcgagcgcgcctgcagtctagaagtagttgttgacttagttttacttccttgtactagctaagtactaagtcgtacgttcggtaccgttacgttacgtttacggaccggtacggggaaccgtaggtacgtaggtaacggtaactaacgaaacgtaacgttagggtacggtacgtacgtacctaaccgtacgttcttccg

SEQ ID NO: 72635 - DNA, 754 bp, Homo sapiens
  misc_feature: GYAE6OF02JOEA7.40.69.G03.1.454.CMB.1.raw
  modified_base (172)..(172): a, c, t, g, unknown or other
  misc_feature (172)..(172): n is a, c, g, or t
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatgcgctggagaaatagtgatgacgcagtccncagccaccctgtctgtntctccgagggaaangccacctcnctgcagggccagtgagngtagttnactacctattacggcctaggtaaccaacnctacggacctgggaccacgggcctacccacgggcctccactctccttcgtcggtacncctacgtccccgaaccccggtctaacgtcggtacctacccggagtaccgtaggttccgaggtcgggtacctagggtcggggttaccggtgggtaaccgtacgtacgttccctaaaccgtttcccgttaaaccgactttccggaaggtaccctacgggacccttggtacctaaccgggttacgtaccgggtaaaattcgggtttacggttccggtaacgtttaacggttttaaccgttccgttacgtacggtactaccggtaacgttacctaaggtcgtaaccggttcggttaacccttacgttacggttaccggtaccgggtaaccggggtaccgtacggtacggtacggtaacggtaccgttaagtaaacccggttaaggtccggttacgggtccgtaccggtacccggtaaccttacgttcccgttaacg

SEQ ID NO: 72636 - DNA, 719 bp, Homo sapiens
  misc_feature: GYAE6OF02JGCS0.40.69.G03.1.454.CMB.1.raw
  modified_base (123)..(123): a, c, t, g, unknown or other
  misc_feature (123)..(123): n is a, c, g, or t
  modified_base (154)..(154): a, c, t, g, unknown or other
  misc_feature (154)..(154): n is a, c, g, or t
  modified_base (170)..(170): a, c, t, g, unknown or other
  misc_feature (170)..(170): n is a, c, g, or t
  modified_base (186)..(186): a, c, t, g, unknown or other
  misc_feature (186)..(186): n is a, c, g, or t
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
  modified_base (631)..(631): a, c, t, g, unknown or other
  misc_feature (631)..(631): n is a, c, g, or t
tcagtctagcgactcacgaccggtgctcgatttagtcgctgcgtaaaggagaaagggggagaactgctcagttaggacccagacggaaccatggaacgccccagcgcagcttctcttctcctnctactctggcctcccagatacgcgctggaanaaagtgtgatgacgcngtctcagccacctgtntcgntcctcgaaggaaacncgaccacctcgtccagacgacggtcgaacgttggacgttgtagttaccgactaacctcgtttacggccgtacggtaacaccacgaacgactcgaacgtcgtacccgtacgtcggtacctccctattacgccgtgttaaggcttaccacctaccccggccgtactaaggttaccttaacgccctaggttccgagttacttaacggngacggtacgnggttaacccgtggaaacctntaaccgttgtaaccacctaancccgtaagcgtacgacctacgccgtcgtagtaccgtagtaacgtagtaagttacggttctaccggtttattaacgttccgtacgtacggtacgaaacgttactacggttaaacgtacgcgtttaaccgtccgtttaaccggttcggttaacggtaacgggcccgaaggtnttaacccgggtaggttaaccgaggtaaacccgtaagttaccggacgttaaacggttccggtaccgaaccggttacctaggtttacccg

SEQ ID NO: 72637 - DNA, 757 bp, Homo sapiens
  misc_feature: GYAE6OF02FY4AU.40.69.G03.1.454.CMB.1.raw
  modified_base (155)..(155): a, c, t, g, unknown or other
  misc_feature (155)..(155): n is a, c, g, or t
tcagtctagcgactcacgaccggtgctcgatttagtcgctgcgtaaaaggagaaaagggggaggaactgctcagttaggacccagacggaaccatggaagccccagcgcagcttctcttcctcctgctactctggcctcccagatagcgctgganaaatagtgatgacgcagtcctccacgccaccctgtctgtgtctaccgagggaaaagcgcccacctctcctgcgacggccagtgagagttgttgactacctactcgccgtacggtaccaacacgaacgtaccgtcggaccacggcctccccgagggccttcccaccgtactccgtccggttgtcgacctacctccccggaccccgggctaccgtcggttaccgtccgtacgtaccgtaggttaccgtaggtacggcgtggggttcggtaccgggtcggaacggtacgttacgttcccgtacgtaccctcaacctaacgttccgaacgtccacgtacccgttaggaccttacggttacgtaaagggtaacgtacgttagggtttacgttaaccggtttttacgtttttacccttacccgttcgttaccgtagtaacccgtaacgttaaccgtagtccggttaacggtcccgtttaacgttaaccggtttcccggttaaccgggaccggtaaccgggtaaccgaggttaaccgggtgaaccggtaaccgttaaaccggtaacggtacggtgttacggtccgtacccgagttaccgttgttacccg

SEQ ID NO: 72638 - DNA, 708 bp, Homo sapiens
  misc_feature: GYAE6OF02FQCUL.40.69.G03.1.454.CMB.1.raw
  modified_base (315)..(315): a, c, t, g, unknown or other
  misc_feature (315)..(315): n is a, c, g, or t
tcagtctagcgactcacgaccggtgctcgatttagtcgctgcgtaaaggagaaagggggaggaactgctcagttaggacccagacggaaccatggaagccccagcgcagcttctcttcctcctgctactctggctcccagatagcgctggagaaatagtgatgacgcagtctccagccaccctgtctgtgtctccgaagggaaaagacgccaccctctcctgcgagggcccagtgagagtgttcgactacctacgttagccttcggtaccaacacacgaccgttggccgacggcctccccgaggtcccttacccnctaacttccgtcgttgggtcgtccacgtccccggacccgggcctaccgtggttacctcccaggttccaggttccaggtcggcgtaggttcgggtcgtaggggactaggtacgtcgtaactcctaccacctatcgacggtaccacggtcccgtagtaccgtagttccgtaaggaagttacgtaggtttaccgtacgttaagtttttaccgttccgttacgtacgtaccgtacgtaacgttaccgtaagttacgttaacggtaccgtttacccgttactttaaccggttttacggggaccgtaacggggaccgtacggtcggtaagggaacgttacgtaaaccgtaaacggttaccgtaggttaccggtacgtcgacccttaaccggtcttaccg

SEQ ID NO: 72639 - DNA, 747 bp, Homo sapiens
  misc_feature: GYAE6OF02F2VVT.40.69.G03.1.454.CMB.1.raw
  modified_base (151)..(151): a, c, t, g, unknown or other
  misc_feature (151)..(151): n is a, c, g, or t
  modified_base (211)..(211): a, c, t, g, unknown or other
  misc_feature (211)..(211): n is a, c, g, or t
  modified_base (709)..(709): a, c, t, g, unknown or other
  misc_feature (709)..(709): n is a, c, g, or t
tcagtctagcgactcacgaccggtgctcgatttagtcgctgcgtaaaggagaaagggggaggaactgctcagttaggaccagacggaaccatggaagccccagcgcagcttctcttcctcctgctactctggctccgagatagcgctgganaaatagtgatgaacgcagtctccagccctacctgtctggtgtcctaccgaagggaaaacncgccctaccctctcctcgacggacgggtaccagtcggagagttgttacgaactaccgttaacgttacgtccgttacggtaaaccgaacacgacggtacccgttcggccgacggtccctcccggaaggtcccttacccggtataacgttccgttcggtcggggttcacctacgtacccccggtaccggcccttacgttcgggtaacctcccgtaggtcgtacggttccgaggttcgggacgttaggtcggggtacttcgggaacgtgtacgtttccacttccgtacaccgtatctacggctacgtactcggtatcgtacgagtaagtggttctcggttacctttacgttttacgtccgtacggttcacgtaacgttacgtaaccgttacggtgttccgtacggtccgttaaaccgttacggtttaccgaaccgggtaacgggtaccgtaaccgggtacgttaaggggaacgtttaaccgtaaaccggaacggtttaacncgggttaaccgtcgttaaccggcgttacctacggttcg

SEQ ID NO: 72640 - DNA, 168 bp, Homo sapiens
  misc_feature: GYAE6OF01ALQEU.31.23.C01.1.454.CMB.1.raw
  modified_base (154)..(168): a, c, t, g, unknown or other
  misc_feature (154)..(168): n is a, c, g, or t
tcagcagtagacgtcacgaccggtgctcgatttagtacacgtgattcgcggggaccgaagctgaccgtcctaggtcagcccaaggctgcccctcggtcactctgttcccaccctcctcacgtctactgctgagcgggctggcaaggcgcatagnnnnnnnnnnnnnnn

SEQ ID NO: 72641 - DNA, 152 bp, Homo sapiens
  misc_feature: GYAE6OF01CL4OM.31.23.C01.1.454.CMB.1.raw
tcagcagtagacgtcacgaccggtgctcgatttagtacacgtgattcgcggggaccaagctgaccgtcctaggtcagcccaaggctgcccctcggtcactctgttcccgccctcctcacgtctactgctgagcgggctggcaaggcgcatag

SEQ ID NO: 72642 - DNA, 157 bp, Homo sapiens
  misc_feature: GYAE6OF01DMPTH.31.23.C01.1.454.CMB.1.raw
  modified_base (156)..(157): a, c, t, g, unknown or other
  misc_feature (156)..(157): n is a, c, g, or t
tcagcagtagacgtcacgaccggtgctcgatttagtacacgtgattcgcgggggaccgaagctgaccgtcctaggtcagcccaaggctgccccctcggtcactctgttcccaccctcctcacgtctactgctgagcgggctggcaaggcgcatagnn

SEQ ID NO: 72643 - DNA, 155 bp, Homo sapiens
  misc_feature: GYAE6OF01DYM2Z.31.23.C01.1.454.CMB.1.raw
  modified_base (155)..(155): a, c, t, g, unknown or other
  misc_feature (155)..(155): n is a, c, g, or t
tcagcagtagacgtcacgaccggtgctcgatttagtacacgtgattcgcgggggaccaagctgaccgtcctaggtcagcccaaggctgccccctcggtcactctgttcccaccctcctcacgtctactgctgagcgggctggcaaggcgcatagn

SEQ ID NO: 72644 - DNA, 156 bp, Homo sapiens
  misc_feature: GYAE6OF01CKB5J.31.23.C01.1.454.CMB.1.raw
  modified_base (155)..(156): a, c, t, g, unknown or other
  misc_feature (155)..(156): n is a, c, g, or t
tcagcagtagacgtcacgaccggtgctcgatttagtacacgtgattcgcgggggaccaagctgaccgtcctaggtcagcccaaggctgccccctcggtcactctgttcccgccctcctcacgtctactgctgagcgggctggcaaggcgcatagnn

SEQ ID NO: 72645 - DNA, 154 bp, Homo sapiens
  misc_feature: GYAE6OF02HWO7E.31.23.C01.1.454.CMB.1.raw
  modified_base (153)..(154): a, c, t, g, unknown or other
  misc_feature (153)..(154): n is a, c, g, or t
tcagcagtagacgtcacgaccggtgctcgatttagtacacgtgattcgcggggaccaagctgaccgtcctaggtcagcccaaggctgcccctcggtcactctgttcccgccctcctcacgtctactgctgagcgggctggcaaggcgcatagnn

SEQ ID NO: 72646 - DNA, 157 bp, Homo sapiens
  misc_feature: GYAE6OF02HEJKC.31.23.C01.1.454.CMB.1.raw
  modified_base (154)..(157): a, c, t, g, unknown or other
  misc_feature (154)..(157): n is a, c, g, or t
tcagcagtagacgtcacgaccggtgctcgatttagtacacgtgattcgcggggaccgaagctgaccgtcctaggtcagcccaaggctgcccctcggtcactctgttcccaccctcctcacgtctactgctgagcgggctggcaaggcgcatagnnnn

SEQ ID NO: 72647 - DNA, 516 bp, Homo sapiens
  misc_feature: GYAE6OF01CH8OQ.9.65.F10.1.454.CMB.1.raw
  modified_base (509)..(509): a, c, t, g, unknown or other
  misc_feature (509)..(509): n is a, c, g, or t
tcagtgatacgtctcacgaccggtgctcgatttagctacgctctaaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttctgactctgtctcctggtaccaacaacacccaggccaaacccccaagctcatgatttatgatgtcaatcatcggccctcaggggtttctgatcgcttctctggctccaagtccggcaacacggcctccctgacccgtctctgggctccgagactgacgacgaggctgattattctgctcctcatatacaagggcagcactctcgtactagttcggcggtagggaccaagctgaccgtctgggtcacgcccaaggcctcgccccctcggtccncgttccg

SEQ ID NO: 72648 - DNA, 544 bp, Homo sapiens
  misc_feature: GYAE6OF01EJVHD.9.65.F10.1.454.CMB.1.raw
  modified_base (429)..(429): a, c, t, g, unknown or other
  misc_feature (429)..(429): n is a, c, g, or t
  modified_base (463)..(463): a, c, t, g, unknown or other
  misc_feature (463)..(463): n is a, c, g, or t
  modified_base (537)..(537): a, c, t, g, unknown or other
  misc_feature (537)..(537): n is a, c, g, or t
tcagtgatacgtctcacgaccggtgctcgatttagctacgctctaagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttctgactctgtctctgtaccaacaacaccagaccaaacccccagctcatgatttatgaagtcaactaagccggcccgtcggggtatttctgctcgcttctctggcctccgaagtccgtacaactaccgtccctccctagactaatctcgtcgggctccagactgaggacgagctactattacttactgttnctcatatacaggtagtaagtggttggtgttcggnggaggacagctgaccgtctaggtcacgacccgaaggtcctaccgcccccgtcggtcctactccttcgttccccnccctccc

SEQ ID NO: 72649 - DNA, 633 bp, Homo sapiens
  misc_feature: GYAE6OF01AHQEY.9.65.F10.1.454.CMB.1.raw
  modified_base (250)..(250): a, c, t, g, unknown or other
  misc_feature (250)..(250): n is a, c, g, or t
  modified_base (444)..(444): a, c, t, g, unknown or other
  misc_feature (444)..(444): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (512)..(512): a, c, t, g, unknown or other
  misc_feature (512)..(512): n is a, c, g, or t
tcagtgatacgtctcacgaccggtgctcgatttagctacgctctaaggggggggtctcaggaggcagcgctctcgggacgtctccaccatggcctgggctctgctattcctcaccctctcactcagggcacagggtcctgggcccagtctgcccttgactcagcctgcctccgtgtctggtctcgtggacagtcactcaccatctccgtgacctacgtaggaaccagcgagtcggtacgttggtagttcngtactcgtacgttcttcccgtaggtaaacccaaccaaccaacccgaggaaccaaaccgaccccccaaaatcaacttactatttacgacggacgtacaacgtaacggccggtacccttacggtagggtttctattccgtactttcgcgtgacctactaagtcacgaactaacgccgtcctccgagactactccgngtcggctacgagctaggagacgagtctagtattatctgtactnacctntaattcgcgtagagttacgngtaccgacttaccggttcgtaggtacgtcgggacggtaacggaccgtaggtacccgtcttaaccggtaggaccgaccggcccgaacgtcccgtacccgacccggtcgtcttccgtaccccg

SEQ ID NO: 72650 - DNA, 777 bp, Homo sapiens
  misc_feature: GYAE6OF01EB14M.9.65.F10.1.454.CMB.1.raw
tcagtgatacgtctcacgaccggtgctcgatttagctacgctctaaggggggggggtctcaggaggcagcgctctcgggacgtctccaccatggcctgggctctgctattcctcaccctcctcactcagggcacgagggtcctcggggcccagtctcgccctgactcacgcctgcctcgtgtcgtgggtctcgtggacagtcgatcacctatcctcctgccacgtacggaaccagacgtaggtcgtacggttggttggttctgtactctgttcctccgtacgtaacccaacaaccacccgacgacccaaaccccgagctacgtatagtagtttatgtatacgtacaatcctacgtccggtccgttacggttacgggtttctaggtactcgtccttcgtcgtcgggtaccttacgaacggtcccgaaccgaccgtacccgtaccttcccggtacgtacccggtttccgtcgggtcggtccctaccggaacgtcgtaacgaccgacgggtacgtagttacgtttattacgtttccgacgttccgttaccttaatacgtttaacggaacggtacgggtaccgtaaccgtactacccgtacgtttaaccgggtaccgtttaggtacccggggaaccgggtacgggaaacccgttaaccggtcgggtaacccggtttacccgggtaccgggtacggggtacccccgtaacgggtaccccggaccgggtttaccccgtacccccgttacccgggttaccctttccccgtacccgttcccccgg

SEQ ID NO: 72651 - DNA, 700 bp, Homo sapiens
  misc_feature: GYAE6OF01EW991.9.65.F10.1.454.CMB.1.raw
  modified_base (227)..(227): a, c, t, g, unknown or other
  misc_feature (227)..(227): n is a, c, g, or t
tcagtgatacgtctcacgaccggtgctcgatttagctacgctctaaggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatccaccattcctcctgccacgtcggaaccnggcagtgagttggtaggatttatgtaccttgtcctcctggtaaccaacagccacccgaggaccaaacgacccccaaactcactctatttagtgacgtacaacgtaacgccggtcctacgtagggtttcttacgttccgtcttcgtctcggacctaccgagttctacgaacaaaccgccggtccctcccgtacaacgtaactccgtcgtcgggtcctacccgtaggtcgtaggaacggacggacggtctacggttaattacgtttaacgtcgtcgtctaccgtactaattacgtgtacgaagtcggttaggtaccgtaccgtaccgtttaccggttacggttacgggttaccgggaacggggtaaccggtaaaccggtacgggtccgttaaccccgggttaccggtaacggttaccgaacccgggaccgtaccggtacccgtaccccggtcccccgttgtaccccgtttacccg

SEQ ID NO: 72652 - DNA, 523 bp, Homo sapiens
  misc_feature: GYAE6OF02G6GS6.9.65.F10.1.454.CMB.1.raw
tcagtgatacgtctcacgaccggtgctcgatttagctacgctctaaggggggtctcaggaggcagcgctctcgggacgtctccaccatggcctgggctctgctattcctaaccctcctcactcagggcacagggtcctgggcccagtctgccctgactcagcctgcctccgtgtctgggtctcctggacagtcgatcaccatctcctgcactggaaccagcagtgacgttggtggttctgactctgtctcctggtaccaacaacacccaggcaaaccccccaagctcatgatttatgatgtcaatcatcggccctcaggggtttctgatcgcttctctggctccaagtccggcaacacggcctccctgacccgtctctgggctccagactgacgacgaggctgattatttctgctcctcatatacaaggggcagcactctcgtactattcggcggagggaccaagctacgaccgtcctgggtcacgcccaaggcctcggccccctcggtcctaccgtcttccg

SEQ ID NO: 72653 - DNA, 681 bp, Homo sapiens
  misc_feature: GYAE6OF02IV6CV.9.65.F10.1.454.CMB.1.raw
tcagtgatacgtctcacgaccggtgctcgattttagctacgctctaaaggggggtctcgagggggagcaagcgctctcgggacgtctccgaccatcggcctgggctctggctattcctcacctcctcactccacggcacagggtcctgggcccaggtcctggccctgactcacgcctgcctccgtgtctcgggtctcctggacgagttccgatcaccatctcctagcacttcggaaccacgcacggtcgaccgtttggtggttactaggtacgtctagttacttccttggttaccaactaacgtaccccaggaccaaaaccccccaacgactaccaactccgtaatttactagtaattgtacgaagtcaactcgggccctcgtaggggtttcttgtacgttcgcctttctctggtcctccaagtccgcaacacggcctccctgaccgtctactcggtctccgagactgtacgacggaggcttaggtactttacgtttctagtccttcctacacttactacgaaggggtctacggtctacgttcgttccgttaacttagttcggtaacggtacggtacccggtaggccggttaccggacccggtttccgtacggggttacccacggtacccgtaaacggtccgtaaccggtcccccgtacgggttccctacccgttccccgg

SEQ ID NO: 72654 - DNA, 519 bp, Homo sapiens
  misc_feature: GYAE6OF02FPO5O.9.65.F10.1.454.CMB.1.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (298)..(298): a, c, t, g, unknown or other
  misc_feature (298)..(298): n is a, c, g, or t
  modified_base (317)..(317): a, c, t, g, unknown or other
  misc_feature (317)..(317): n is a, c, g, or t
  modified_base (337)..(337): a, c, t, g, unknown or other
  misc_feature (337)..(337): n is a, c, g, or t
  modified_base (373)..(373): a, c, t, g, unknown or other
  misc_feature (373)..(373): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
tcagtgatacgtctcacgaccggtgctcgatttagctacgctctaaggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccngcagtgatgttgggattangaccttgtctcctggtaccaacagcacccaggcaaagccccccaaactcatcatttangaggtcactaagcgccctnaggggtttctattcgcttcnctggctcagtctgacacacgcctccctgacatctcnggctcgagctggaggacgagctgattattactgctgctcatatgcagntggtnacgtacctccggtggtacgttcgggccggtagggaccgagggtcgaccgtcgtaggtcacgcccgaggtccgtacggccccctggtctacccg

SEQ ID NO: 72655 - DNA, 639 bp, Homo sapiens
  misc_feature: GYAE6OF02I6YBI.9.65.F10.1.454.CMB.1.raw
  modified_base (221)..(221): a, c, t, g, unknown or other
  misc_feature (221)..(221): n is a, c, g, or t
  modified_base (241)..(241): a, c, t, g, unknown or other
  misc_feature (241)..(241): n is a, c, g, or t
tcagtgatacgtctcacgaccggtgctcgatttagctacgctctaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttcngactctgtctctgtaccaacaacaccagaccaaacccccagctcatgatttatgatgtacaatcatccggccctcgtagggtttctgatcgtcttctcgtcggctaccgaacgtcccggacaaccgaccggtccctacccgtcggacccgttcgtcgtcgggtcctaccgagtaccgtacggaccgacggacggtacttagtatttactttccgtcgtcccttacctactaattaacgtaaccgggaaggggtaccacgtacctaccgttaccgttacgttaaccgttacgttccggacgggaacggtaaccgacgtcgtaccgtacccggttccggtacggggtaccaccggacccgaacggtccgtcccgtacccccgtcggtacctaccttcccg

SEQ ID NO: 72656 - DNA, 660 bp, Homo sapiens
  misc_feature: GYAE6OF02GHN3V.9.65.F10.1.454.CMB.1.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (554)..(554): a, c, t, g, unknown or other
  misc_feature (554)..(554): n is a, c, g, or t
tcagtgatacgtctcacgaccggtgctcgatttagctacgctctaaggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccngcagtgacgttggtgttcngactntgtctcgtgtaccaanaacacccgaggaccaaacccccagcctacgatacgtaatttagngtattgtacctaacttcgaacgtcccggtacccttcggtagggttttccaggtacttccgtacgtttctcggtacgtcccttaccgaacggttacccggactaaccgaccggtccctacccgtccggtacccgttccgtcgtacgggtccctaccgtaacggtactcggaaccgacggtagtccgttaagtactttacgttcgtcgtcttaccctagttaacgacgttaacgggacggacacgttacncccggttataccgttagtacgttcggaacggacgacctagccgttacggccggtcgtacgggtaccacgtccgacgtccgtcccgacccgtcgtacgtaccttccg

SEQ ID NO: 72657 - DNA, 637 bp, Homo sapiens
  misc_feature: GYAE6OF02FKJF0.9.65.F10.1.454.CMB.1.raw
  modified_base (268)..(268): a, c, t, g, unknown or other
  misc_feature (268)..(268): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
  modified_base (456)..(456): a, c, t, g, unknown or other
  misc_feature (456)..(456): n is a, c, g, or t
tcagtgatacgtctcacgaccggtgctcgatttagctacgctctaaggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcactggaaccagcagtgacgttggtggttctgactctgtctcctaggtaaccaacaacncccaggacccaaacccccagctnatgtaattagngatgtacaatcacgtcggtccctagtcgggtttcngacttcgtctttctcgtgtacctaccgtaacggtccgacgacgtaccggtccctacccgtcgacccgttctcgccgggtctacccgagactcggaaccgacggtacgtctagttacttnttccgtcgtaccttacctatactacgaacggacggggacctacgtctaaccgttcgttaccgtacgttacgtccgggaacggtacggtaccgacgaccgtccggtacccgttcgtacggggtacctaccggtaccggaccgtcccgtacccggtccccgttccgggtactacccttcccgg

SEQ ID NO: 72658 - DNA, 532 bp, Homo sapiens
  misc_feature: GYAE6OF02HAK2M.9.65.F10.1.454.CMB.1.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (290)..(290): a, c, t, g, unknown or other
  misc_feature (290)..(290): n is a, c, g, or t
  modified_base (355)..(355): a, c, t, g, unknown or other
  misc_feature (355)..(355): n is a, c, g, or t
  modified_base (433)..(433): a, c, t, g, unknown or other
  misc_feature (433)..(433): n is a, c, g, or t
tcagtgatacgtctcacgaccggtgctcgatttagctacgctctaagggggggtctcaggaggcagcgctctcgggacgtctccaccatggcctgggctctgctattcctcaccctcctcactcagggcacaggtcctgggcccagtctgccctgactcagcctgcctccgtgtctgggtctcctggacagtcgatcaccatctcctgcactggaaccngcagtgacgttggtgttcngactctgtctctggtaccacaacaccagccaaacccccagctcatgatttangatgtcaatcatccggccctgtacgggtttctgactcgtcttctcgtgctccaagtccgacaacnccggccctccgtgaccgtctcgtcgggctccgagactgacgcgagctgacttatactgctgctctatatgcagatggnactccgttccggtgtacgtcggacgggacggtacgaaggtcgacccggtcgtacggtaccacgacccgaaggccgtaccggtccccctcggtcctaccg

SEQ ID NO: 72659 - DNA, 737 bp, Homo sapiens
  misc_feature: GYAE6OF02HXUB3.9.65.F10.1.454.CMB.1.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
tcagtgatacgtctcacgaccggtgctcgatttagctacgctctaaggggggggtctcaggaggcagcgctctcgggacgtctccacatggcctgggctctgctattcctcaccctcctcgactcagggcagaggtccgtgggcccagtctgccctgactacacgccttcgcctcgtgtctcgggtctaccgnggacngtcactcaccatctcctgcctactaggaaccntcgatcgacgttgtgttcngacctntcgtctcgtcgtaaccaacgaccaccgacgtaaccccaaccccgagtctactaagtcttaagtttatcggtattacgactaactccgacgttacccggacccgtttacggtacggtttacctaacgttcgtccgttcctttacgtcggtaaccgtccttaccgggtaccgaccgttaaccgaacccggtaccggtaccccttccggtaacggtcccgttacggtacccgtcgggtaacccttcggaaacgttcgtaacgggaccggttacgacggttcctactttacgtttcctccgtaatttcccgaccttagtaacgttacggtaaccgggcgtacgaccgtactcgttaccgtagtaaccgttgggtaccgggtacgacgggactaccgtccggaacgttaccggtcggtcgggaaccgtccggtaaccgccggtttacccgcccggttaccccggtcttaacccgtccgttaaccccg

SEQ ID NO: 72660 - DNA, 662 bp, Homo sapiens
  misc_feature: GYAE6OF02HIQ3O.9.65.F10.1.454.CMB.1.raw
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (636)..(636): a, c, t, g, unknown or other
  misc_feature (636)..(636): n is a, c, g, or t
tcagtgatacgtctcacgaccggtgctcgatttagctacgctctaagggggggggtctcaggaggcagcgctctcgggacgtctccaccatggcctgggctctgctattcctcaccctcctcactcagggcacagggtcctgggcccagtctgccctagactcagcctgcctcgtgtctgggtctccgtggacagtcgatcaccatccnctgcagtggaaccngcagtgacgttggtgttcngactntcgtctcctgtaccaacacaccagaccccaaacccagctcagttatangatcgtacatcncgtccgtcctgtacggttcagtagtccgtcttctcgacgtccaccgtacgtcccggaactaccgaccgtccctccgtacgtaccccggtgtaccgttcggaccgtcgaggtaccgtacgtaacggcggtacgtctaggttctttaattccgttacgttccctaccgttataaacgtacggtaacggagtccgtacgtaccctacgtaccggttaacttcgggtactaccggggacggttaaccgacggtacggtccgttaccgggtccggttccgggtaacggtccgtaacccgaccggttaccgggtccctacccggttacccccggngggtttaccctacccggttttacccg

SEQ ID NO: 72661 - DNA, 637 bp, Homo sapiens
  misc_feature: GYAE6OF02GVT7Z.9.65.F10.1.454.CMB.1.raw
  modified_base (225)..(225): a, c, t, g, unknown or other
  misc_feature (225)..(225): n is a, c, g, or t
  modified_base (463)..(463): a, c, t, g, unknown or other
  misc_feature (463)..(463): n is a, c, g, or t
tcagtgatacgtctcacgaccggtgctcgatttagctacgctctaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccacgtaggaacccngcaggtgacggtttggtcggttctgacttctgtcctccgtcggtaaccaacaaccacccaggacccaaaccccccagctcatgtatttatgtatgtctaatcacgtcccgcctcggtacgggtttcaggactccgtctttctcgtcggtcctccgaacggtcccggacaaccgcccgtccctaccctcggtacccttccgtacgtccgggtacctacccgcgaacgtcgaccggacgnggtcttagtatttacttctcgtccctcctatactacgtaaacgggacgggtcaacggtcctactccgttacgtacgttaccggtcggaccgggtaacgcctagtcgtccgtaccggtacgtacggccgacggaccgtcggtccgtccccgtccccggtacgtcctaccgtcccg

SEQ ID NO: 72662 - DNA, 718 bp, Homo sapiens
  misc_feature: GYAE6OF02JG5DJ.9.65.F10.1.454.CMB.1.raw
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
  modified_base (332)..(332): a, c, t, g, unknown or other
  misc_feature (332)..(332): n is a, c, g, or t
tcagtgatacgtctcacgaccggtgctcgatttagctacgctctaagggggggtctcaggaggcggagcgctcgtcgggacgtctccaccagtcggcctgggctctgctatcctcaccctcctctactcagggtccacgagggtcctgggcccagtcgtcgtccctgaacctcacgcctcgacctcgtgtcgtcggtcctccgtagacagtcatcacntcnctagcactcgaacncgnagtcgacggtgttcggttcagctgtgtctcgtacgtaccaactaaccaccgacggaccccaaaacccccagccctacgaccttactacgtttancgtagtccttaacgtactacgacgttcccggtaccgttacggtacgggtttcacggtcttccggtacctttcgtcgtccgtaccgtacctaccggtccgaaccgtaaccgtaccgtccccgtacccgtaccgtaccgttcccgttaccgtcggtacctaaccgtcgtacgtcggaacgcggacgtacgttagttaaccttcgttacgtcttaccgttcctacggtaactcgtaacggtcggtcgtaacccgtctacggttcctacggttaaccgtcggtaccgggacgtaccgttaccgagtacccgtcgtaaccgggtcgcggttaaccgccgtaaccggtaccgtcccttcccgggtacccttacgtacccttccgttccccgg

SEQ ID NO: 72663 - DNA, 750 bp, Homo sapiens
  misc_feature: GYAE6OF02IOLPA.9.65.F10.1.454.CMB.1.raw
  modified_base (174)..(174): a, c, t, g, unknown or other
  misc_feature (174)..(174): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
tcagtgatacgtctcacgaccggtgctcgatttagctacgctctaaggggggggtctcaggaggcagcgctctcgggacgtctccaccatggcctgggctctgctattcctcaccctcctcactcagggcacagggtcctgggcccagtctgccctgactcagcctgcctcgtntcgtggtctcctggacagtcgatcaccntctccngcactggaaccngcagtgattggttgggattancgaccttgtctcctaggtaccaacagccaccaggaccaaacgcccctaaactcactctaattagtgacggtcaacgtaacggccggtaccctacggtacggggttttctaggtttccgacctttctccgttcggtacccttaccgtaaaggttcctaacggaaaccaacccggtaaccgggtaccccttaccccgtaggtaaacctaacgttccgttaccggttacggggtccccttaccgaaccgggtccgtaacggtaacgggtaaccgtacgggtaccggttaagtaacttttaacgttaccggtgtaccttcgtaccgtattagtacgtgaaccgtaggtagttggacgtactacccgttaccgggtacgttacgttacggggacccgggtacgggtaaccgtaacggggttcgtaaccccggttacgtaaccgggtccgtaaaccggtacccggtaacgggtcccctcccgggtaccccccgtttacggtaacccgttaccccg

SEQ ID NO: 72664 - DNA, 487 bp, Homo sapiens
  misc_feature: GYAE6OF01DMUS3.52.32.C10.1.454.CMB.1.raw
  modified_base (227)..(227): a, c, t, g, unknown or other
  misc_feature (227)..(227): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgaattggtatcagcaaaaaccagggacagccctaaactcctgatcctcgatgcatccactttggaaacaggggtcccatcaaggttcagtggaagtggctcgtgggacagattttactttcaccatcagcaggctgcagcctgaagacattgcaacatattactgttcaactagtaatgatagtcctcccgctcacgtttcgggcgggggaccaagggtggagatcaagcgtaacg

SEQ ID NO: 72665 - DNA, 484 bp, Homo sapiens
  misc_feature: GYAE6OF01AEGMI.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacagggtcccatcaaggttcagtggaagtggctcgtgggactagtattttacttcaccatcagcagctgcagcctgaagacattgcaacatattactgtacaactagtatgatagtcctccgtctcacgtttcgggcggggtacagggtgagatcgaagcgtacg

SEQ ID NO: 72666 - DNA, 497 bp, Homo sapiens
  misc_feature: GYAE6OF01BS1NV.52.32.C10.1.454.CMB.1.raw
  modified_base (274)..(274): a, c, t, g, unknown or other
  misc_feature (274)..(274): n is a, c, g, or t
  modified_base (322)..(322): a, c, t, g, unknown or other
  misc_feature (322)..(322): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccngggacagcccctaaactcctgatcctcgatgcatccactttggaaacngggtcccatcaaggttcagtggaagtggctcgtgggacagtattttacttcactatcagcaggctgcagcctagaagacattgcaacatattactgtacaactagtatgaatacgtcctcccgcttcacggtttccgggacgggggtaccaagggtcggagatcgaagcgtaacg

SEQ ID NO: 72667 - DNA, 529 bp, Homo sapiens
  misc_feature: GYAE6OF01BJR43.52.32.C10.1.454.CMB.1.raw
  modified_base (228)..(228): a, c, t, g, unknown or other
  misc_feature (228)..(228): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctcctgtctgcatctataggagacagaatcaccatcacttgccgggngagtcgagacattagcatgtatctgaattggtatcagacaaaaaccagggacacgacccctaaactcctgactcctcgatgcatccactttaggaaactagggtccagtcaaggttcagtggaagtggctcgtgggacagtatttactttcactatcagcaggctgcngctgaanacattgacaatatattactgtacaactagtatagtatacgtccgtacccgtcttaccgtaccggtttccggggaccggggggtaaccaaggggtcgggaacgaacgttacgaacggtcgtaaacgg

SEQ ID NO: 72668 - DNA, 396 bp, Homo sapiens
  misc_feature: GYAE6OF01BVPG8.52.32.C10.1.454.CMB.1.raw
  modified_base (272)..(272): a, c, t, g, unknown or other
  misc_feature (272)..(272): n is a, c, g, or t
  modified_base (301)..(301): a, c, t, g, unknown or other
  misc_feature (301)..(301): n is a, c, g, or t
  modified_base (390)..(396): a, c, t, g, unknown or other
  misc_feature (390)..(396): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagatttttacttcaccatcagcaggctgcagcctgaagcattgcaacattattactgtcaacagtatgataatcctcccgntcactttcggcggagggaccaaggtgganatcagacgaactgtggctgcaccatctgtcttcatccttccgccatctgatatatacgatcgctgagcgggctggcaaggcgacatagnnnnnnn

SEQ ID NO: 72669 - DNA, 613 bp, Homo sapiens
  misc_feature: GYAE6OF01A7KKM.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgtaattggtatcaagacaaaaaccgagggaacacgacccctaaactcctagactcctacgtatcgcactacctaactttaggaaaccgtacggggtacccagtacgtaaagggttctaacggtgggtaaaggtcggtctcgtaggggtactaaggttatttttaccgtttaccaaccgtattacgagtacgaagggcttaggccgtacgtaccctaggaacgtactaacgtttacgacctaaacgtattaacttacgttacgtacaactagtaatagtattacgtaccctcccgtcttacgtaccggtttcgggaccgggggtaaccaagggttcggaagtagtacgaaagtcggtaaacg

SEQ ID NO: 72670 - DNA, 505 bp, Homo sapiens
  misc_feature: GYAE6OF01DBTS8.52.32.C10.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (322)..(322): a, c, t, g, unknown or other
  misc_feature (322)..(322): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggngagtcgagacattagcatgtatctgaattggtatcagacaaaaaccagggacagcccctaaatcctgatcctcgatgcatccactttggaaacngggtcccatcaaggttcagtggaagtggctcgtggacagtattttactttcactatcaacagctgcagcctgaagacattgcaaacatatttactgtacaaacagttatagattacgtcctaccgctctacgtttcgggccggggggtaccaagggtcggaagtacgtcaaagccgaagtcgg

SEQ ID NO: 72671 - DNA, 507 bp, Homo sapiens
  misc_feature: GYAE6OF01B85O3.52.32.C10.1.454.CMB.1.raw
  modified_base (226)..(226): a, c, t, g, unknown or other
  misc_feature (226)..(226): n is a, c, g, or t
  modified_base (452)..(452): a, c, t, g, unknown or other
  misc_feature (452)..(452): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcacatcacttgccgggngagtcgagacattagcatgtatctgaattggtatcagacaaaaccagggacacgccctaaactcctgatcctcgatgcactccactttaggaaactagggtcccagtcaaggttcagtggaagtggctcgtgggactaggtacttttacgttcactatcgagcaggctgcagtcctagaacgacattacgacaactatacttactgtacaactagtatgatagtcncccgtctctacgttcgggccggggtaccagggtcggagactacgaagcgtaacgg

SEQ ID NO: 72672 - DNA, 497 bp, Homo sapiens
  misc_feature: GYAE6OF01BOZAM.52.32.C10.1.454.CMB.1.raw
  modified_base (322)..(322): a, c, t, g, unknown or other
  misc_feature (322)..(322): n is a, c, g, or t
  modified_base (451)..(451): a, c, t, g, unknown or other
  misc_feature (451)..(451): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcgagtcgagacattagcatgtatctgaattggtatcagacaaaaccagggacagacccctaaactcctgatcctcgatgcatccactttggaaacngggtccatcaaggttcagtggaagtggctcgtgggacagtattttacttcacctatcagcaggctgcagcctagaacgtacattgacaactataattactagtacaacagtatgattagtcctcccgtntctacgtttcgggacgggggtacaagggtgagatcgaagcgtaacg

SEQ ID NO: 72673 - DNA, 392 bp, Homo sapiens
  misc_feature: GYAE6OF01AYC3M.52.32.C10.1.454.CMB.1.raw
  modified_base (384)..(392): a, c, t, g, unknown or other
  misc_feature (384)..(392): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagacattgcaacatattactgtcaacagtatgatagtctcccgctcactttcggcggggggaccaaggtggagatcaagcgaactgtggctgcaccatctgtcttcatcttcccgcatctgatatacgatcgctgagcgggctggcaaggcgcatagnnnnnnnnn

SEQ ID NO: 72674 - DNA, 390 bp, Homo sapiens
  misc_feature: GYAE6OF01CI4J5.52.32.C10.1.454.CMB.1.raw
  modified_base (369)..(369): a, c, t, g, unknown or other
  misc_feature (369)..(369): n is a, c, g, or t
  modified_base (385)..(390): a, c, t, g, unknown or other
  misc_feature (385)..(390): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacagggtcccatcaaggttcagtggaagtggctctgggacagattttacttcaccatcagcaggctgcagcctgaagacattgcaacatattactgtcaacagtatgatagtctcccgctcactttcggcggggggaccaaggtcggagatcaagcgaactgtggctgcaccatctgtcttcatcttcccgccatctgatatacgatcgctgagcgggntggcaaggcgcatagnnnnnn

SEQ ID NO: 72675 - DNA, 529 bp, Homo sapiens
  misc_feature: GYAE6OF01D2EDI.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacacgaccccaaaactcctgactcctcgatcgcactccacgtttacggaaacgtacggggtacccatacgaaggttcaggtggaagtggctcgtgggactagtatttacttcactatcgagcaggctgcacgtcctagaacgtacattcgactaactattattactgtacaacgtagttatgtaatacgtcctcccgtctcgtacggtttcgggacgggggtacaagggtcggagtagtcgaagcgtaacg

SEQ ID NO: 72676 - DNA, 389 bp, Homo sapiens
  misc_feature: GYAE6OF01C01ZK.52.32.C10.1.454.CMB.1.raw
  modified_base (378)..(378): a, c, t, g, unknown or other
  misc_feature (378)..(378): n is a, c, g, or t
  modified_base (384)..(389): a, c, t, g, unknown or other
  misc_feature (384)..(389): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacagggtcccatcaaggttcagtggaagtggctctgggacagattttactttcaccatcagcaggctgcagcctgaagacattgcaaacatattactgtcaacagtatgatagtctcccgctcacgtttcggcggggggaccaaggtggagatcaagcgaactgtggctgcacatctgtctcatcttcccgcatctgatatacgatcgctgagcgggctggcaaggcncatagnnnnnn

SEQ ID NO: 72677 - DNA, 493 bp, Homo sapiens
  misc_feature: GYAE6OF01AMPCM.52.32.C10.1.454.CMB.1.raw
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
  modified_base (487)..(487): a, c, t, g, unknown or other
  misc_feature (487)..(487): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagcaaaaaccagggacacgcccctaaactcctgatcctcgatgcatccactttggaaacngggtccatcaaggttcagtggaagtggctcgtgggactagtattttacttcacctatcagcaggctgcagcctagaagacattcgacaactatattactgtacaacgatatgtatacgtctcccgtctctacgtttcgggcggggtacagggtcgagatcgagngtaacg

SEQ ID NO: 72678 - DNA, 506 bp, Homo sapiens
  misc_feature: GYAE6OF01DJASU.52.32.C10.1.454.CMB.1.raw
  modified_base (352)..(352): a, c, t, g, unknown or other
  misc_feature (352)..(352): n is a, c, g, or t
  modified_base (433)..(433): a, c, t, g, unknown or other
  misc_feature (433)..(433): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccactttggaaacaggggtcccatcaaggttcagtggaagtgntctgggactagtattttactttcacctatcagcaggctgcagcctagaacgacattgacaactattattactcgtacaacngttaatgattacgtcctcccggctcgtacgttcgggcgggggtaccaagggttggacgtatcgaagcgtaacg

SEQ ID NO: 72679 - DNA, 553 bp, Homo sapiens
  misc_feature: GYAE6OF01DIS0K.52.32.C10.1.454.CMB.1.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (539)..(539): a, c, t, g, unknown or other
  misc_feature (539)..(539): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttggccgggngagtcgagacattagctatgtatctgtaattggtatcagacaaaaccgagggacacgaccctaaactcctagactcctacgatcgctactacctactttaggaaacgtacgggtacccagtcgaaggttcagtaggaagtggctcgtgggactagtattttactcactatcagcaggtctgacacgacctagaacgactagttgaactaactaattacttaacgtagtacctaacgtagttaatagtacttacgtcctacccgtctaccgtacggtttccggggaccggggtactaagggtcggaagtancgaaggcgtaacgg

SEQ ID NO: 72680 - DNA, 549 bp, Homo sapiens
  misc_feature: GYAE6OF01CMPK0.52.32.C10.1.454.CMB.1.raw
  modified_base (227)..(227): a, c, t, g, unknown or other
  misc_feature (227)..(227): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacaggatcaccatcacttgccggngagtcgagacattagcatgtatctgaattggtatcagacaaaaaccagggacacgacccctaaactcctgactcctcgatgcatccatttgaaacgcgggtaccatcgaaggttcagtggaagtggctcgtggactagtattttacttcacctatcagtcaggctgcgacgcctagaacgactattcgacaactataattactacgtactaactagttactagtaacttacgtcctaccccgtcgttactaccgggttttcggggacccggggggtaaccaaggggtacggaacggtagttaccgaaacggtcggtaaacgg

SEQ ID NO: 72681 - DNA, 509 bp, Homo sapiens
  misc_feature: GYAE6OF01AGNFW.52.32.C10.1.454.CMB.1.raw
  modified_base (203)..(203): a, c, t, g, unknown or other
  misc_feature (203)..(203): n is a, c, g, or t
  modified_base (322)..(322): a, c, t, g, unknown or other
  misc_feature (322)..(322): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcgagtcgagacattagcatgtatctgaattggtatcagcaaaaaccagggacagcccctaaactcctgatcctcgatgcatccactttggaaacnggggtcccagtcaaggttcagtggaagtggctcgtgggacagtattttacttcactatcagcaggctgcagcctgagactattgcaacatattactgtacaacgagtatgtatacgtcctcccgtctacctacggtttcgggaccggggggaccaacgggtggaacggtatcgaaggtcgtaaccgg

SEQ ID NO: 72682 - DNA, 616 bp, Homo sapiens
  misc_feature: GYAE6OF01EH5AS.52.32.C10.1.454.CMB.1.raw
  modified_base (237)..(237): a, c, t, g, unknown or other
  misc_feature (237)..(237): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtcctccactccctccctgtctcgcatctagtaggagacagaactcaaccatcacgttcggccgggngagtcgagactattacgctatgtatctagtaagttggtaactcaacgaaccaaaaaccgacgggaaccacgtacccctaaactcctagactcctcgtatcgcactacctacgtttaggaaacgtacgggtacctagtacgtaacggttcgaggtaggaaggtcgtcgtcggtacgggtaactagtttactttttacttctaacctatcgacgacgtacgctgtacacgtcgtagaatactagttgaacaactattaacttactagttacaacgtattagtagtacgttacgtcccgtacccgtccttacgttaccgggtttcggggggaaccggggtaccgtaaggggtacggaagacgtacgaaacggtccgtaacgg

SEQ ID NO: 72683 - DNA, 498 bp, Homo sapiens
  misc_feature: GYAE6OF01A4VRJ.52.32.C10.1.454.CMB.1.raw
  modified_base (228)..(228): a, c, t, g, unknown or other
  misc_feature (228)..(228): n is a, c, g, or t
  modified_base (429)..(429): a, c, t, g, unknown or other
  misc_feature (429)..(429): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaaaccagggacacgacccctaaactcctgactcctcgatgcatccactttaggaacagggtcccatcaaggttcagtggaagtgctcgtgggacagtattttacttcactatcagcaggctgcagcctagaagacattgacaactatattactgtacaanagtatgatagtcctacccgtctactacggtttcgggacggggtacaagggtcgagatcgaagcgtaacg

SEQ ID NO: 72684 - DNA, 388 bp, Homo sapiens
  misc_feature: GYAE6OF01EBUU5.52.32.C10.1.454.CMB.1.raw
  modified_base (348)..(348): a, c, t, g, unknown or other
  misc_feature (348)..(348): n is a, c, g, or t
  modified_base (374)..(374): a, c, t, g, unknown or other
  misc_feature (374)..(374): n is a, c, g, or t
  modified_base (376)..(376): a, c, t, g, unknown or other
  misc_feature (376)..(376): n is a, c, g, or t
  modified_base (379)..(388): a, c, t, g, unknown or other
  misc_feature (379)..(388): n is a, c, g, or t
tcagcgcagtacgacacgaccggtgctcgatttagtatagacatcaacacacaaagggcgagtcgagacattagcatgtatctgaattggtatcagcaaaaccagggacagcccctaaactcctgatcctcgatgcatccactttggaaacaggggtcccatcaaggttcagtggaagtggctctgggacagattttacttcaccatcagcaggctgcagcctgaagacattgcaacatattactgtacaacagtatgatagtctcccgctcactttcggcgggggaccaaggtggagatcaagcgaactgtggctgcacatctgtcttcatcttccgcatctgatanacgatcgctgagcggctggcaaggcnanagnnnnnnnnnn

SEQ ID NO: 72685 - DNA, 515 bp, Homo sapiens
  misc_feature: GYAE6OF01BNKTM.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaacagggacagcccctaaactcctgatcctcgatgcatccactttggaaacacgggtcccatcaagttcagtggaagtggctgtgggactagtattttacttcacctatcagcaggctgcagcctagaagacattcgacaactattattactgtacaactagtatgattgtcctcccgtcttctacggtttcggggaccggggggtaaccaaggggttcggaagacgtcgaaaggtcgtaaacgg

SEQ ID NO: 72686 - DNA, 556 bp, Homo sapiens
  misc_feature: GYAE6OF01EMU5I.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacacgacccctaaactcctgactcctcgatcgcatccctacgtttagggaaaccgtacggggtacccagttaccgaaggttcaggtggaagtggctcgtagggactaggttattttacgttacacctatcagcgaggctgcagcctagaagtactattgacaactattacttactacgtacaactagtatagacttacgtccttacccgtcttaccgtacggtttccgggggaccgggggtaaccgaagggtggaacgtatacgaaggtcgtaacgg

SEQ ID NO: 72687 - DNA, 390 bp, Homo sapiens
  misc_feature: GYAE6OF01BTWM4.52.32.C10.1.454.CMB.1.raw
  modified_base (376)..(376): a, c, t, g, unknown or other
  misc_feature (376)..(376): n is a, c, g, or t
  modified_base (382)..(390): a, c, t, g, unknown or other
  misc_feature (382)..(390): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagacattgcaacatattactgtcaacagtatgatagtctcccgctcactttcggcgggggaccaaggtggagatcaagcgaactgtggctgcaccatctgtctcatctcccgccatctgatatacgatcgctgagcgggctggcaaggcncatagnnnnnnnnn

SEQ ID NO: 72688 - DNA, 594 bp, Homo sapiens
  misc_feature: GYAE6OF01AIZ5Q.52.32.C10.1.454.CMB.1.raw
  modified_base (227)..(227): a, c, t, g, unknown or other
  misc_feature (227)..(227): n is a, c, g, or t
tcagcgcagtacgacacgaccggtgctcgatttagtatagacatcaacacacaaaggggcgaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggngagtcgagacattagcatgtatctgaattggtatcgagacaaaaccgaggacacgaccctaaacgtcctagactccgtcgatcgactactaccacgtttaggaaacgacggggtcccaagttacgaaggttacaggtggtaaaggtcggcgttaccggtagggacctaggttaactttttctttacgacctatacgagtcgtaaggcttaggacctacgtcccgtagaacgactaattcggataacctagttacttaacggtactactaactagtactaggattaccgtccgttcccgtacttgtaccggtttcggggaccgggggtaactaacggggtagacggaacttacgaaggcgttaaccgg

SEQ ID NO: 72689 - DNA, 490 bp, Homo sapiens
  misc_feature: GYAE6OF01E3AMS.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaacagggacagcccctaaactcctgatcctcgatgcatccactttgaaacagggtcccatcaaggttcagtggaagtggctctgggacagtattttacttcaccatcagcaggctgcagcctgaagacattgcaacatattactgtcaactagtatgattagtcctcccgcttcacgtttccgggccgggggaaccaagggtggagagtcaagcgtaacgg

SEQ ID NO: 72690 - DNA, 507 bp, Homo sapiens
  misc_feature: GYAE6OF01EIZVY.52.32.C10.1.454.CMB.1.raw
  modified_base (227)..(227): a, c, t, g, unknown or other
  misc_feature (227)..(227): n is a, c, g, or t
  modified_base (402)..(402): a, c, t, g, unknown or other
  misc_feature (402)..(402): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgaattggtatcagacaaaaaccaggggacagacccctaaactcctgactcctcgatgcatccactttaggaaacaggggtcccatcaaggttcagtggaagtggctctgggacagtattttacttcaccatcagcaggctgcagcctgaancattgactaacattattactgtacaactagtatgtatacgtcctcccgcttcctacggtttcgggcggggggtaaccaagggtggagatacgaaggtcgtaacgg

SEQ ID NO: 72691 - DNA, 487 bp, Homo sapiens
  misc_feature: GYAE6OF01BE0BY.52.32.C10.1.454.CMB.1.raw
  modified_base (274)..(274): a, c, t, g, unknown or other
  misc_feature (274)..(274): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccngggacagcccctaaactcctgatcctcgatgcatccatttggaaacaggggtcccatcaaggttcagtggaagtggctgtgggacagtattttacttcaccatcagcaggctgcagcctgaagcattcgacaactatattactgtacaacatatgatagtcctcccgctcacgtttcgggccgggggtacaagggtggagatcaagcgtaacg

SEQ ID NO: 72692 - DNA, 403 bp, Homo sapiens
  misc_feature: GYAE6OF01DEQJR.52.32.C10.1.454.CMB.1.raw
  modified_base (229)..(229): a, c, t, g, unknown or other
  misc_feature (229)..(229): n is a, c, g, or t
  modified_base (397)..(403): a, c, t, g, unknown or other
  misc_feature (397)..(403): n is a, c, g, or t
tcagcgcagtacgacacgaccggtgctcgatttagtatagacatcaacacacaaagggcgagtcgagacattagcatgtatctgaattggtatcagcaaaaaccagggacagccccctaaactcctgatcctcgatgcatccactttggaaacaggggtcccatcaaggttcagtggaagtggctctgggacagattttacttcaccatcagcaggctgcagcctgaanacattgcaacatattactgtcaacagtatgatagtctcccgctcacgtttcgggcgggggaccaaggtggagatcaagcgaactgtggctgcaccatctgtcttcattccttccccgctatctgatatacgacttcgctggagcgggctcgggacaaggcgcagtagnnnnnnn

SEQ ID NO: 72693 - DNA, 512 bp, Homo sapiens
  misc_feature: GYAE6OF01C9AQ8.52.32.C10.1.454.CMB.1.raw
  modified_base (227)..(227): a, c, t, g, unknown or other
  misc_feature (227)..(227): n is a, c, g, or t
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
  modified_base (422)..(422): a, c, t, g, unknown or other
  misc_feature (422)..(422): n is a, c, g, or t
  modified_base (495)..(495): a, c, t, g, unknown or other
  misc_feature (495)..(495): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgaattggtatcagacaaaaccagggacacgacccctaaactcctagactcctcgatgcatcctactttaggaaacgngggtcccagtacaaggttcagtggaagtcggntcgtgggactagtattttacttcactatcagcaggctgcagcctagaactacattgactaanacttattactgtacaactagtatgaatcgtcctccgtctctacggttccgggacgggggtacaagggtggaanagtcaaggtcgtaacgg

SEQ ID NO: 72694 - DNA, 631 bp, Homo sapiens
  misc_feature: GYAE6OF01B4RGO.52.32.C10.1.454.CMB.1.raw
  modified_base (228)..(228): a, c, t, g, unknown or other
  misc_feature (228)..(228): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaaccaggacagacccctaactcctgatcctcgatgccatccacgtttaggaaacgtacggggtcccagtactaaggttcaggtggaagtggcttcgtagggtactagtacttttacgtttcaacctatcaagcctagggcttacggcacgtcctaggaacgtacgtattacgactaaaccgtaattaacttaacccgtagttaacctaaaccgtaagttaacgttcggtaaactttacggttaacccttcccccggtaacttccccgttaaccgggtttttacccggggggacccgggggttaaacccgggaaggggttcgggaaacggtagttaaccggaaacgggtacggtaaacccggg

SEQ ID NO: 72695 - DNA, 413 bp, Homo sapiens
  misc_feature: GYAE6OF01C2FBK.52.32.C10.1.454.CMB.1.raw
  modified_base (399)..(413): a, c, t, g, unknown or other
  misc_feature (399)..(413): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctggggacagattttactttcaccatcagcaggctgcagcctgaagacattgcaaacatacttactgtcaacagtatgatagtctcccgctcacgtttcggcggggggtaccaaggtggagatcaagcgaactgtggctgcacatctgtcttcatcttcccgctatctgtatatacgattcgcgtgacggcgggctggacaagggcgacaatagnnnnnnnnnnnnnnn

SEQ ID NO: 72696 - DNA, 581 bp, Homo sapiens
  misc_feature: GYAE6OF01EI9IC.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggggcgagtcgagacattagcatgtatctgaattggtatcagacaaaaaccgagggacacgacccctaaactcctagactcctcgatgcactccacgtttaggaaaccgaggggtacccagtacgtaaggttcaggtaggtaagtggtctcgtgggactagtacttttacttcactatcagcgaggctgcagcctagaagacattagactaactaagttaattaccgtagtacctaaacgtagttatagtaacttacgtacccgttcccgtccgttaccgttaccgggtttccgggggaccggggggtaacccgtaaggggtacgggtaacgtagtacggaaacggtacggtaacgg

SEQ ID NO: 72697 - DNA, 527 bp, Homo sapiens
  misc_feature: GYAE6OF01DLODM.52.32.C10.1.454.CMB.1.raw
  modified_base (402)..(402): a, c, t, g, unknown or other
  misc_feature (402)..(402): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcagacaaaaaccgagggacagacccctaaactcctagatcctcgatgcatccactttggaaacgagggtcccatcaaggttcagtgaagtgctgtgggactagtattttacttcacctatcagcaggctgcagcctagaanactattgaactaactaagtacttacttagtactaaactaggtatagtaattacgtcctacccgtcctacgtaccggtttccgggacgggggtaccaagggtcggaagtagtacaaggcgtaacgg

SEQ ID NO: 72698 - DNA, 600 bp, Homo sapiens
  misc_feature: GYAE6OF01ADKHB.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatccaccatcacgttggccggcgagtcgagacattagcatgtatctagtattggtatcagaacaaaacgaggacacgaccctaaactcctagactcctacgatcgactactacctacgtttacgggaaacgtacggggtaccctaagttaccgtaaggttcgaggtagggaacggtcggtcgttacgtagggactagttacttttacttaccactatacgagtacgacggtctgacgacgtacctagaacgactacgttagactaactattacttactacgtaactaactagtactagtagtaccgtccgtacccgtcgttaccgtaccgggtttcggggaccgggggtaaccgtagggtacggaacgtacgtacggaaggtccggtaacgg

SEQ ID NO: 72699 - DNA, 515 bp, Homo sapiens
  misc_feature: GYAE6OF01BNXFH.52.32.C10.1.454.CMB.1.raw
  modified_base (322)..(322): a, c, t, g, unknown or other
  misc_feature (322)..(322): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgattggtatcagcaaaaaccagggacagacccctaaactcctgatcctcgatgcatccactttggaaacngggtcccatcaaggttcagtgaagtggctgtggacagtattttactttcacctatcagtcaggctgcagcctagaagacattgacaacatattactgtacaacagtaatgtatagttcctacccgcttccacggttttccggggacggggggtaacccaaaggggtggacgaatacgtaaaggccgtaaacgg

SEQ ID NO: 72700 - DNA, 500 bp, Homo sapiens
  misc_feature: GYAE6OF01A8XYG.52.32.C10.1.454.CMB.1.raw
  modified_base (319)..(319): a, c, t, g, unknown or other
  misc_feature (319)..(319): n is a, c, g, or t
  modified_base (431)..(431): a, c, t, g, unknown or other
  misc_feature (431)..(431): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgattggtatcagcaaaaccagggacagccctaaactcctgatcctcgatgcatccactttggaaacnggggtcccatcaaggttcagtggaagtggctctgggactagtacttttacgttcacctatcagcaggctgcagcctagaacgacatttgctaaacataattactagtccaanagtatgattagtctcccgctctacgtttcgggacgggggaccaagggtcggagatcgaaggtcgtaacg

SEQ ID NO: 72701 - DNA, 527 bp, Homo sapiens
  misc_feature: GYAE6OF01A8ZXL.52.32.C10.1.454.CMB.1.raw
  modified_base (227)..(227): a, c, t, g, unknown or other
  misc_feature (227)..(227): n is a, c, g, or t
  modified_base (272)..(272): a, c, t, g, unknown or other
  misc_feature (272)..(272): n is a, c, g, or t
  modified_base (320)..(320): a, c, t, g, unknown or other
  misc_feature (320)..(320): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggngagtcgagacattagcatgtatctgaattggatcagcaaaaaccngggacagcccctaaatcctgatcctcgatgcatccacgtttggaaacngggtcccatacaaggttcaggtgaagtggctcgtgggtacagtattttacttcgacctatacagcaggctgtcagacctagaacgacaattcgacaacatacttactagtacaactagtatgtatagtcctcccgcttcctacggtttccgggaccggggggtaacctaaggggtacggacgaagttacgaaggtaccggtaaacgg

SEQ ID NO: 72702 - DNA, 485 bp, Homo sapiens
  misc_feature: GYAE6OF01D44ZJ.52.32.C10.1.454.CMB.1.raw
  modified_base (228)..(228): a, c, t, g, unknown or other
  misc_feature (228)..(228): n is a, c, g, or t
  modified_base (417)..(417): a, c, t, g, unknown or other
  misc_feature (417)..(417): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagcaaaaaccagggacagcccctaaactcctgatcctcgatgcatccactttggaaacaggggtcccatcaaggttcagtggaagtggctctgggacagtattttacttcaccatcagcaggctgcagcctagagacattgcaacatattactntcaacagtatgatagtctccgctcacgtttcgggcgggggtaccaagggtggagatacgagcgtaacg

SEQ ID NO: 72703 - DNA, 492 bp, Homo sapiens
  misc_feature: GYAE6OF01D8M6E.52.32.C10.1.454.CMB.1.raw
  modified_base (478)..(478): a, c, t, g, unknown or other
  misc_feature (478)..(478): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagccctaaactcctgatcctcgatgcatccactttaggaaacagggtcccatacaaggttcagtggaagtgctcgtgggactagtattttacgttcacctatcagcaggctgcagcctgaagatatgcaactatattactgtacaacatatgatacgtctcccgtctctacgttcgggacgggggtacaagggtcgganatcgaagcgtaacg

SEQ ID NO: 72704 - DNA, 496 bp, Homo sapiens
  misc_feature: GYAE6OF01EQQ0T.52.32.C10.1.454.CMB.1.raw
  modified_base (202)..(202): a, c, t, g, unknown or other
  misc_feature (202)..(202): n is a, c, g, or t
  modified_base (274)..(274): a, c, t, g, unknown or other
  misc_feature (274)..(274): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcacttgccgggcgagtcgagacattagcatgtatctgaattggtatcagacaaaaaccngggacagacccctaaactcctgatcctcgatgcatccagtttggaacagggtcccatcaagttcagtggaagtggctcgtgggacagtattttacttcaccatcgagcaggtctgacagtcctagaanactattnacaactatattaacgtgtacaagatatgtactgtcctccgtcttcacgtttcgggccgggggtacaaggtgaagatcaagcgtaacg

SEQ ID NO: 72705 - DNA, 650 bp, Homo sapiens
  misc_feature: GYAE6OF01A82RL.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctcctgtctgcatctataggagacagaatccaccatcacgttgccgggcgagtcgagacattagcatgtatctagtaattggtatcaagaaccaaaaaccgagggaccacggtaccccctaaactcctagacttccctggaatcgcctaacgttaccccgtaagttttacgggaaaacgtcggggtacccctaagttaccggtaaacggtttcgaagggttcgggtaaaggtcgggtcttcggtaggggtaacctagtttaacgtttttaccttacgaaccctataccgtagtccgaagggcctgaccgtacgacgtagaagtacctagtttacgaacctaatacgttattaaccgtgtaactaacgtagtattgaaccttcgtccttacccgtcgttaccggtccgggttacggggacccgggggtaactaagggtcgggaactaggttacaaagggtccgtaacggg

SEQ ID NO: 72706 - DNA, 393 bp, Homo sapiens
  misc_feature: GYAE6OF01DC1UI.52.32.C10.1.454.CMB.1.raw
  modified_base (385)..(393): a, c, t, g, unknown or other
  misc_feature (385)..(393): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaacaggggtcccatcaaggttcagtggaagtggctctgggacagattttacttcaccatcagcaggctgcagcctgaagacattgcaacatattactgtcaacagtatgatagtctcccgctcactttcggcggggggaccaaggtggagatcaagcgaactgtaggctgcaccatctgtcttcatctcccgcatctgatatacgatcgctgagcgggctggacaaggcgcagtagnnnnnnnnn

SEQ ID NO: 72707 - DNA, 734 bp, Homo sapiens
  misc_feature: GYAE6OF01DG575.52.32.C10.1.454.CMB.1.raw
  modified_base (192)..(192): a, c, t, g, unknown or other
  misc_feature (192)..(192): n is a, c, g, or t
  modified_base (635)..(635): a, c, t, g, unknown or other
  misc_feature (635)..(635): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtccnatctatagaggacagaatacaccactactactacgtccgggccggagtacgacgaacattagtacgatagttatactagtaattaggttagtacaacgaacaaaaaccgaaacgggacgaccgaaccccttaacccttaacctcgtaactacctaccgagtacgacactacctaccgtttaaggtaaacgaacggggtcccgtaactaacgttaacggtacgttacggagggttaaggtagggtccgtcgttacgggacgtaacttaagttttttaccctttttaccaacctaaactcgtaacggacgtaacgggtcgttcgacgtaacgcccggttaagaaacggtaaactactttaggtaccaaaacctaattaaacgtttttaccgtacgttaaccgaaactaaggttattacggtaaacttacgttaccccgtttcccnccggttaccgttaaccggggttttccggggaacggggggggaacccgtaaagtacgggggttacaaacgttccgaaaacggtggtaacccgttaagggg

SEQ ID NO: 72708 - DNA, 594 bp, Homo sapiens
  misc_feature: GYAE6OF01COD9P.52.32.C10.1.454.CMB.1.raw
  modified_base (225)..(225): a, c, t, g, unknown or other
  misc_feature (225)..(225): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcacatcacttgccggngagtcgagacattagcatgtatctgaattggtatcagacaaaaaccagggaccacgacccctaaactcctagactcctcgatcgcactcctaacgtttacggaaacgacggggtaccctatacgaaggtttacaggttagggaaagttggacgtcgtaggggacctagttactttttacctttactacctaatcgtagcgaggctagaccacggtccgtagaacgactatttacggactaactacttaattactacgtacaaacgtagtaatagtaagttacgtccgtaccccgtcttacccgttaccggtttcggggaccggggggtaaccctaagggtacgggacgagtacgaaggtcgttaaccgg

SEQ ID NO: 72709 - DNA, 669 bp, Homo sapiens
  misc_feature: GYAE6OF01BO4W0.52.32.C10.1.454.CMB.1.raw
  modified_base (228)..(228): a, c, t, g, unknown or other
  misc_feature (228)..(228): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggnagtcgagacattagcatgtatctgtaattggtatcaagaacaaaaaccgagggaacacgtacccctaaactcctagactccgtacgtatcgctactaccgtaacgtttacgggaaaacgtcggggtaccctaagtaccgtaaaggttctaagggtaggtaaggtcggtacttacggtacggggtaactaagtttacgtttttaaccttaccgaaccttataccgagtacgtacggtctacggtacacggtaccgacggtaacgtactaagtcgtaaccaacttaacgttacgttaacctaggtaactaaacgtagttattacggtaacttacgttacccgttacccgtacgttacccgttaccgggtttaccgggggacccgggggttaaccctaaggggttacgggaacgtaggttaaccgaaagggtcgttaaaccggg

SEQ ID NO: 72710 - DNA, 544 bp, Homo sapiens
  misc_feature: GYAE6OF01B01MD.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttgccggcgagtcgagacattagcatgtatctgaattggtatcagacaaaaccgaggacacgaccctaaactcctgactcctcgatgcactcctacgtttaggaaacgacggggtcccagtacgaaggttcaggtaggaagtggctcgtagggactagttacttttacttacacctatccagcaggctgcacgtccgtagaacgactattagactaactattattactagtacaacgtagtatgtattacgtccgtcccgtctcccgtacggtttccggggaccgggggtacctaagggtcggagtaagtcgaaggtccgtaacgg

SEQ ID NO: 72711 - DNA, 634 bp, Homo sapiens
  misc_feature: GYAE6OF01C2GAC.52.32.C10.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccatcctcctgtctgcatctatagganacagaatcaccatcacgttggccgggngagtcgagacattagctatgtatctagtattggtatcagaacaaaaccgagggacacgaccctaaactcctagtactcctcgatcgactactacctacgtttacggaaacgtcgggtaccatacgtaagttcgaggtaggtagtgtctcgtaggactagttacttttaccttacactatcgagcgacggtctcgacgacgcgtaggaactactattacgaacaacgtacttaacgttactacgttaactaacgtagttaacgtacgtaacttaccggttccgtaccccggttacgttacccggtttaaccggggtttacccgggggaacccggggggtaacccggttaaagggggtacgggtaaacggttacgtaaccggtaaacgggtcccggtaaaccggg

SEQ ID NO: 72712 - DNA, 936 bp, Homo sapiens
  misc_feature: GYAE6OF01D5MMS.52.32.C10.1.454.CMB.1.raw
  modified_base (234)..(234): a, c, t, g, unknown or other
  misc_feature (234)..(234): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtcctccatccctccctgtctgcatctataggagacagaactcaccatccacgttcggccggngagtcgagactatagcatgtatctgtaattggtatcagacaaaaccgaggacacgaccctaactctgactcctacgatcgactactaccctaacgtttacgggaaaccgtacgggggtacccaacgttacgtaaacggtttcgtaaacgggttaggggtaaaggttcgggtaccgttacgggttacgggggtaaccgttaacgggttttaaaccttttttaacccgttttacccgtaaacccgtttaacgtttaacccggaaccgggtaccggtaacgggttacccgttacgggtaacccgtaaccgggtaccccgttaaacggggtaaaacggttaacccgttaaacgtttaaccgggtaaacccgttaaaaccttaacgtttaaaccgtttttaaacccggtttaacggttaaacccgttaaaacggttaaacggtttaaaccgttaacgggttaaaaccgttttaccccggggtttaaacccccgttttaccccccgggttaacccgtttaccccggggttttaaacccccggggggtttttaacccccggggggggtaaacccccgggggggggggggtaaaaccccggttttaaaacggggggggttaacccgggggttaaaaaccggggttaaaccgggttttaaaccccgggtaaaaacccgggggttaccccgggtttaaaaaccccggggggg

SEQ ID NO: 72713 - DNA, 546 bp, Homo sapiens
  misc_feature: GYAE6OF01DFJHQ.52.32.C10.1.454.CMB.1.raw
  modified_base (225)..(225): a, c, t, g, unknown or other
  misc_feature (225)..(225): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccatcctcctgtctgcatctataggagacagaatcaccatcacttgccggngagtcgagacattagcatgtatctgaattggtatcagacaaaaaccgaggacacgaccctaaactcctagactcctacgatcgcactcctactttagggaaaccacggggtcccatacgaaggttcgaaggtggaagtggactcgtagggactagtacttttacgttacacctatcagcaggctgcacgcctagaagtactattagactaacattaacttacacgtacaactagtatgtaatacgtcctacccgtcttacgtaccggtttcggggaccgggggtaacctaagggtacggaagtacgacgaaagcgtaacgg

SEQ ID NO: 72714 - DNA, 605 bp, Homo sapiens
  misc_feature: GYAE6OF01D2P5L.52.32.C10.1.454.CMB.1.raw
  modified_base (229)..(229): a, c, t, g, unknown or other
  misc_feature (229)..(229): n is a, c, g, or t
  modified_base (277)..(277): a, c, t, g, unknown or other
  misc_feature (277)..(277): n is a, c, g, or t
  modified_base (421)..(421): a, c, t, g, unknown or other
  misc_feature (421)..(421): n is a, c, g, or t
  modified_base (433)..(433): a, c, t, g, unknown or other
  misc_feature (433)..(433): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacgttgcccggngagtcgagactattagcatgtatctagtattggtatcagacaaaacgnggacacgaccctaaactcctgaactctacgatcgacactaccgtacgtttacgaaacgtacgggtaccctagtaccgtaaggttacgagtgggaagtggcttacgtagggactagtactttttaccttacgacctatccagtanacggtctgaccncggtaccgtagaacgtaactacgttacgaacctaacttaacttaacgtttaccgtagtacctaacgtagtaagtagtacgtacgttacccgtcccgtcttaccgttacggtttccggggaccgggggtacggttaaagggtcggaggtaacgtacgaaggccggttaaacgg

SEQ ID NO: 72715 - DNA, 610 bp, Homo sapiens
  misc_feature: GYAE6OF01BSM6T.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttggccgggcgagtcgagacattagcatgtatctagtaattggtatacagacaaaaccgaggacacgacccctaaactcctagtactcctcgatcgactactcctacgtttaggaaaccgtacgggtaccctagtacgtaacggttacgaggtagggaacgtggtcgtcgtaggggacctaggtttaacttttaccttaccgacctaacgtacgacggtcgaaggtctaggactaccggcctaaggaactaccgtagttacgaactaacctagttaacttacgtacgtactaacgtagtagttagactcgttccctaccgtcttccggtaccggtttcggggacccgggggtaacaaggggttcggaagtacgttagaaccgcggttaacgg

SEQ ID NO: 72716 - DNA, 613 bp, Homo sapiens
  misc_feature: GYAE6OF01ASQ4X.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttggccgggcgagtcgagacattagcatgtatctgaattggtatcagacaaaaccgagggacacgacccctaaactcctagactcctacgtatcgactactcctactttacggaaacgtacggggtacccataccgtaaggttccgtaaggtaggtaaggtggaccgttcgtacggggtaacttaaacgtttttacctttactaaccctacttacacgtacgtaggtccgttagccgtacgaccgtagaacgactacgttagaccgtaactaattacttactagtactaactagtatagtaacttacgttaccgtacccgtacgtccgtacggttaccggggaccgggggtaccgaagggtacggtagaagtacgaacgtcggtaacgttacgg

SEQ ID NO: 72717 - DNA, 565 bp, Homo sapiens
  misc_feature: GYAE6OF01A07BG.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgtaattggtatcagacaaaaccgaggacacgacccctaaactcctagactcctcgatgcatacctacgtttaggaaacgacggggtacccagtacgtaaggttcgaggtaggaagtggctcgtgggactagtacttttacttcgacctatcagcgagctgcacgccgtagaacgactattacgacaactattaactttacgtagttaacaactagttaagtagtacttacgtcctcccgtccttaccgtaccggtttccggggaccgggggtaaccgaacgggtacggacggtacgtacgaaggtcgtaacgg

SEQ ID NO: 72718 - DNA, 476 bp, Homo sapiens
  misc_feature: GYAE6OF01B93JC.52.32.C10.1.454.CMB.1.raw
  modified_base (322)..(322): a, c, t, g, unknown or other
  misc_feature (322)..(322): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacngggtccatcaaggttcagtggaagtgctcgtggactagtattttacttcacatcagcaggctgcagcctgaagacattgacaacatattactgtacaacagtatgatagtctccgcttcacgttcggcggggacaggtcgagatcagcgtaacg

SEQ ID NO: 72719 - DNA, 391 bp, Homo sapiens
  misc_feature: GYAE6OF01EJSYO.52.32.C10.1.454.CMB.1.raw
  modified_base (379)..(379): a, c, t, g, unknown or other
  misc_feature (379)..(379): n is a, c, g, or t
  modified_base (385)..(391): a, c, t, g, unknown or other
  misc_feature (385)..(391): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccaagggtggagatcaagcgaactgtggctgcaccatctgtcttcatcttcccgcatctgatatacgatcgctgagcgggctggcaggcncatagnnnnnnn

SEQ ID NO: 72720 - DNA, 603 bp, Homo sapiens
  misc_feature: GYAE6OF01DQ87G.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaccgagggacacgacccctaaactcctagactcctcgacttcgactactcctacgtttaggaaacgtacggggtacccaagtaccgaaggttacacggtgggaaacggtggtacgtcgtacggggaactaaggtactttttaaccttacgtacctattcgacgtcgaacggtctaggaccacgtacccgtaagtaacgaactagttcgaacctaacgtatttaacttaacgtcgtaacctaacgtagtactagtaactcgtctcccgtacttacgtacgtttcggggaccggggtaaccaagggtcggaagtacgtacgaagtcggtaaacgg

SEQ ID NO: 72721 - DNA, 740 bp, Homo sapiens
  misc_feature: GYAE6OF01BXY00.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcaagacaaaaaccgaggacacgaccctaaactcctgactcctcgatcgcactcctaacgtttaggaaaccgtacggggtacccaagttcctaaacgggtttcagggtagggaaagtcgggtacttacggtaggggtaactaggttaacttttttaaccgtttacctaaccctaagttaccgaacggtccaacgggtccgtacggaccgtacggtacccgtaggaaacgtaacgtacgtttacggaacctaaaccgttaaagtttaaccgtttaacgttaccgttaaaccgtaaaccgttaaggttaacgttacggtaaacgtttaccggtaccccgtttacccccggtaccttacccgggtttaacccggggttttacccgggggggaacccggggggggttaaacccgtaaacgggggtttacgggaaaccgggttaacgttaaaccggtaaaccgggtacccgggttaaaaccggg

SEQ ID NO: 72722 - DNA, 546 bp, Homo sapiens
  misc_feature: GYAE6OF01EVGP1.52.32.C10.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcacttgccgggngagtcgagacattagcatgtatctgattggtatcagacaaaacgagggacacgacccctaacgtcctagactccgtcgatgcatacctacgtttaggaaacctcggggtacccagtacgtaaggttcaggtaggaagtggtcgtcgtgggtacagttacttttacgttcaccgtataccgagcgaggtctgactacgtcctagaacgtacattgacaactatacttactcgtactaacagttatagtattacgtcctccgtctacgtacggttcgggaccgggggtacaaggggtcggagagtacgaaggccgtaacgg

SEQ ID NO: 72723 - DNA, 817 bp, Homo sapiens
  misc_feature: GYAE6OF01BP8IO.52.32.C10.1.454.CMB.1.raw
tcagcgcagtacgacacgaccggtgctcgatttagtatagacatcaacacacaaagggggcaggagtcagtacccaaccaggacactagcatggacatgagggtccctgctcagctcctggggctcctgctcgctctggctctcaggtgccagatgtgtcatccagatgacccagtctccatcctcctgtcctgcatctatacggagacagaactcaccatcacttcgccgggcgagtcgagacattagcatgtatctagaattggtatcgaagaccaaaaaccgagggaccacgaccccttaaaactcctacgaactccctacgtatacgacctaactcccgtaacgtttacggaaaaccgtacgggggtaccccaagttaccgtaaacggttcaaggttagggtaaggtcggtaccttaccggtaagggggtaacctaaggtttaaccgttttttaaccgttaccctaaaccctacgttacgtaacgggccgtaacgggtccgttacggtacccgaacggtaccccgttaaggaaaaccggttaccgtaacgttttaccggaacccgtaaaaccttaactttaaacttttaacccgttaacggttaaacccaaaccgggttaaggtttaacgttacgggttaaaccttaccggttaacccgtttcccccggtaccgtttaacccggttaacccggggtttttaaccccggggggggaccggggggttaaacccccgggttaaaaggggggtaccgggttaaaccggtaaaccgggtttaaccgtaaaaccggggttcccggttaaaaacccgggg

SEQ ID NO: 72724 - DNA, 631 bp, Homo sapiens
  misc_feature: GYAE6OF01AJEQ8.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccactccctcctgtctgcatctagtaggagacagaactccaccatcacgttggccgggcgagtcgagacattagcatgtatctagtaagttggtatacgaacgaaccaaaaaccgaggacaccgaacccctaaactcctagacttcctacgatcgactactacccgtacgtttacgggaaacgtccggggtacccagtacgaaggtttcgaggtagggaagtcgtccttcggtacgggtaactagttacttttaccttaccgacctatacgacgacgtacggtctgacgacgtctaagaactactagttacgacaactattacttactacgtactaacgtagtacgtagtacgttaccgtcccgtacccgtcttacccggttaaccgggtttccgggggaacccgggggttaacgtaaggggtacgggtaagacgtacgaaccggtacgtaacggg

SEQ ID NO: 72725 - DNA, 733 bp, Homo sapiens
  misc_feature: GYAE6OF01DE9QG.52.32.C10.1.454.CMB.1.raw
  modified_base (232)..(232): a, c, t, g, unknown or other
  misc_feature (232)..(232): n is a, c, g, or t
tcagcgcagtacgacacgaccggtgctcgatttagtatagacatcaacacacaaagggggcagtagtcagtcccaaccaggacacagcatggacatgagggtccctgctcagctcctgggctcctgctgctctggctctcaggtgccagatgtgtcatccagatcgacccagtctccatccctcctgtctgcatctataggagacagaatccaccatccacttcggccgggngagtcgagactattagctatgtatctgtaattggtaatcaagaacaaaaaccgagggaccaacgacccctaaactcctagactctacgtatgaccactacccgtaacgtttacgggaaacgtaccggggtacccaagttaccggtaaacggttacgtaagggtacgggtaaacggttcgggtaccgttaccgggtagggggtaaccttaaggttttaacccttttttaacctttacccgtaaaccctaacgttaccgacggtaccggtaacggtccgttacggacccgtacgtacccgttaggaaacgtaccgtaatttacggaaactaaccgtaaattactttaacgtacggttaacaaaccgtaggttaacttacggtaaacgttccggttaccccttcccgttaccgttacccggttacccgggtttacccggggggaccgggggtaaaccggtaacgggtcgggaacgttaacgtacgtaaacggtcgtaaaccggg

SEQ ID NO: 72726 - DNA, 601 bp, Homo sapiens
  misc_feature: GYAE6OF01DA1AR.52.32.C10.1.454.CMB.1.raw
  modified_base (229)..(229): a, c, t, g, unknown or other
  misc_feature (229)..(229): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtcctccatcctccctgtctgcatctataggagacagaatcaccatcacttgccgggngagtcgagacattagcatgtatctagaattggtatcaagacaaaaaccgagggacaacgacccctaaactcctagactcctcgatcgacactcctaactttaggaaaacgtacggggtacccaagttaccgaaggtttacaggttagggaaaggtgggtcctacgttggggaactaggtactttttaacctttacaaccctatcaagtacgaggctcgacagccctagaacgactattcgaacaactattaacttactgtactaacgtgtaatagtaatacgttccgtacccgtactaccgttacggtttccgggggacccggggggtaacaacggggttcggaaacgtagtaacgaaggtacggtaaacgg

SEQ ID NO: 72727 - DNA, 765 bp, Homo sapiens
  misc_feature: GYAE6OF01C5D10.52.32.C10.1.454.CMB.1.raw
  modified_base (227)..(227): a, c, t, g, unknown or other
  misc_feature (227)..(227): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggngagtcgagacattagcatgtatctagaattggtatcagacaaaaccgaggacacgacccctaaactcctagactcctcgatcgctactcctaacgtttacggaaaaccgcgggggttacccaagttaccgtaaagggtttcccaagggtttacggggtaaacggttcgggtaccttaccgggttacgggggtaaccttaaggtttaaccgttttttttaaccttttacccgaaaccccttaacgtttacccgaacgggtacccgtaacggggtcccgtttacgggacccgtaacggtaccccgtttaacggaaacgtaaccgttaagtttaccggaaacctaaaccgttaacgttttaactttaacccgttaggttaaccctaaaccgtagttaacgttaggtaactttaccggttccccttaccccggtaccgttaccccgttaaccgggttttcccgggggaacccgggggggttaacctaaacgggggttcgggaaacggtagttaacccggtaaacgggtccggttaaaccggg

SEQ ID NO: 72728 - DNA, 558 bp, Homo sapiens
  misc_feature: GYAE6OF01DC471.52.32.C10.1.454.CMB.1.raw
  modified_base (202)..(202): a, c, t, g, unknown or other
  misc_feature (202)..(202): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctctgctgctctggctctcaggtgccagatgtgtcatccagatgacccagtctccatcctccctgtctgcatctatagganacagaatcaccataacttggccggcagtcgagacattagcatgtaatctgaattggtatcaggacaaaaaaccagggacacgacccctaaactcctgaactcctacgatcgcatcctacgtttaggaaacgaggggtcccatacaaggttcagtggtaagtggctcgtagggtacaaggttacttttactttacaacctatacgagacgaggccttgcacggcctagaagtactattgacaactattattactgtacaactagtatagtatacgtcctcccgactccgtacgtttccggggacgggggaacctaagggtcggaacgtaacgtaccgaaacggccgtaaacgttcgg

SEQ ID NO: 72729 - DNA, 626 bp, Homo sapiens
  misc_feature: GYAE6OF01AD4CW.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggaccacgtcccctaaaactcctgactcctcgatcgctactccctaacgtttacgggaaaacgtacgggggtacccctaagttaccgtaaagggtttaccagggttagggaaacggttcgggtccgttcggtaggggacctaggttactttttaaccgtttccaacccgtataccgaacgtcgtaaggtccgtcgacctaacggtccctaggaacgactaagttgaccaaactattaagttactagttacctaacgagttaatagaacttcgttaccctcccgtcctacttaccggttcggggacccggggggtacaacggggtggaacgaagtcgaaggtcggtaacgg

SEQ ID NO: 72730 - DNA, 403 bp, Homo sapiens
  misc_feature: GYAE6OF01DCBW5.52.32.C10.1.454.CMB.1.raw
  modified_base (394)..(403): a, c, t, g, unknown or other
  misc_feature (394)..(403): n is a, c, g, or t
tcagcgcagtacgacacgaccggtgctcgatttagtatagacatcaacacacaaagggcgagtcgagacattagcatgtatctgaattggtatcagcaaaaaccagggacagccccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcacttcggcgggggaccaaggtggagatcaagcgaactgtaggctgcaccagtctgttcttcactccttcccgctatctgatatacgatcgctgagccgggctgggacaagggcacatagnnnnnnnnnn

SEQ ID NO: 72731 - DNA, 389 bp, Homo sapiens
  misc_feature: GYAE6OF01E0J1J.52.32.C10.1.454.CMB.1.raw
  modified_base (384)..(389): a, c, t, g, unknown or other
  misc_feature (384)..(389): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtgctgcacatctgtcttcatcttcccgctatctgatatacgatcgctgagcgggctggcaaggcgacatagnnnnnn

SEQ ID NO: 72732 - DNA, 575 bp, Homo sapiens
  misc_feature: GYAE6OF01E3Z6W.52.32.C10.1.454.CMB.1.raw
  modified_base (203)..(203): a, c, t, g, unknown or other
  misc_feature (203)..(203): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcgagtcgagacattagcatgtatctgattgtatcagacaaaaccaggacacgacccctaaactcctagactcctacgatcgacactcctaacgtttacggaaacgtacgggtacccagtacgaaggttcaggtaggaagtggtctacgtagggaactagttacttttaccttacacctactactagcgaggctgacgacgtacccgtagaacgtactagttcgacaaactattattactagtacaactagtatgacttacgtccttacccgtcgttaccgtaccgggtttccgggggaccggggggtaaccctaaggggtacggagaacgtacgaaggtcggtaacgg

SEQ ID NO: 72733 - DNA, 562 bp, Homo sapiens
  misc_feature: GYAE6OF01AIQMA.52.32.C10.1.454.CMB.1.raw
  modified_base (144)..(144): a, c, t, g, unknown or other
  misc_feature (144)..(144): n is a, c, g, or t
  modified_base (149)..(149): a, c, t, g, unknown or other
  misc_feature (149)..(149): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (480)..(480): a, c, t, g, unknown or other
  misc_feature (480)..(480): n is a, c, g, or t
  modified_base (550)..(550): a, c, t, g, unknown or other
  misc_feature (550)..(550): n is a, c, g, or t
tcagcgcagtacgacacgaccggtgctcgatttagtatagacatcaacacacaaagggggcaggagtcagtcccaaccaggacacagcatggacatgaggtccctgctcagctcctgggctcctgctgctctggctctcaggtnccagntgtgtcatccagatcgacccagtctccacttccctccctgtactcgcatctagtaggacgtacagaactccaccattacgacttggacccgggcgtagtcgagacgtatagctatgtactcgtagtaagttgtatcgaacgaacgaaaacgacgggaccacgtaccctaactctagtactccgtacgatcactactacgtaagttacggaaactcgggtacctatacgtaaggttctagggtagaacgtcgacgttcggacggtatagttacttttacnctactatacngtacngcncgcagctagatancgtanaccaatcgtattacgngtactaacgatgtacgattcgacttccgcttcgtcggtaccgggcgggtaactagggtagtaacgcgtanaacggtgtaacg

SEQ ID NO: 72734 - DNA, 761 bp, Homo sapiens
  misc_feature: GYAE6OF01CO0IH.52.32.C10.1.454.CMB.1.raw
  modified_base (111)..(111): a, c, t, g, unknown or other
  misc_feature (111)..(111): n is a, c, g, or t
  modified_base (208)..(208): a, c, t, g, unknown or other
  misc_feature (208)..(208): n is a, c, g, or t
  modified_base (234)..(234): a, c, t, g, unknown or other
  misc_feature (234)..(234): n is a, c, g, or t
tcagcgcagtacgacacgaccggtgctcgatttagtatagacatcaacacacaaagggggcaggagtcagtcccaaccaggacacagcatggacatgagggtccctgctcngaaactcctggggctcctgctgctctggctctcaggtgccagatgtgtcatccagatgacccagtctccatccctccctgtctgcatctagtagganacagaatccacatcacttggccgggngagtcgagacattagcatgtatctagaattggtatacgagaaccaaaaccgagggaccacgacccctaaacgtcctgactcctcgatcgactacttccgtaacgtttagggaaaccgtacggggtaccctaagttaccgaaacgggtttaccgaggttaggggtaaacggttcgggtaccgttacggtagggggtaacccgttaaggttttaacctttttttaacccgttttacccgaacccgtaacgtttaccggaacgtaccggtaaccgggtccgttacggacccgtaacgggtacccgttacgggaaacgtaaccgttaagtttaccggtaacctaaacgttaacttttaaccgtttaaccgttacgttaacctaaaacgtaggttaacttacggtaacgtttacccgttacccgttcccccggtacgtttacccgttaacccggggtttccgggggaacccgggggggtaaacctacgggggtagggtaacgtaaggtaccgaaagggtacggttaaccggg

SEQ ID NO: 72735 - DNA, 677 bp, Homo sapiens
  misc_feature: GYAE6OF01BP4FY.52.32.C10.1.454.CMB.1.raw
  modified_base (206)..(206): a, c, t, g, unknown or other
  misc_feature (206)..(206): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtcctccactccctccctgtctgcatctatagganacagaatccaccatcacttcggccgggcgagtcgagacattagcatgtatctgtaattggtatcgagaacaaaaaccgagggaccaacgtaccccctaaactcctagacttcctacgatcgacctacttaccctaacgtttacggaaaccggtacggggtacccaagttacgtaaggttactaagggttagggtaaaggtcggtacgttacggtacggggtactaacggtttaactttttaccttacctaacctagttacgacggtacgacggtcttacggaccgtacgtaccgtagaacgtaacgtacgttacgaactaacgtaattaacgttaccgttagttacctaacgtagttagtagtaacgttacgttccctacccgtccttacgttaccgggtttccgggggacccggggggtaaccgtagggggttacggaacggtaagtaccgaacgggtaccgtaaaccgg

SEQ ID NO: 72736 - DNA, 841 bp, Homo sapiens
  misc_feature: GYAE6OF01A6MDM.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtcctccatccctccctgtctgcatctataggagacagaatccaccatcacttcggccgggcgagtcgagactattagctatgtatctagtaattggtatcaagacaaaacgaggaccacgtaccctaaactcctgactcctacgatcgactacgtaccgtacgtttaacgggaaacgtaccggggtaccctaagttaccgtaaagggtttaccgaagggttacggggtaaacggttcgggtaccgttacgggttaacgggggtaaccttaacggttttaaaccttttttaacccgtttaaccgaaacccgttaacgtttacccggaacgggtaccgtaaccggggtcccgttacggtacccgtaacggtaccccggttaaggaaaccgttaaccgtaacgtttacggaaaccttaaacttaacgtttaacgttttaaaccgttacggttaaaccgaaacgttaaggttaacgttacggttaaaccgtttacccggtttaccccgttaaaccccggttcccgtttaaccccgggtttaaacccggggggtttttcccgggggggaaacccccggggggggttaaaacccgtaacgggggggtttaaccgggtaaaccgggttaaacggttaaacccgggtaaaaccggggtcccgggtttaaaacccggg

SEQ ID NO: 72737 - DNA, 692 bp, Homo sapiens
  misc_feature: GYAE6OF01CLYXS.52.32.C10.1.454.CMB.1.raw
  modified_base (205)..(205): a, c, t, g, unknown or other
  misc_feature (205)..(205): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccatccctcctgtctgcatctatagganacagaatcacatcactggccggcgagtcgagacattagcatgtatctagtaatggtatcgaagaacaaaacgagggaccaacgaccctaaactcctagactcctcgtatcgactactacctacgtttacggaaacgtacgggtacccaagtacgtaaggttacaaggtaggaacggttcggacttacggtacggggtaacctaggtttaactttttaccttacctaacctaagttaccgaacggtaccgtacgggaccttacggaccgtaaccggaccgtaacggtaaaccgtaactaacgtttacgaaccttaaacgttaacgtttaaactttaccgtacgggttaacctaaacgtaagttacgttaaggtaaacttaccggttaccccttacccgggtacctttaccggttaaccgggttttcccgggggacggggggtaaccgtaacggggtggtaacgagttaaccgaacggtacgtaacggg

SEQ ID NO: 72738 - DNA, 609 bp, Homo sapiens
  misc_feature: GYAE6OF01A3TV6.52.32.C10.1.454.CMB.1.raw
  modified_base (231)..(231): a, c, t, g, unknown or other
  misc_feature (231)..(231): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacgttggccgggngagtcgagacatagctatgtatctagtagttaggtatcgaagaaccgaaaaaccgacgggaccaaccggtaccctaaaccgtcctagtactcctacgactcgactactacctacgttaacggaacgtacggggtacctacgtacgtaaggtacgtaggtaggtaaggtcggtacgtcggtacgggacgtagttacttttactttaccacctatacgagacgacggtctcgactacgaccgtaggaacgtactaagtacgaactaactattaacttacgtactacaatagtaatagtaacgtacgtccctccgtccttaccgtacgggttccggggtaccggggacgtaggtacggacgaactacgaagtacggtacgg

SEQ ID NO: 72739 - DNA, 586 bp, Homo sapiens
  misc_feature: GYAE6OF01BU8BH.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaactcaccatcacttgccgggcgagtcgagacattagcatgtatctgaattggtatcagaacaaaaccgaggaccacgacccctaaactcctacgactcctacgatcgcagtccctacgtttacggaaaccgtacggggtacccaagtacgtaacggttcaggtaggtaaggtgctcgtagggtaacgtagttacttttacttcaacctactcgacgtacgaggtctgcgacgtccgtagaacgtctaacgttacgactaacgtattaacgttactacgttacaacgtagtaactgtaacttacgtaccctcccgtcttaccgtacggtttcggggaccggggtacgaagggtacggagtacgtacgaaggtcgtaacgg

SEQ ID NO: 72740 - DNA, 736 bp, Homo sapiens
  misc_feature: GYAE6OF01EO8B0.52.32.C10.1.454.CMB.1.raw
  modified_base (234)..(234): a, c, t, g, unknown or other
  misc_feature (234)..(234): n is a, c, g, or t
  modified_base (284)..(284): a, c, t, g, unknown or other
  misc_feature (284)..(284): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtcctccatccctccctgtctgctatctataggagacagaactccacctatcacgttggccggngagtcgagactattagcctatgtatctagattggtatcagacaaaaccgnggacacgacccctaactcctgactcctcgtatcgacctactaccgtacgtttagggaaaccgtacggggttacccaagttaccgtaacggtttcaagggtagggtaacgttcgggcgttacggtacgggactaagggtttactttttacctttacccgtaacccttaagttaccgaacggtaccgtacgggtacccttaggacctaccggtccgtaaggtaaacgtacctaacgttacggaaccttaaacggttaatttaacgtttaaccgttacggttaaccctaaacggttaacgtttaacgtaggttaacccttacggttccccgttaccccggttacccgtttaccgggttaacccggggttttcgggggtaacccgggggggtaacctaaaccggggggttagtaaacggtaaccgttaccggtaaacgggtccgggttaaaccggg

SEQ ID NO: 72741 - DNA, 517 bp, Homo sapiens
  misc_feature: GYAE6OF01AMZ8Q.52.32.C10.1.454.CMB.1.raw
  modified_base (437)..(437): a, c, t, g, unknown or other
  misc_feature (437)..(437): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacacgacccctaaactcctgactcctcgatgcatccactttaggaaacacggggtcccatcaaggttcagtaggaagtggctcgtggggactagtattttacttcactatcagctaaggctgccagcctagaagacattacgacaacattattaacgtntacaactagtatagacttagtcctcccgtctccgtacgtttcgggacgggggtacaagggtggacgatcgaagcgtaacg

SEQ ID NO: 72742 - DNA, 571 bp, Homo sapiens
  misc_feature: GYAE6OF01DR18Z.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagatcaccatcacttgccgggcgagtcgagacattagctatgtatctagaattggtatcagacaaaaccgagggacacgaccctaactcctgatcctcgatgcactcctacgttacggaaacgacgggtacccagtacaaggttcacgtggtaagtcggctacgtggggactagttacttttaaccgttcaactatacagacgaggtctcgcctacgtacgtgaaacgtacgaatttacgaactaactaatttaacgttactacgttactaacgtagttactagtatacgtccgtacccgtcttaccggtacggtttcggggacccgggggtacgtaagggtacggacgtagaccgaaggcgtaacg

SEQ ID NO: 72743 - DNA, 605 bp, Homo sapiens
  misc_feature: GYAE6OF01AGUFT.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagatcaccatcacgttcgccgggcgagtcgagacattagcatgtatctgtaattggtatcaagacaaaaccgaggacacgtacccctaaactcctagactcctcgatcgactactacctaactttacgaaaccgtacgggtacccaattacgtaacggttcgagtacgggtaaggtggtccgtacggtacgggactaggttacttttaccttaccgactactacacggtccgtagggtctacggacgtacgtaccgtaggaactactacgttacgactaactattacttacgtagactaacgtagtatagtattaccgtcctacccgtcttaccggtaccggtttccgggggaaccggggtaaccgtaagggtcggaagtacgacgtaaagcgtaacgg

SEQ ID NO: 72744 - DNA, 404 bp, Homo sapiens
  misc_feature: GYAE6OF01EOTNN.52.32.C10.1.454.CMB.1.raw
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (399)..(404): a, c, t, g, unknown or other
  misc_feature (399)..(404): n is a, c, g, or t
tcagcgcagtacgacacgaccggtgctcgatttagtatagacatcaacacacaaagggcgagtcgagacattagcatgtatctgaattggtatcagcaaaaaaccagggacagccccctaaactcctgatcctcgatgcatccactttaggaaacaggggtcccatcaaggttcagtggaagtggctctgggacagtatttttacttcaccatcagcaggctgcagcctgaagactattgacaaacatattactgtacaacagtatgatagtcctcccgctctacgttcgggcgggggaccaagggtggaagatacaagcgaactgtggctgcaccatctgtctcntccttcccgctatctgatatacntcgctgagcgggctggcaaggcgacatagnnnnnn

SEQ ID NO: 72745 - DNA, 698 bp, Homo sapiens
  misc_feature: GYAE6OF01DB33R.52.32.C10.1.454.CMB.1.raw
  modified_base (156)..(156): a, c, t, g, unknown or other
  misc_feature (156)..(156): n is a, c, g, or t
  modified_base (208)..(208): a, c, t, g, unknown or other
  misc_feature (208)..(208): n is a, c, g, or t
  modified_base (221)..(221): a, c, t, g, unknown or other
  misc_feature (221)..(221): n is a, c, g, or t
  modified_base (341)..(341): a, c, t, g, unknown or other
  misc_feature (341)..(341): n is a, c, g, or t
  modified_base (641)..(641): a, c, t, g, unknown or other
  misc_feature (641)..(641): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcaggtgccagatgtntcatccagatcgacccagtcctaccactccctccctggtctgcattactaanaggagacagaacncaaccatcgtacgtggcccgggagaggtacgagactattaggatattagtatacgtaggtaagttcggtaatacaagaaccaaaaaccggaggaaccaccgtaacccctaaactccgtanactcccgtagatacgactactaccgtaagttaacgggaaaccgcgggtacctagtacgtaacggtgaggtaggaaggtcggtctcggtagggacttacggtttaacttttacgttacctacctagtaccgagtacgaggtcacggacctacgaccgtaagaacggtactagtacgactaaactatttaacgttaacgtacgtaaacctaagtaagtacgttaataacggttaccctacccgtaccccgtacgtttacccgggtaacgggtttcccggggggggaaccggggggtttaaanaaccgggggttaggaaaccggttaataacccgggtaaaacgggtcgttaaaccgggg

SEQ ID NO: 72746 - DNA, 698 bp, Homo sapiens
  misc_feature: GYAE6OF01ERF4S.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacgttcggccgggacgagtacgagactattagctatgtatctagtaagttggtatacgaacgaaccaaaaaccgacggggaaccaaccggtaacccccttaaactccgtagactccgtacgtactcgacctacttacccgtaacgttttaacggaaaaccggtaccggggtaccctaagtaccgtaagggttacgtaagggtagggtaacggtcggtaccgttacggtacggggtaacgttaaggtttaacttttttacccgtttaccgaacccttaacgttaccgaacggtacgtacggtcgtacggtaccgacgtaccgtagaacgtactagtacgactaactattacttactacgtacaacgtagttactagtaacgttacgtaccgttcccgtaccgttacgttacgggtttccgggggaccggggggtaaccgtaaggggtacggtagtaaacgtccggtaaaggtccgtaaacggg

SEQ ID NO: 72747 - DNA, 728 bp, Homo sapiens
  misc_feature: GYAE6OF01DVWJM.52.32.C10.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcacttggccggngacgtcgagacattagcatgtatctagaattggtatcagacgaaaaaccgagggacacgtacccctaaactcctagtactcctcgaattgctactccgtaacgttttacgggaaaacgtaccggggttaccctaacgtacgtaaggttcgaagggttacgggtaaaggtcgggtctacgggttacgggaacttaacggttaactttttaccgtttacaaccctacgttaccacggaacgtaggtcctaggtaccaaggtccccttaaggaaacgtactaacgttcgaactaaacttacgttaactttaaccgtcgttaacgtaaacgtaggttaacttaggtaacgttaccggttacccgtacccccggtacgtttacccgttaaacccgggggtttttcccggggggaaaccccgggggggggttaaacctaaacggggggttaacgggtaaacccggtaaaggttaacccggaaacggggttacccgttaaaaccgggg

SEQ ID NO: 72748 - DNA, 421 bp, Homo sapiens
  misc_feature: GYAE6OF01DOR70.52.32.C10.1.454.CMB.1.raw
  modified_base (259)..(259): a, c, t, g, unknown or other
  misc_feature (259)..(259): n is a, c, g, or t
  modified_base (347)..(347): a, c, t, g, unknown or other
  misc_feature (347)..(347): n is a, c, g, or t
  modified_base (407)..(421): a, c, t, g, unknown or other
  misc_feature (407)..(421): n is a, c, g, or t
tcagcgcagtacgacacgaccggtgctcgatttagtatagacatcaacacacaaagggcgagtcgagacattagcatgtatctgaattggtatcagcaaaaccagggacagcccctaaactcctgatcctcgatgcatccactttggaaacaggggtcccatcaaggttcagtggaagtggctctgggacagattttacttcaccatcagcaggctgcagcctgaagacattgcaacattattactgtacaacagtatntatagtcctcccgctcacttttcgggcggggggaccaaggtcggagatcaaggcgaactgtggctgcacatctgtcttcatcctcccncgatcctgtatactacgctcgcgttgaacgcgggtctgggacctaagggcgacattaggnnnnnnnnnnnnnnn

SEQ ID NO: 72749 - DNA, 674 bp, Homo sapiens
  misc_feature: GYAE6OF01B8FKZ.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcaggtgccagatgtgtcatccagatcgacccagtcctccacttccctccctgtctgctatctagtaggagaacagaactccaaccatcacgttcggccgggcgagtacgaagactattagctattgtatcgtagtaattggtactacgaagaaaccaaaaacggacggtaaccaaccgtaacccctaaaactccgtagtactccgtacgacgtcgactaactaccgtaacgttaacggaaccggtacggtaccctagtacgtaaggttcgaggtacggagtcggtacgtacggtagggaacttagtttacgttttaccttacgaacctatacgagtaccgtaggctacggacgacgtaccgaaggtaacgacttacgttaacgaactaaacttattaacgttaacgtactaaccgtaactagtacgtagtaccgttacgttccctacccgtaccgttacgggttaaccggggttccgggggaacccggggtaacgtaaggggtcgaacgtacgaacgaacggacgttaacggg

SEQ ID NO: 72750 - DNA, 758 bp, Homo sapiens
  misc_feature: GYAE6OF01CXEZW.52.32.C10.1.454.CMB.1.raw
  modified_base (237)..(237): a, c, t, g, unknown or other
  misc_feature (237)..(237): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccatccctccctgtcctgctatctataggagacagaactccaccatcacttcggccgggngagtcgaagactattagctatgtatctagtattggtatacgaagaaccaaaaccgagggaaccaaccgtacccctaaactccgtagacctccgtacgatcgacctacttaccgtaacgtttacggaaaccgtcgggttacccaagttacgaaacggtttcgaacgggttagggtaaacggttcggtaccgttacggtacgggggtaaccttacggtttaaccttttttaaccgttacccgaacctacgttaccgaacgtaccgtacgggtacctcgggaccttacgaccgttaaggaaacgtacccgttaagttaccgaaccgtaaacgtttaacgtttaacgtttaaccgttacgtaaacccctaaagtaggttaaacttaacggtaaactttaaacccgtcccgtttaccccggtaccgtttaaccggtttaacccggtttacgggggaacccggggttaaccgggtaaaccgggtaagggttacgggaaggttacctaacgggtaacgggtaaaccgg

SEQ ID NO: 72751 - DNA, 566 bp, Homo sapiens
  misc_feature: GYAE6OF01D1SIB.52.32.C10.1.454.CMB.1.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacgttgccgggngagtcgagacattagcatgtatctgaattggtatcagacaaaaaccgaggacacgacccctaactcctagactcctacgatcgacactacctacgtttaggaaacgtcgggtacctatacgaaggttcagtgaagtgctcgtggactagttactttactacactatcagcgagtctagcagtcagaacgtacattacgaactaactacttatttacgtacgtacaacgtagttaactagtaattccgttaccgtacccgtcgttaacccgttacgggtttaccggggaccgggggtaacctaagggttacggacgtacgtacgaaggtccgtaacgg

SEQ ID NO: 72752 - DNA, 719 bp, Homo sapiens
  misc_feature: GYAE6OF01DRZQR.52.32.C10.1.454.CMB.1.raw
  modified_base (226)..(226): a, c, t, g, unknown or other
  misc_feature (226)..(226): n is a, c, g, or t
  modified_base (276)..(276): a, c, t, g, unknown or other
  misc_feature (276)..(276): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgcggngagtcgagacattagcatgtatctagaattggtatcaagacaaaaaccgngggacaacgcccctaaactcctagactcctcgacttcgctaactcctaacgttttagggaaaaccgtcggggtaccctaagttacgtaaacgggtttccaaagggtacgggtaaacggttcgggtaccgttacggtacgggggtaactaagggtttacctttttttaaaccgttttaccgaaacccgttaagttacccgaaacggtaccgtacgggttaccgttacggaaccgtaaccggtacccgttaacgggaaacgttaaccgtagtttacggaaccttaacgtaatttaacgtttacttacggtaacaacgtagttaacgtaggaacttaccgtaccttaccccggtacttaccggttaccggtttccgggggaacccggggggtaaacctaaagggggttcggaaacgtacgtaacgtaacggtaccggtaaaccggg

SEQ ID NO: 72753 - DNA, 578 bp, Homo sapiens
  misc_feature: GYAE6OF01BZVGI.52.32.C10.1.454.CMB.1.raw
  modified_base (229)..(229): a, c, t, g, unknown or other
  misc_feature (229)..(229): n is a, c, g, or t
  modified_base (325)..(325): a, c, t, g, unknown or other
  misc_feature (325)..(325): n is a, c, g, or t
  modified_base (394)..(394): a, c, t, g, unknown or other
  misc_feature (394)..(394): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctccctgtctgcatctataggagacagaatcacatcacttgccgggnagtcgagacattagcatgtatctgaattggtatcagacaaaaaccgagggacaacgacccctaaactctgatcctcgatgcatcacttaggaaacngggtacccagtactaagtcgagtggaagtggctcgtagggacagtattttacttacacatcagcacggntcgcagtacctagaagtacagttcgactaacgtaattaattactagtacaaacgtagtaataggtaattaccgtaccttcccggtacttacccggtaaacggttttcccggggggaccgggggggtaaacccgtaaaggggtaccgggtaagaaacgttaccgtaaagggaccgtaaaaccggg

SEQ ID NO: 72754 - DNA, 718 bp, Homo sapiens
  misc_feature: GYAE6OF01BV5UH.52.32.C10.1.454.CMB.1.raw
  modified_base (211)..(211): a, c, t, g, unknown or other
  misc_feature (211)..(211): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccactccctccctgtctgactatctaagtagganacagaactccacctatcacgtcggccggagagtcgagactattagctatagtatctagtaattggtatacgaagaaccaaaaaccgacggaccaaccgtaacccctaaactccgtagtacctccgtacgatacgcctactaccgtaacgtttacggaaacgtaccgggacctacgtacgtaacgttcgaaggtagggtagtggtctacggtacgggtaactagtttacttttaacctaccaacttacgtacgacgtacgtacggtctcgtacgtacgtaccgtaaggaacgtaacgttacgtaacgtaacctaaacgttaactttaacgttaaccgttacgtaactaaacggtagttaacgtaacgttaacgttcccgttacccgtaccccgttacggttacccggtttaacccggggtttaccggggggaaacccgggggttaaccgttaaacgggggtacggtaacgttaacggtaaccggtaaacggtaacccggttaaccggg

SEQ ID NO: 72755 - DNA, 646 bp, Homo sapiens
  misc_feature: GYAE6OF01CGV0W.52.32.C10.1.454.CMB.1.raw
  modified_base (229)..(229): a, c, t, g, unknown or other
  misc_feature (229)..(229): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacgttgccgggngagtcgagacattagctatgtatctagattgtatcaagacaaaaccgagggacacgacccctaaactcctagacttcctcgtactgactactacctacgtttacggaaacgtacgggtacccaagtacgtaaggttccgaggtaggaaggttacggtactacggtagggtaactaggttactttttaccgttacctacctagttacacgtaccgtagggtacttacggaccgtacgacccgttaggaaacgaccttaaagttcggaaacctaaactacgtttaacttttacgtacgtaacgtaaactagttaacgtcgttaagtaccgttaccctcccgttaccttacggtaccggtttccgggggaccgggggtaacgtagggtacggaatacgtaacgacggtacggttaacggg

SEQ ID NO: 72756 - DNA, 758 bp, Homo sapiens
  misc_feature: GYAE6OF01C731R.52.32.C10.1.454.CMB.1.raw
  modified_base (230)..(230): a, c, t, g, unknown or other
  misc_feature (230)..(230): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttggccgggngagtcgagacattagcatgtatctagtattggtatacgaagaaccaaaaaccgagggaccaaccgtacccccttaaactccctagtactacccgtacgtactcgacctacttccctaacgtttacgggaaaacgtcggggttaccctaagttaccgtaacgggtttaccgaagggttacgggaaacggttcgggtacccgttacgggttaacgggggaacctttaacggttttaacctttttttaaaccccgtttacccgaaacccgttaacgtttaccggaaacggtaccgtaacggggtccttacgggacccgtaacggtaccccgttaaggtaaacgtaaccgttagtttaccgaaccttaaacgtattttaaccttaacgtacggttaacctaacggttagttaacttaggtaaccgttaccgttaccccgtacccgttaccgttacccggttaccggggtttaccggggggacccgggggtaacctaaggggtacgaacgtacgtaacgaggtacgttaacgg

SEQ ID NO: 72757 - DNA, 633 bp, Homo sapiens
  misc_feature: GYAE6OF01BNJL6.52.32.C10.1.454.CMB.1.raw
  modified_base (237)..(237): a, c, t, g, unknown or other
  misc_feature (237)..(237): n is a, c, g, or t
  modified_base (263)..(263): a, c, t, g, unknown or other
  misc_feature (263)..(263): n is a, c, g, or t
  modified_base (542)..(542): a, c, t, g, unknown or other
  misc_feature (542)..(542): n is a, c, g, or t
  modified_base (549)..(549): a, c, t, g, unknown or other
  misc_feature (549)..(549): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccactccctccctgtctagcatctagtaggagacagaactccaccatcacgttggccggngagtcgagactattagctatgtactntagtattggtatacaagaacaaaacgacggaccacgtaccctaaactcgtacgactccgtagatcgctaacctacttacgttacgggaaactaccgggtaccaagtacggtaaggttacgtaagggtacggaaggttcggcttaggttaccgggtaattacggtttactttttaaccgtacctaacgtcgttaacacggtacgaggtcgtacgaccgtacgacctaggaacgttacaagttacgaactaaccgttattaacctacgacgtacaaccgtntaacgtntacgtacgttcccacgtccgttacgttacgggttccgggggacggtaaggtacgtacgggaactacgaacgcggtacggtaacg

SEQ ID NO: 72758 - DNA, 877 bp, Homo sapiens
  misc_feature: GYAE6OF01DISVP.52.32.C10.1.454.CMB.1.raw
  modified_base (145)..(145): a, c, t, g, unknown or other
  misc_feature (145)..(145): n is a, c, g, or t
  modified_base (171)..(171): a, c, t, g, unknown or other
  misc_feature (171)..(171): n is a, c, g, or t
  modified_base (205)..(205): a, c, t, g, unknown or other
  misc_feature (205)..(205): n is a, c, g, or t
tcagcgcagtacgacacgaccggtgctcgatttagtatagacatcaacacacaaagggggcaggagtcagtcccaacaggacacagcatggacatgagggtccctgctcagctcctggggctcctgctgctctggctctcaggtnccagatgtgtcatccagatcgacccngtctccatcctccctgtcctgcatctagtagganacagaactccaacctaagtccacgttggaccccggggacgtagttccggaagactaagttaggcctaatgttaatcgtagtaagtttggtaataccaagaacgaaaaaccgaggggaaccacggtaacccccttaaaactccgttacgaaccttcccgtacgaagtccgtactaacgttacccttaaaccggtttaagggaaaaccgtaccgggggttaccccaaaggttaccgtaaacgggtttcccgaaagggttaacggggtaacggttacgggtccttaaccgggttaggggaacccgttagtttaaacggtttttaaccttttaccgtaaacccttaacgttaccggttaaacggaccgtaaccgggtaccgttacggtaccgtaacgggttacccgtttacgggaaactaaccgtaagtttaaccgggtacaaaaccgttaacgtttaactttaaccggttaccttaaacccgttaaacgttaacggttaaacttacgggtaaacgttaaccggttacccgtaccccccggttaccgtttacccggttaaccggggttttccccgggggtaaaccggggggggttaacccccgtaaaacgggggttaccggggtaaacgggtaacgtttaaacccgggaaaccgggttaaccggttaaacccgggg

SEQ ID NO: 72759 - DNA, 516 bp, Homo sapiens
  misc_feature: GYAE6OF01AUDQ9.52.32.C10.1.454.CMB.1.raw
  modified_base (227)..(227): a, c, t, g, unknown or other
  misc_feature (227)..(227): n is a, c, g, or t
  modified_base (274)..(274): a, c, t, g, unknown or other
  misc_feature (274)..(274): n is a, c, g, or t
  modified_base (417)..(417): a, c, t, g, unknown or other
  misc_feature (417)..(417): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgaattggtatcagacaaaaaccngggaacagtacccctaaactcctagactcctcgatgcatccaactttagggaaacaggggtcccagtacaaggttcagtggaagtggctcgtgggactagtacttttacttcactatacagtcaggctgcagtcctagaacanattgacaatatacttactagtcaacgatatgatacgtctcccgtctcgtacggtttccgggacgggggtaccaagggtcggagatcgtaagcgtaacgg

SEQ ID NO: 72760 - DNA, 582 bp, Homo sapiens
  misc_feature: GYAE6OF01CPD3O.52.32.C10.1.454.CMB.1.raw
  modified_base (178)..(178): a, c, t, g, unknown or other
  misc_feature (178)..(178): n is a, c, g, or t
  modified_base (254)..(254): a, c, t, g, unknown or other
  misc_feature (254)..(254): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
  modified_base (493)..(493): a, c, t, g, unknown or other
  misc_feature (493)..(493): n is a, c, g, or t
  modified_base (506)..(506): a, c, t, g, unknown or other
  misc_feature (506)..(506): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctgctcgtggctctcgaggtcgccagatgtgtcactccagatcgaacccngtcctcacttccctcctgtctgctatacgtagtaggagacagactccacagtcacgtcggccggacgagtcggaanactattacgctagttagtatctagtaagttgtatacacgaaaccgaaaaccggcggtaaccaaccgtaaccctaaaccgtcgtacgtacttaccgaggtactacgacttacttaccgtagttaacgggaacgtcggtaccagtacgtaggtctaggcggtagtgaccgtggtagattagtttactttctacactancgagtcgngtcagcganctagacactgacaactaatcgtactnacgtacaggtacntacgtatcctacgccgtgttactaccggggttcggggccggaaactgggcgtaacggacctacgggtgtagtcggg

SEQ ID NO: 72761 - DNA, 681 bp, Homo sapiens
  misc_feature: GYAE6OF01BL8UY.52.32.C10.1.454.CMB.1.raw
  modified_base (205)..(205): a, c, t, g, unknown or other
  misc_feature (205)..(205): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatcctccctgtctgcatctagtagganacagaactccaccatcacttcggccgggtcgacgtcgagacattagactatgtatctagtattggtatcaagaacaaaaccgaggacacgtaccctaactcctagactcctacgatcgacctactacctaacgttaacggaaaccggtacgggtaccctaagtaccggtaaggttcgaagggtaggaaggtcggacttcggtacgggtaactagtttaactttttaccttaccaaccgttactacgaacgtcgtaacgggtcctacggacgtacggacccgtaagaaacgtacgtaagttacaaccgtaacttaacgttacgtttaacctaggtaactaacgtaagttacgtacggtaacttaccggttccctaccccggtacgttacccggttaccggggtttccgggggaacccggggtaacggttaacggggtacggtaacgtaacggttacgaaacgggttcgtaaaccggg

SEQ ID NO: 72762 - DNA, 666 bp, Homo sapiens
  misc_feature: GYAE6OF01CY7NN.52.32.C10.1.454.CMB.1.raw
  modified_base (182)..(182): a, c, t, g, unknown or other
  misc_feature (182)..(182): n is a, c, g, or t
  modified_base (197)..(197): a, c, t, g, unknown or other
  misc_feature (197)..(197): n is a, c, g, or t
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (263)..(263): a, c, t, g, unknown or other
  misc_feature (263)..(263): n is a, c, g, or t
  modified_base (286)..(286): a, c, t, g, unknown or other
  misc_feature (286)..(286): n is a, c, g, or t
  modified_base (333)..(333): a, c, t, g, unknown or other
  misc_feature (333)..(333): n is a, c, g, or t
tcagcgcagtacgacacgaccggtgctcgatttagtatagacatcaacacacaaagggggcaggagtcagtcccaaccaggacacagcatggacatgagggtccctgctcagctccgtgggctcctgctgctctggctctcgaggtcgccagatgtgtcatccagatcgacccagtcctccnctccctccctgtctncatctaagagganaacataactccaacctatcacgttcggaccgggngagtacgaagtacattagntatgtatatagtaagtggttaanacgaacgaaccaaaaaccgcggaacaccgtaaccctaaactccgtanacgtctacgtatacactacgtaaccgtacgttaacgggaacgtacgggtaccctaagttacgtaacggttacgaaggtagggtaaagtcggtacgtaccggtagggtaaccttaagttttactttaccttacaacttagacgtaacgcgtaaggtcctacgacgttaacgccgtaagaaacggtctaacgtaacgaactaaacgttctaacggtttacacggtaaactaactaaggttactaacggtactaacccggttcctacccggttctaacgggttcccggttcgggggaacgggtactaagggacgtagacgtacgagtaacgtcggg

SEQ ID NO: 72763 - DNA, 480 bp, Homo sapiens
  misc_feature: GYAE6OF01CHOW6.52.32.C10.1.454.CMB.1.raw
  modified_base (468)..(480): a, c, t, g, unknown or other
  misc_feature (468)..(480): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggccctggacgagatttacttttctaccactacagcaggcgtcgcacgcctcgaagaacaattgtcaaccaatattactgtctaaccaagtatgtataagtctccctccgtctaccgtttccggtcgggggggacccggaacggtaggaggatacgaacgacggaaccgtagtggcgtcgcgaccactactcggtcctttctaactcttccccgtcccactctcgtagtaataacgatacgtcgtacgtaggacggggcgttggacgaaacgggtcgacctaataggnnnnnnnnnnnnn

SEQ ID NO: 72764 - DNA, 632 bp, Homo sapiens
  misc_feature: GYAE6OF01ALM79.52.32.C10.1.454.CMB.1.raw
  modified_base (205)..(205): a, c, t, g, unknown or other
  misc_feature (205)..(205): n is a, c, g, or t
  modified_base (299)..(299): a, c, t, g, unknown or other
  misc_feature (299)..(299): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccactcctcctgtctgcatctagtagganacagaactccaacctatccacgttcggccggggcgacggtcgaagactattacgctatgtatctagtaattggtatacgacgaaccaaaacggnggaaccaccgtacccctaactcctagtactcctagatcgactactacgtacgttaaggaaccgtcggtacctagtacgtaaggttacgaggtaggtaacggtcggtacgtacggtacggtaactacgtttacttttaccgtactacctacgtacgacgtcgtacggtccgtcgacgtacgtcgtacgaacgtactagttaccgaacttaacgtattaacgttactacgtaacaacgtacgttatacgttacttaccgtcctacccgtcgttacgttaccggggttcgggaccggggtaactacgggtacgagtacgtaacgtaggtcgtacgg

SEQ ID NO: 72765 - DNA, 569 bp, Homo sapiens
  misc_feature: GYAE6OF01DWWN9.52.32.C10.1.454.CMB.1.raw
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctagaattggtatcaagacaaaaacgngggacacgacccctaaactcctagactcctcgatgcatcctaacgtttacgggaaaccgacggggtcccaattacgaacggttacaggtaggaaggtcggcttacgtaggggaactagtactttttacttacgtaacctatcaagcgaggctgcagtcctagaatactattcgacaactattacttactgtacaacagtagtagtatacgtcctcccgtcttacgtacggtttccggggaccggggggtaactaacggggtacggaagtacgtaacgtacggacgtaaacgg

SEQ ID NO: 72766 - DNA, 694 bp, Homo sapiens
  misc_feature: GYAE6OF01CMQ13.52.32.C10.1.454.CMB.1.raw
  modified_base (302)..(302): a, c, t, g, unknown or other
  misc_feature (302)..(302): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccactccctcctgtctagctagtctaagtaggagacagaactcactatcacgttggccgggagagtcgagactattagctattgtactacgtagtaattggtactacgaaacgaaccaaaaccgnggaaccaaccgtaccctaaactcctagtacctccgtacgatcgctacgtacctagttaacggaacgtccggtaccaagtcgtaaggttacgacggtaggtaacgtggtaccgtaggtacgggtaacttacggttttacttttacctaacgacctaacgttcgaacgtcgtaggtcctacggacgtacgacctaaggaactatacgttagaaccttaaacgttactttaacgttaccgttactaaccgtaaagttaacggttactacggtaacgttacccggttccctaaccccggttcgttaacccgggtttaaccgggtccggggggaacccggggtaaacgtaaggggtacgtaacggaaccgtaacgggaaccggtacggttaaccggg

SEQ ID NO: 72767 - DNA, 738 bp, Homo sapiens
  misc_feature: GYAE6OF01AB8IT.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctagaattggtatcagaccaaaaccgagggacacgacccctaaactcctagactcctcgatcgcactcctaacgtttacggaaacgtacggggtaccctaagttaccgtaaaggtttacgtaacggttacgggtaaaggttcgggtaccgttacggtagggggtaacccttaggttaacctttttttaaccgtttaccgaacccgttaagtttaccgaacggtaccgaagggtacccttacgggaccgtaacggtaccccgttaaggtaaaccggtacctaagttttaaccggaacctaaaccttaacgtttaacgttttaaacccgtacggtttaaccctaaacgttaacggttaacgttacggtaacgtttaaaccggtcccgttaccccggttacgtttacccgttaacgggtttcccgggggaaccggggggtaaccctaagggggttacggaacgtacgtaaccggaaaggtcggtaaaccgg

SEQ ID NO: 72768 - DNA, 394 bp, Homo sapiens
  misc_feature: GYAE6OF01A0AJL.52.32.C10.1.454.CMB.1.raw
  modified_base (385)..(394): a, c, t, g, unknown or other
  misc_feature (385)..(394): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtggctgcaccatctgtcttcatcttcccgcatctgatatacgatcgctgagcgggctggcaaggcgcagtagnnnnnnnnnn

SEQ ID NO: 72769 - DNA, 714 bp, Homo sapiens
  misc_feature: GYAE6OF01CR5SC.52.32.C10.1.454.CMB.1.raw
  modified_base (244)..(244): a, c, t, g, unknown or other
  misc_feature (244)..(244): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcaggtgccagatgtgtcatccagatcgacccagtcctccactcctccctgtctgcctattctaataggacacagtaactcaacctatcacgttcggaccgggntacgtcgaagactagttagctatcgtatcgtagtaagttggtactacgaacgaacgtaaaaccgagggaaccaccgtacccctaaactcctagtacccttccgtagactcgacctactaccgtaagtttaccgggaaacctacggggtacccagttaacaacggtttacaggtttacggaaggttcgtacgtacgtagggtaaccttagtttaccttttaacctactaacctacgtcgtaacgtcgtaacgggctacggtaccgaacgtccggttaagaacgtaaccttacgttacgaacctaagttactttaaccgttacgttacgtaaactaacggttaacgttaagtctaaaccgttcccgtacccgtacccgttccgttaacgttaccccgggggtttaaggggacccggggtaaaccgttaggggtacttaaacggaccttaacgaccgggtacgttaacccggg

SEQ ID NO: 72770 - DNA, 624 bp, Homo sapiens
  misc_feature: GYAE6OF01CBHP9.52.32.C10.1.454.CMB.1.raw
  modified_base (229)..(229): a, c, t, g, unknown or other
  misc_feature (229)..(229): n is a, c, g, or t
  modified_base (273)..(273): a, c, t, g, unknown or other
  misc_feature (273)..(273): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacgttgccgggngagtcgagacattagcatgtatctgattggatcagacaaaacgnggacacgaccctaaactcctagactcctcgatcgctactcctaacgtttacgggaaaccgtacggggtacccaagtaccgtaacggtttcaggttagggtaaacggttcggcgttacgtaggggtactaggtttaactttttaccgtttctaacctattacgacggtctagggtcctgacctacgcctaggaacgtataagttcgaactaactattaacttacgtacgtacctaagtagtaactgtaagttacgtccgttacccgtccttaccggtaccggttttccgggggacccgggggtaaccgtaacgggtcgggtaagtacgtaaccgtaacggtacggtaacggg

SEQ ID NO: 72771 - DNA, 642 bp, Homo sapiens
  misc_feature: GYAE6OF01CZOVN.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagaacagatcaccatcacttgccgggcgagtcgaagacattagcatgtatctgtaattggtatcaagaacaaaaaccgagggaaccaacggtacccctaaaactccctagactaccgtacgatagctaacttcctaacgtttagggaaaacgtacggggtcccaataccgtaaggtttaccaggttaggaaggttcggtacgtacgtggggaacctaagtacgttttttacctttacaaccctatacgaaggtaccaaggtctggaccgacgtcctaggaaacgtactagttacgaactaacctaattaacttactagttaacaaacgtataatacggtaactacgttaccctacccggtcttaccgtaccggttttaccggggaccgggggggtaaacaaggggttacggaaggtacgaacgtaaacgggccgtaaacgg

SEQ ID NO: 72772 - DNA, 796 bp, Homo sapiens
  misc_feature: GYAE6OF01B1KTW.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccatcctccctgtctgcatctataggagacagaactcaccatcacgttcgccgggcgagtcgagacattagcatgtatctgtaattggtatcagacaaaaaccgaggacacgaccctaaactcctagactcctcgatcgcactcctaacgttacggaaacgtacggggtacccaacgttacgtaaaggtttccgaagggttacgggtaaacgggttcgggtaccgttaccgggttaacggggtaaccgttaaggttttaaccgtttttttaaccgttttacccgaacccgttaacgttaccgtaacggtaccgtaacgggtccttacgggacccgtaacggtacccgttaacggaaacggtaacccttaacgttttaacggaacccttaaaacgtaaacttttaaccgtttaaaccgttacgtttaaccgaaaacgttacggttaaacgttacggttaaaccgtttaccggtaccccgtttacccccggtaccctttaccgggtttaaccccgggtttcccgggggggtaaacccggggggtaaacccggttaaacgggggttacgggaaacgggtaacggttaaacccgggtaaacgggtaacccggttaaaccgggg

SEQ ID NO: 72773 - DNA, 704 bp, Homo sapiens
  misc_feature: GYAE6OF01DR81E.52.32.C10.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (649)..(649): a, c, t, g, unknown or other
  misc_feature (649)..(649): n is a, c, g, or t
  modified_base (688)..(688): a, c, t, g, unknown or other
  misc_feature (688)..(688): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtcctccatccctccctgtctgcatctatagganacagaatccaccatcacgttgccggngagtcgaagacattagcatgtatctgtaattggtatcaagaacaaaaaccgagggaccaacggaccccctaaactcctagtaacctcctacgtaactcgacctaacttacccctaacggttttacgggaaaaaccgtacgggggttacccctaaagttaccgtaaacgggtttaccgaagggttacggggaaagttcggggaccgtttaccggttacggggggtaaccttaagggttttaaccctttttttaacccgtttaccgtaaccccctaagtttaccgaacggtaccgtaccgggtacttacgggcccgtaacggtcccgtttaacgggaaaatacccgtagtttaccgaacgtaacttaacgtttaacttaccgtataactaactaggtatagtattaccgtcctacccgtntacggtaccggttcgggacggggaaccagggtgaacgtntaaccgagtcgtaacg

SEQ ID NO: 72774 - DNA, 700 bp, Homo sapiens
  misc_feature: GYAE6OF01BSPIK.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatcctccctgtctgcatctataggagacagaactcaccatcacttcggccggcgagtcgagacattagcatgtatctagtaattggtatcaacgaacaaaaccgagggacacgtaccctaaactcctgactcctcgtactcgacctacttacctaacgtttacgggaaaccgacgggtaccctacgtacgtaacggttacgtagggtaggtaacggtcggtaccgtacggtacggggtaacttaacgtttaactttttaacctttaccgaacccttagtaccgaacggtaccgtaacgggcctacggaccgtacggtacccgtaaggaaacgtaaccgttagttaacgaactaaacgttaagtttaaccgtttacgttacggttaactaaaccgtaggttaactaggtaaccgtttacgtaccccgttcccgtacgttacccggttacggggtttacccgggggaccggggggtaactaacggggtacggtacgaacgtacggtaacggtaccggttaacgg

SEQ ID NO: 72775 - DNA, 760 bp, Homo sapiens
  misc_feature: GYAE6OF01DZY42.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcaggtgccagatgtgtcatccagatcgacccagtcctccacttccctccctgtctgctatctataggagacagaatcacctatcacgttggccgggacgagtcgaagactattagctatgtatctagtaattggtatacaagaaccaaaaaccgacgggaacaaccgtacccctaaactccgtagtactccgtacgatcgacctactacctaagttaacggaaacgtacgggtaccctaagttaccgtaaacggttcgaagggtaggtaaacggttcggtaccgttacgggtacgggtaaccgttaaggttttaaccttttttaaccgttacccgtaaacctaacgttcgaacggtaccggtacggtacgttcggaccgtaacgtcccgtaaaggtaagttaacttaagttacggaactaaacgttaattttaacgtttaacgttacggtaaactaacgttaagttaagttaacggtaacctttcccggttacccgtaccccggttccggtttaaacccggtttaaccccgggggtttaccggggggaacccggggggttaaaccttaaagggggtccggtaaaaggtaccgttaaacggaaacgggttacgtaacggg

SEQ ID NO: 72776 - DNA, 651 bp, Homo sapiens
  misc_feature: GYAE6OF01D0WK7.52.32.C10.1.454.CMB.1.raw
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctcctgtctgctatctatagganacagaatcacatcacgtgccgggngagtcgagactagttagctatgtattcgtagtaagttggtaatacgaacgaaacccgaaaaaccggacgggaaccaacccgtaaccccttaaacctcctagtactcctacggactcgacctaacgtaccgttaacggtttaacgggaaaccgtaccggggtacctaacgtaccgtaaggttcgaaggtggtaacggtcggtacgttcggtaagggtaacttagtttacgttttaacctcaacctagtacgacgcgacgctcgcgtacgtacgtaagtacgatacgtacgaactaattaacttagttacctaggtaaccaagttagtactgtaacgttccgtccgtcccggttactacccggttaccgggtttcggggaaccgggtacgaagggtacgagtaacgtaccggaagtcggtaacg

SEQ ID NO: 72777 - DNA, 457 bp, Homo sapiens
  misc_feature: GYAE6OF01CK12E.52.32.C10.1.454.CMB.1.raw
  modified_base (185)..(185): a, c, t, g, unknown or other
  misc_feature (185)..(185): n is a, c, g, or t
  modified_base (242)..(242): a, c, t, g, unknown or other
  misc_feature (242)..(242): n is a, c, g, or t
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
  modified_base (429)..(457): a, c, t, g, unknown or other
  misc_feature (429)..(457): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctntgggacagtatttttacttcaccatcagcaggctgcagcctgaagacattgcaaacnttatactgtacaacagtatgatagtctcccgctctagtttcggggcggggggacctaagggtgagactcaagcgaatgtggctgaccacatcttgtcttacgacttccgttccccgacctacttcctagtatactacgtatccgtctggaggccgggntacgggactaacgggcgactagtagntgnnnnnnnnnnnnnnnnnnnnnnnnnnnnn

SEQ ID NO: 72778 - DNA, 543 bp, Homo sapiens
  misc_feature: GYAE6OF01AL5YG.52.32.C10.1.454.CMB.1.raw
  modified_base (289)..(289): a, c, t, g, unknown or other
  misc_feature (289)..(289): n is a, c, g, or t
  modified_base (460)..(460): a, c, t, g, unknown or other
  misc_feature (460)..(460): n is a, c, g, or t
  modified_base (504)..(504): a, c, t, g, unknown or other
  misc_feature (504)..(504): n is a, c, g, or t
  modified_base (506)..(543): a, c, t, g, unknown or other
  misc_feature (506)..(543): n is a, c, g, or t
tcagcgcagtacgacacgaccggtgctcgatttagtatagacatcaacacacaaaagggcgagtcgagacattagcatgtatctgaattggtatcagacaaaaaccaggggacagcccctaaactcctgatcctcgatgcatcccactttggaaacaggggtcccatcaaggttcagtggaagtggctcgtgggacagtattttacttcaccatcagcaggctgcagcctagaagacctagttcgacaactattaacgttactgtaccaacgtagtatgattacgtccncccgtctcgtaccggtttcggggaccgggggaaccaaggggtgaagacgtacgtaacggccggtaacgtggtcggtaccttggccctaaccgtattccgttcgtttaccttacgacctttacccgtcccccgtactaacgtcttaggaacttaccgttaccgtgtacccgngtagggacgggtccggacggttggaccgaagggtcacgtagtgncnnnnnnnnnnnnnnnnnnnnnnnnnnnnnnnnnnnnnn

SEQ ID NO: 72779 - DNA, 546 bp, Homo sapiens
  misc_feature: GYAE6OF01CCDOK.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctagtattggtatcagacaaaaccgagggacacgacccctaaactcctagactcctcgatcgcatcctaacgtttacggaaacgtacgggtcccagtcgtaaggttcagtaggagtggctgtgggactagttattttacttcactatcagcaggctgcagtccgtagaacgactattagactaactattacgttactagtacaacgtagtatagtacttacgtcctcccgtcttacgtaccggtttcggggaccgggggtaaccgtagggtcggagtaagtcgaaggtcgtaacgg

SEQ ID NO: 72780 - DNA, 723 bp, Homo sapiens
  misc_feature: GYAE6OF01CY44K.52.32.C10.1.454.CMB.1.raw
  modified_base (209)..(209): a, c, t, g, unknown or other
  misc_feature (209)..(209): n is a, c, g, or t
  modified_base (268)..(268): a, c, t, g, unknown or other
  misc_feature (268)..(268): n is a, c, g, or t
  modified_base (697)..(697): a, c, t, g, unknown or other
  misc_feature (697)..(697): n is a, c, g, or t
  modified_base (714)..(714): a, c, t, g, unknown or other
  misc_feature (714)..(714): n is a, c, g, or t
tcagcgcagtacgacacgaccggtgctcgatttagtatagacatcaacacacaaagggggcaggagtcagtcccaaccaggacacagcatggacatgagggtccctgctcagctccgtgggctcctgctgctctggctctcaggtcgccagtatgtgtcatccagatcgacccagtctccattccctcctgtctgctatctagtagganacagaactccaacctatccgacgttcggccggggacgtaacgtcgaagtactagttaanctataggtatctaggtaattcggtataccgaacgaaaccaaaaaccggaggaccctaaccgtaacccccttaaatccgtaacgtactccgttacggaattccgacttaaccttccgttaaacgttaccgggaaaacggtccggttaccctaagttaacccgggtaaagttcgtaaagggtagggtaacgttcggtactgggttaacgggacttaacgtttacttttaccttacaacctagttacgaacgcggtagtcgacgtactacgaccgttagaacgttacgtataaccgaccttaatacgtttacttaaccgaggttaacaaacgttgtaactacgttaacgtccgttaccccgaccgtttcgttacccggggacggttttacccggggggggaccggaaacgttacgggttacggacgttaacnccggggttaaaaccggnggttaaccg

SEQ ID NO: 72781 - DNA, 686 bp, Homo sapiens
  misc_feature: GYAE6OF01BHRTC.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcgaggtgccagatgtgtcatccagatcgaccctagtcctccactccctccctgtctgctatctaagtaggagacaagtactccacactcacgttcggccggcgagtcgatactagttacgctagttcgtattcgtagttagttaggtactacgaaacggaaaccaaaaccgggacgggaaccctaccggtaacccccttaaacgtccgtacgtacccttccgtacggtaactcgaccctaacgttacccgttaacgttaacgggaaccggtacgggtaccctagtacggtaacggttgaagggtaggtaacggtgtccgtaggtacgggtaattacgtttaacttttcctaccgattacacgtacggcgtaacggtctaggtaccgcgtaacgagacttaccgatacgaacctaattacgttacgttaacctagtaaacctagtagttagacgttacgttccgtccccgtaacgtcgttacccgggtacggggttcggggaaccgggtaagtagggtacaacgttaagacgtacggtagttacgg

SEQ ID NO: 72782 - DNA, 595 bp, Homo sapiens
  misc_feature: GYAE6OF01EN23B.52.32.C10.1.454.CMB.1.raw
  modified_base (204)..(204): a, c, t, g, unknown or other
  misc_feature (204)..(204): n is a, c, g, or t
  modified_base (231)..(231): a, c, t, g, unknown or other
  misc_feature (231)..(231): n is a, c, g, or t
  modified_base (311)..(311): a, c, t, g, unknown or other
  misc_feature (311)..(311): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctcctgtctgcatctatagganacagaatcaccatcacttcggccgggngagtcgagacattagctatgtatctagtattggtatcaagaacgaaaaccgcggacacgacccctaactcctagactccncgtatcacctatacctacgttaggaacgtacgggtacccagtacgtaaggttcaggtacggtaagtcggcgtcgtagggtactagtttacttttacgttacacctatcgagtcgacggctgaccacgtcgtagaacgtactagtacgaacctaatacttattactacgtaacaacgttagtattacgaattccgtacctacccggtcttacggttaccgggttccgggggaccgggggaacctaaggggtcggtaacgaacgttaccggaaggtcggtaaccgg

SEQ ID NO: 72783 - DNA, 630 bp, Homo sapiens
  misc_feature: GYAE6OF01AVGPQ.52.32.C10.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcacgttgccgggnagtcgagacattagctatgtatctgtaattggtatcagtacaaaaccgaggacacgacccctaaactcctagtactcctagatgaccactacctacgttaacggaaacgtacggggtacccaagtaccgtaaaggttccgtaaggtacgggtaaacggtcggtccgttacggtaggggtaacctaggtttaacgttttttaccttaccggtaaccctaacgttacgaacgtacggtacggtccgtaggacgaccgtaccgtaggaacactacgttacgacaaacctagttaattactacgtaactaacagttacagtataccgtcccgttccgacgttaccgtacggtttccgggacgggggtaaccaacggggtgtaacgacgtacgaacgtcggtaacgg

SEQ ID NO: 72784 - DNA, 712 bp, Homo sapiens
  misc_feature: GYAE6OF01D8Z5P.52.32.C10.1.454.CMB.1.raw
  modified_base (238)..(238): a, c, t, g, unknown or other
  misc_feature (238)..(238): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctcccatccctccctgtcctgcatctataggagacagaactccaccatcacgttcggccgggngagtccgagactagttagctatgtatctagtaattggtatacaacgaaccgaaaaaccgagggaaccaccgtacccctaaacgtcctagtacttcctacgatcgactacttaccgtaacgtttacgggaaaccggtacggggtaccctaacgtacgtaacggttccgagggttacgggtaaggttcggtaccgttacgggttaccggggtaacttaacggttttaactttttaacccttaccgtaaccttagtaccgagtacgacgggtctacgtaccgtacgtaccgtaaggtaataccgtagttacgaaccgtaactacttaacgtttacgttacgtaactaactaaggttactaacgtagttacccgtaccttaccccggtacgttacccggttaccggggtttacccgggggaccgggggtaacccggaagggttacggaacgtaacggtacgtaacggtacggtaacgg

SEQ ID NO: 72785 - DNA, 696 bp, Homo sapiens
  misc_feature: GYAE6OF01AQMOT.52.32.C10.1.454.CMB.1.raw
  modified_base (156)..(156): a, c, t, g, unknown or other
  misc_feature (156)..(156): n is a, c, g, or t
tcagcgcagtacgacacgaccggtgctcgatttagtatagacatcaacacacaaagggggcgaggagtcagtcccaaccaggacacagcatggacatgagggtccctgctcagctcctgggctcctgctgctctggctctcaggtgccagatcgtntcatccagatgacccagttctccactcctccctgtcctgactatcctataggacgacagaactccaccatcacgttacggcccgggacgtacggtaccggaacgtacgtacgttaaggactagttacgtacttacgtagttaagttaggtacttacgaacggaaccgaaaaccggtaacggaaccgaaccgtaaccccgtaaaccttaccgtacgtactacccgtacagttacgacctactaccgtacgttaacggtaacgtacgggtacctagtaccgacgttacgaggtacggagtcggcttcgtaggactagttacttttacgtctaacctcgtacagtacgtagtcctagacgtacgtcgtagtaagactacgttagacccgtaattaacgtacctttaactcgtaacttaactacggtattacgtacttacggtacccctaccgttacgttcccggttacggtttcccgggggtaaccgggggaacgttacggggtacgttaagggtacctacgggtaaccgtaccggtaaacgg

SEQ ID NO: 72786 - DNA, 818 bp, Homo sapiens
  misc_feature: GYAE6OF01A2GLX.52.32.C10.1.454.CMB.1.raw
  modified_base (204)..(204): a, c, t, g, unknown or other
  misc_feature (204)..(204): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctatagganacagaactcaccatcacttggccgggcgagtcgagacattagcatgtatcctagaattggtatctagaccaaaaacgacggacacgaccctaaactctagactccgtcgatcgcactccgtacgtttagggaaaccgaccgggggtaccctaacgttaccgtaacgggtttaccgtaagggttacggggtaacggttacgggtaccgttaccggtacgggggtaccgtaaacgggtttaaccgtttttttaaccgttttaaccgtaaccccgtacgtttaaccgaggtacccggtaacggggtccttaccgggtacccgtaccggtacccgttaacgggaaacggtaaccgttaacgtttacggtaacccttaaaaccggttaactttaaacgtttaaccgttacggttaacccgttaaacgttacggtttaaacgttaggtaaccgtttaaccggttaccccgtttcccccggtacccggtttaacccggtttaacccggggtttaaccccgggggggtaaccccggggggggttaacccggttaaaacggggggttacgggttaaaccgggaaccggttaaccgggtaaaccgggtacggtaaacccggggg

SEQ ID NO: 72787 - DNA, 732 bp, Homo sapiens
  misc_feature: GYAE6OF01AHSLX.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctagtaggagacagaactccgacctatccgtacgtttcggcccggggtacggagttaccggaagtaacctaagtttacggactaacgttgttaattccgttaggttaacgtttagggttaacttccgaaacggaaaccaaaaaaacccggagggaacccacccggtaacccccttaaaaccgtcccttaggtaccttaccgtacgacttcgaccttaacctacccgttaacgtttacgggaaaccggtacgggtaccctaagtcgtaaggttcgaggtaggtaaggtggcctacggtagggtaacgtacgtttactttttacttacgtacctaactcgacgacgtacggtaccgtcgaccacgtacgaggaacgtactagtacaactaatagttacttacgtacgttaccaaggtacttagtacgtacttaccgtcccgtaccgtcccgttaccggttaccgggtttccgggggacccgggtaaccggtaacgggttacgggaacggtaaccgtaacgtaaccgggtacggtaacgg

SEQ ID NO: 72788 - DNA, 586 bp, Homo sapiens
  misc_feature: GYAE6OF01CUTCG.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcacctatcacgttggccgggcgagtcgagacattagcatgtatctgattggtatcagacaaaaccgagggaccacgacccctaaactcctagactcctcgatgctactcctacgtttacggaaacgacggggtacccatacgaaggttacaggtaggaagtggtctcgtagggtactagttactttttaccttacacctacgtcgacgtcgacggtctacgccgtaacgtccgtaaggaacgtactatagacaactaatttacgttactacgtactaactgttaagtgtaacgtccgttccgttcccgtacttccgttacgggtttccggggaccggggtaccgaagggtcggaacgatacgaacggtcgtaacgg

SEQ ID NO: 72789 - DNA, 778 bp, Homo sapiens
  misc_feature: GYAE6OF01B1A01.52.32.C10.1.454.CMB.1.raw
  modified_base (206)..(206): a, c, t, g, unknown or other
  misc_feature (206)..(206): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccactccctccctgtctgcatctatagganacagaatccaccatcacttggccgggcgagtcgagactattagctatgtatctagtagttggtatacagaaccaaaacgacggaccacgtacccctaaactccgtagtactccgtcgtagtcgtacctacgttaccctaacgtttaacgggaaaacccgtacggggttacccctaagtacggttaaacgggttcgtaaggggttacgggtaaacgggttcgggtaccgttaccgggttaaggggtaacctttaaggttttaaacctttttttaacccgtttaccctaacccgttaacttaccggaacggtacccggtaacgggtccttaccgggaccgtaaccggtaccctaagggaaaccttaacgttagttaccgaacctaaacgttactttaacgttttaccgttagtaaccctaaagttaacgttaagttacgtaactttaccggtccccgttaccccggttaccgttacccgggtttacccggggtttacccggggggaccggggggtaaaccgtaacgggggttacggacggttaaaccggtacgaaacgggtccgttaaccgggg

SEQ ID NO: 72790 - DNA, 763 bp, Homo sapiens
  misc_feature: GYAE6OF01EDSS1.52.32.C10.1.454.CMB.1.raw
  modified_base (153)..(153): a, c, t, g, unknown or other
  misc_feature (153)..(153): n is a, c, g, or t
  modified_base (757)..(757): a, c, t, g, unknown or other
  misc_feature (757)..(757): n is a, c, g, or t
tcagcgcagtacgacacgaccggtgctcgatttagtatagacatcaacacacaaagggggcaggagtcagtcccaaccaggacacagcatggacatgagggtccctgctcagctccgtgggctcctgctgctcgtggctctcgaggtgccagntgtgtcactccagatcgacctagtcctccactcctcctgtctgctatctagtaggacacaagaactccacctactcgtacggtcggccgggacgacggtacgaagtaactagttacgactagttacgtacttgttaacgtaagttcggtaactaaccgaaacggaaaaccgaaaaaccggtacgggaacccaacccgtaaccccttaaccgtaccgtacgtaaccttccgtaacgtactaccgtaccgtaaccttaccggttaacggttaaaccggggaaacccggtaaccggtaccctaacgttaaacggttaacggttaacggtagggttaacgggtaacggttccgtacgtttacgggtacggtaacgtttaaccgtttttacttttaacccgtaccaaccgttagaccgaggtacccggtgtacccgtgaccgtacgtgaaacgaacgtacctagaccgtaacttaaacttacgttaacgtttaacgacgttaaacctaagtacgttagtacgtacccgttcggtacccccttccggtacgtttacggggaccggggttacggggaacggtacgtaggtacgacaacgtcgaaacgggtntacggg

SEQ ID NO: 72791 - DNA, 725 bp, Homo sapiens
  misc_feature: GYAE6OF01CBYY1.52.32.C10.1.454.CMB.1.raw
  modified_base (208)..(208): a, c, t, g, unknown or other
  misc_feature (208)..(208): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccactcctccctgtctgctatctagtagganacagaatccacatcacgtggccggagtacgtcgagactattacgctagtgtatcgtagtaagttggtactacgaacgaaaccaaaaaccggacggaaaccaacccggtaacccccttaaaacgtcccgtagtaccttaccccgtagacgtcgtacctaacttacccgttaaacggttaacgggaaaacccggtccggggtaaccctacgtaacgtaacgggttacgagggttaacggtaggtacggtcgttacggtaacgggtaaccgttagttttaaccgttttaccttaccgaacctagtacgaacggtacggtaacgtccgtagaccgtacggtacctaacggtaaacgtacgttacgttagaaccctaatttaactttaacgttacgtacgtaaacacgttagtaagttacctaagttacccgtcccgtaccgtcccgttaacggtaccggggttcccggggaacggggtaagtaacggggttgaacgtaacgtacggtaagtcccgtaacgg

SEQ ID NO: 72792 - DNA, 671 bp, Homo sapiens
  misc_feature: GYAE6OF01DZY8V.52.32.C10.1.454.CMB.1.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
  modified_base (435)..(435): a, c, t, g, unknown or other
  misc_feature (435)..(435): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccgagatcgacccagtcctccatccctcctgtctgcatctagtagganacagaatccaccatcacgttcggccggcgagtcganactatagctatgtatctagtaagtgtactcgaacgaaccgaaaaccgacggaaccaacgtaccccctaactcctagtacttccgtactaatcgactacctacgtacgttacggaaaccgtccgggtaccagttacgaggttacgaggtagaggtgtacgtcggtaggactagtttacttttacttccgaactntaccaggtacacggctacgccgagtccctaaggaactacgtattcgaactaacgtatttaaacgttctaccgtaacgaacttaaggttcgtaagttaaccgtcccgttacccggttacccctacccggtttaaccgggttaccccgggtttacggggggggacccggggttaaaacccgggtaagggttacgggaaacgttaccgtaaacggtaacccggtaccggttaaaccggg

SEQ ID NO: 72793 - DNA, 714 bp, Homo sapiens
  misc_feature: GYAE6OF01BXM7V.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcactccagatcgaccctagtcctcctacttcccgtccctgttctacgctatacgtaagtaggacgactaagactaccacctataccgtacgttcgggaccgggacgtacgtacgaacgtactaagttacgactagtacgtatacgtagtagttacggtaactacgaacggaaaccgaaaaaccggcgggtaaccctaaccggtaaccccttaaacgtcccgtagtaaccctccgtacgactccgtactaaccttaccgtaacgttaacggaaaccggtcggtaaccctagtaccggtaaggtacgtaggcggtaaggtcggacgtacggtacgggtacttagtttacttttaccacgaacttcgaactcggacgtggactccggactacgtacgtagaaccgtatacgtacgaacaattactacgtttacgactaaccaagttaggtactcggtaactcccgtaccgtcccgtacgttccgggttaacccgggtccggggggaaccggtacgttaaacggggtcggaacacgttaacgggacggttaacggtaccggg

SEQ ID NO: 72794 - DNA, 515 bp, Homo sapiens
  misc_feature: GYAE6OF01EU55Y.52.32.C10.1.454.CMB.1.raw
  modified_base (107)..(107): a, c, t, g, unknown or other
  misc_feature (107)..(107): n is a, c, g, or t
  modified_base (225)..(225): a, c, t, g, unknown or other
  misc_feature (225)..(225): n is a, c, g, or t
  modified_base (270)..(270): a, c, t, g, unknown or other
  misc_feature (270)..(270): n is a, c, g, or t
  modified_base (444)..(444): a, c, t, g, unknown or other
  misc_feature (444)..(444): n is a, c, g, or t
  modified_base (478)..(515): a, c, t, g, unknown or other
  misc_feature (478)..(515): n is a, c, g, or t
tcagcgcagtacgacacgaccggtgctcgatttagtatagacatcaacacacaaagggcgagtcgagacattagcatgtatctgaattggtatcagacaaaaaaccngggacacgcccctaaactcctgatcctcgatgcatccactttaggaaacgcggggtccccatcaaggttcagtggaagtgctctgggacagtattttacttcaccatcagcagctgcngcctagaaacgactattgacaaactattacgtttactgtaccaanaagttatagtatacgtcctcccgcttccgtacgttcgggggacggggacagggtcggagactacgaacggtcgtaacgtggtacggcctaggacctaccgattccggttctcgttcctactcccgttcccgactactctagtattaaacgcgtactcgcgtacggagtccgggntaacgggacggtaaggtcgactaagtcgatcggnnnnnnnnnnnnnnnnnnnnnnnnnnnnnnnnnnnnnn

SEQ ID NO: 72795 - DNA, 530 bp, Homo sapiens
  misc_feature: GYAE6OF01BUI4I.52.32.C10.1.454.CMB.1.raw
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(530): a, c, t, g, unknown or other
  misc_feature (506)..(530): n is a, c, g, or t
tcagcgcagtacgacacgaccggtgctcgatttagtatagacatcaacacacaaaagggcgagtcgagacattagcatgtatctgaattggtatcagacaaaaaccagggacagcccctaaactcctgatcctcgatgcatccactttggaaacaggggtcccatcaaggttcagtggaagtggctcgtgggacagtatttttacttcacatcagcaggctgcagcctagaagactattgacaacattacttactgtaccaaactagttatgtaattacgtcctccccgtcttacgtaccggtttccgggggaccgggggggtaacctaaggggtcggaagtacgtacgtaaggaccgtaacgttgggtcggcttacggaccaacccgtattctcgttaccttacgtacctttcccgttaccccccgcctattccgttataacttacgtaccgtatccggtcgtaggacgggtccggggctacgggcgaaggcgacagtacngngnnnnnnnnnnnnnnnnnnnnnnnnn

SEQ ID NO: 72796 - DNA, 627 bp, Homo sapiens
  misc_feature: GYAE6OF01C1GUR.52.32.C10.1.454.CMB.1.raw
  modified_base (155)..(155): a, c, t, g, unknown or other
  misc_feature (155)..(155): n is a, c, g, or t
  modified_base (479)..(479): a, c, t, g, unknown or other
  misc_feature (479)..(479): n is a, c, g, or t
  modified_base (520)..(520): a, c, t, g, unknown or other
  misc_feature (520)..(520): n is a, c, g, or t
tcagcgcagtacgacacgaccggtgctcgatttagtatagacatcaacacacaaaagggggcaggagtcagtcccaaccaggacacagcatggacatgagggtccctgctcagctcctgggctcctgctgctctggctctcaggtgccagatgtntcatccagatcgacccagtctccatcctccctgtctgcatactagtaggagacagaactccaccatccacgttcggccggagagtcgagacattagctaatcgtatcgtagtagttaggtaattacgaaaacggtaaaaaccggacgggaaccaccgtaaccccctaaacttcctacgaactcaatcgactcgtactactaccttacgttaacgggaaactcgggtacccagttacaagtcgagtaggagtggtctacgtggtacgtagtttacttttactacactactcagactgctagctacgacgtagaacgtactagtanaaccaagtactttaacgtacttagtaactaacgtacgttanagttaactccgttaccccaccgttcctcgttaccggggtttaccggggaccggggggtaacctaggggtaacggtaacgtagtaacgtacgggtaccgttaaacggg

SEQ ID NO: 72797 - DNA, 747 bp, Homo sapiens
  misc_feature: GYAE6OF01EL9R4.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtcctccgactcctccctgtctgctattctagtaggtacgacagaactccacctatcagttcggccgggtcgaggttccgagtacgtattagactagtgtaactctagtaattggtaatactaaggaaccaaaaaccggacgggtaacgaccggtaaccccttaaaccgttccgtaacgtaccttacccgttacgaacgtcggacctacgtacccttaacgtttaacgggaaaaccgacggggttacccaaaggtacgtaacggttacgtaagggtagggtaaggtcggccgttaggtacggtacgtaacggttaacttttaccttaccgtacctagttaccgaggtacgaggtacgtacgtcgaacgtaccgtaaggtaacgacgttacgttacgggaaccaaacgttagttaacgtttacgtacgttaaccgtaaacgttacgttaacgtgaacgtttacgtacccgttcccggttaccgtttaccgggtaccgggttttccggggggacgggttaaacccgggtaagggggtttacggaacgtaaacggttacggtaaacggtccggttaacgg

SEQ ID NO: 72798 - DNA, 600 bp, Homo sapiens
  misc_feature: GYAE6OF01A0BJT.52.32.C10.1.454.CMB.1.raw
  modified_base (585)..(585): a, c, t, g, unknown or other
  misc_feature (585)..(585): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttcgccgggcgagtcgagacattagcatgtatctgtaattggtatcagacaaaaccgaggacacgtacccctaaactcctagactcctacgatcgctactcctaacgtttacgggaaaccgtacggggtaccctagtacgtaacgggttcaagggttagggtaaaggtcgggtacgttacggtaggggaacctagtttacttttacctttcaaccgtataccgagtacgtacggctacgcacgtcctaggaactacgtattcgaacctaactaacttactttactacgttaacaacgtagttactaggtatacgtcctaccgtctacgtacggttcgggacgggggtacctagggtacggacgtanacgaagtcgtaacgg

SEQ ID NO: 72799 - DNA, 468 bp, Homo sapiens
  misc_feature: GYAE6OF01EMPEX.52.32.C10.1.454.CMB.1.raw
  modified_base (431)..(432): a, c, t, g, unknown or other
  misc_feature (431)..(432): n is a, c, g, or t
  modified_base (434)..(468): a, c, t, g, unknown or other
  misc_feature (434)..(468): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagacattgcaacatattactgtcaacagtatgaataactctcccgctccactttcggcggagggaccaagggtggagatcaaggacgaactggtacggctggcacctatctagtcttcacttcctcccgacctattcctagaacttacgaacgtatccgtccgtaggacgccgggtcgtggccgaaagggtccgacgagtacggnngnnnnnnnnnnnnnnnnnnnnnnnnnnnnnnnnnnn

SEQ ID NO: 72800 - DNA, 615 bp, Homo sapiens
  misc_feature: GYAE6OF01B1WJX.52.32.C10.1.454.CMB.1.raw
  modified_base (231)..(231): a, c, t, g, unknown or other
  misc_feature (231)..(231): n is a, c, g, or t
tcagcgcagtacgacacgaccggtgctcgatttagtatagacatcaacacacaaaggggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagaatcaccatcacttggccgggngagtcgagactattagctatgtatctagtaattggtatacagaacaaaaccgagggaaccacgaccccttaaactcctacgactccgtacgatcgactacgtcctaacgtttacggaaacgtccggggtaccaagtacgtaaggtacgaggtacggtaagtcggactcggtagggaactagtttacttttactacgactagtacgagcgagtcgtgacacgtacctagaacgtactagttacgaactaactattaacttactagaactaacgtagttactagtaacttaccggtcctacccgtcttaccggttaccgggtttaccgggggaccgggggtaaaccgtagggtacggaacggtaacacggaaacggtcgtaaacgg

SEQ ID NO: 72801 - DNA, 703 bp, Homo sapiens
  misc_feature: GYAE6OF01CAETY.52.32.C10.1.454.CMB.1.raw
  modified_base (207)..(207): a, c, t, g, unknown or other
  misc_feature (207)..(207): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccatccctccctgtctgcatctagtagganacagaactccacctatctacgttcggccgggagaggtcgaaggtaactagttacgctagtgtatcgtagtaagttggatacaagaaccaaaaccgaggaccaccgtaacccctaaactcctagactcctacgatcgacctactaccgtacgttaaggaaaccgtcgggtaccacgtacgtaagttcgaagggtacggaaggtcggtactcggtacgggtactagttttacttttacccgttacaccgttatccggtacgcgtacgggtcctacgaccgtagtacccgtaaggaacgttacctaagttacgaactaaacttaacgttcgttaaacgtcttaaactaacgttacgttaacgtacgtaaccgttaccgttccccgtacccgtaccgttacccggttacccgggggtttaccgggggggaacccggggttaacgtaaacggggttacgggaacgtaaaccgttaccggaaaccgggttacggtaaccggg

SEQ ID NO: 72802 - DNA, 518 bp, Homo sapiens
  misc_feature: GYAE6OF01CM9JS.52.32.C10.1.454.CMB.1.raw
  modified_base (223)..(223): a, c, t, g, unknown or other
  misc_feature (223)..(223): n is a, c, g, or t
  modified_base (315)..(315): a, c, t, g, unknown or other
  misc_feature (315)..(315): n is a, c, g, or t
  modified_base (453)..(453): a, c, t, g, unknown or other
  misc_feature (453)..(453): n is a, c, g, or t
  modified_base (485)..(518): a, c, t, g, unknown or other
  misc_feature (485)..(518): n is a, c, g, or t
tcagcgcagtacgacacgaccggtgctcgatttagtatagacatcaacacacaaagggcgagtcgagacattagcatgtatctgaattggtatcagcaaaaaccagggacagccccctaaactcctgatcctcgatgcatccactttggaaacagggtcccatcaaggttcagtggaagtggctcgtgggacagtattttactttcaccatcagcaggctgcncgcctgaagactattgacaaacattaacttactgtacaacgagtatgatacgtcctcccgctcctcgtttccgggacgggggaccgaggtgngactacgacgacgtaacgtggtcggcgtcggactaccgtactactcggtttaccttccgtactttccccttaccccggacctacgttcgtacttaacgtactacgtaccgtccgtcgtcggtaacgggcgggttccgngggacggtaacgggcctaacgtagtaacggcnnnnnnnnnnnnnnnnnnnnnnnnnnnnnnnnnn

SEQ ID NO: 72803 - DNA, 942 bp, Homo sapiens
  misc_feature: GYAE6OF01D7VAR.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacctagtcctccatccctcccgtgtctcgactattcgtaagagggaatacgaagaacttcaacccattccgtaacgttcgggccggggacgtaacggtacgaaggtaacctaagttacgactaagttagtattacgtagtaaagttcggtaactacgaaacgaaaaccgaaaaaccggtacgggaacctaacccggtaaccccttaaacgttccgtaacgtaccttacccgtacggtattaccggacctaaccgttacccgtaaccgggtttaagggaaaaccccggtaaccggggttaccctaaacgttaccgggtaaaggtttaccggaaaggggttacgggtaacggtttacgggaccgtttaccgggtacggggtaacctttaagttttaaacccgtttttaaccttccgaaaaccggtttactaaccgtaagggaaccgtacgggttacctacgtaaccgtaccgtacgtaaacgtaaccgttaactacgggtttaacaaccttaaacggtacttttaaaccgtttacgttaaccgtaacgtaaaccgtttaggtaaacgtttccgtaaaccggttttacccgtcccccggttaaaccccgttccccgggttttaaaaccccgggttcccggggggttttaaacccgggggggggaaaaccccccggggggggttaacgggttttaaaaaccggggggtacggtaaaaacccggggtttacccggtaaaaacccgggggttaacccgtaacgggggttttaaaccccggg

SEQ ID NO: 72804 - DNA, 784 bp, Homo sapiens
  misc_feature: GYAE6OF01EZIU7.52.32.C10.1.454.CMB.1.raw
  modified_base (238)..(238): a, c, t, g, unknown or other
  misc_feature (238)..(238): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctcctgtctgcatctataggagacagactcaccatcacgttcgccgggcagtcganacattagcatgtatctagtaattggtactcgagaccaaaaaccgagggacaccgacccctaaactcctagacttcctacgtactcgactactaccgtaacgtttacggaaaccgtacggggtaccctaagttaccgtaacggtttcgaagggttacgggaacgtcgggtccttacggtaggggtaaccttaaggtttaacttttttaccgttacccaaccgttacgtaccgaacggtacgtaacgggtccttacggaccgtacggtaccccgttaaggaaacgtacctaacgtttacgaaacccgtaaacttaacgttttaacgtttaaccgttaccgggttaaacctaaaccggtaaggttaaccttaagggttaaacccgttttaaccggtcccccgtttaaccccggtcgttttaaccccgggttaaccgggggttttaccccgggggggaaccccggggggggtttaaaccaaacggggggtttacggggttaaaacgtaaccggttaaccggtaaaccggggttaacccgggtaaaccggg

SEQ ID NO: 72805 - DNA, 618 bp, Homo sapiens
  misc_feature: GYAE6OF01EHFP8.52.32.C10.1.454.CMB.1.raw
  modified_base (535)..(535): a, c, t, g, unknown or other
  misc_feature (535)..(535): n is a, c, g, or t
  modified_base (573)..(573): a, c, t, g, unknown or other
  misc_feature (573)..(573): n is a, c, g, or t
  modified_base (577)..(581): a, c, t, g, unknown or other
  misc_feature (577)..(581): n is a, c, g, or t
  modified_base (584)..(586): a, c, t, g, unknown or other
  misc_feature (584)..(586): n is a, c, g, or t
  modified_base (588)..(590): a, c, t, g, unknown or other
  misc_feature (588)..(590): n is a, c, g, or t
  modified_base (592)..(594): a, c, t, g, unknown or other
  misc_feature (592)..(594): n is a, c, g, or t
  modified_base (596)..(598): a, c, t, g, unknown or other
  misc_feature (596)..(598): n is a, c, g, or t
  modified_base (600)..(618): a, c, t, g, unknown or other
  misc_feature (600)..(618): n is a, c, g, or t
tcagcgcagtacgacacgaccggtgctcgatttagtatagacatcaacacacaaagggcgagtcgagacattagcatgtatctgaattggtatcagacaaaaaccaggggacagccccctaaactcctgatcctcgatgcatccactttggaaacaggggtcccatcaaggttcagtggaagtggctcgtgggacagtattttacttcaccatcagcaggctgcagcctagaagactattcacgaactattacttacgtacgtacaaacgtaagttagtgaattacggttcctccccgactttccgtaacccggttttcccggggggaccgggggggaaccctaaaggggtaggggtaagtacttaccggaaacgtaccggtaaacccggttggttccgggcgtacggaccctaaaccgtaattttcccgtcgttacctttaccgaacctttccccttaccccggaccctaactttccgttagtaatttaccgtaaacgtaccgttccggtacttacggggtacgggccggggtnttacccggggaacgaaccgggttacgaacttagaacgngcannnnngannngnnntnnntnnngnnnnnnnnnnnnnnnnnnn

SEQ ID NO: 72806 - DNA, 727 bp, Homo sapiens
  misc_feature: GYAE6OF01EWO3O.52.32.C10.1.454.CMB.1.raw
  modified_base (209)..(209): a, c, t, g, unknown or other
  misc_feature (209)..(209): n is a, c, g, or t
tcagcgcagtacgacacgaccggtgctcgatttagtatagacatcaacacacaaaggggggcaggagtcagtcccaaccaggacacagcatggacatgagggtccctgctcagctcctggggctcctgctgctctggctctcaggtgccagatgtgtcatccagatcgacccagtctccactccctccctgtctgctatctagtagganacaagaactccaccatcctacgttcggccggggcgagtcgacgactattacgactatcgtatacgtagtaacttggtactacgaacgaaccgaaaaaccggacgggaacctacccggtaaccccctaaaccttccgtacgaccttcccgtacgtactcgacctaccttaccgtaaccggtttaacgggaaaccggtaccggggtaccctaagttaaccggttaacggttccggtaaagggttagggtaacgggttcggcccgttacgggtacgggtaaccgttaagttttacctttttaccttacctaccgttactacgtaggtaccgacggtccgtacgacgtaccgtaccgtagtaaacgtactacgttacgacctaagtaactttagttaacctagttaacctaacgtaggttatacgtacttaaccgtccctacccgttccgttacggttacccggggtttccggggaccggggtaaccgtaaggggtacggacgtacgacgtaggacgtacgg

SEQ ID NO: 72807 - DNA, 694 bp, Homo sapiens
  misc_feature: GYAE6OF01C3DWV.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagttcctcccacttccctccccttgtcctgcatctaataggagacagaatccaccatccacgttcggccgggcgtagtcgaagacattagcatgtatctagtattgatacaagaacgaaaaccgaggaaccaccgtacccctaaactcctacgtactcctcgaatcgcctactccttaacggtttaacggaaaccggtccgggtaccctaagtacgtaaggttcgaggttaggaggtcggtccgttacggtacgggtaacttaacggtttaactttttaccgtacgaagtactagtacgtaggcgtaacgtccgtagaccgtacgtacccgtaaggtaacgtacctaggttacctaactaaacttaatttacgttacttacgaaaccgtataagtttaagaaccgttacgttacccgtacccgtcccggttacgttaccccgggttcggggtttacccggggggaaccgggggtacggtaaacggggttacggaagtaaccgtacggtaaaccggtaaaccggg

SEQ ID NO: 72808 - DNA, 697 bp, Homo sapiens
  misc_feature: GYAE6OF01DOWMK.52.32.C10.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccgtcctgtctgcatcatagganacagatcaccatcacgtgccgggnagtcgagacagttagactagtagtatactagtaattggtatacgacgaacaaaaccgagggacaccgtacccctaaactcctacgtactacctcgaactcgtactactcccgtaacgttttaacgggaaaacccggtacggggttacccctaagttaccggtaaacggtttaccgacgggttagggaacggttacggtccgttacggtagggggtaacttaaggttttaaccttttttaaccgttaccaaacctacgttaccgaacgtacgtaccggtacgttcggaccacgtccgttaagaacggtactaagttcgaaacctaacgtacttaacgttacgtacgtactaacgtagttaacgtagtacgttaccgttcctacccggttacttaccgggtaccggtttaccggggggacccggggtaacgtaagggtacggtaacgacggttaacgaaggtcgtaaccggg

SEQ ID NO: 72809 - DNA, 633 bp, Homo sapiens
  misc_feature: GYAE6OF01CL907.52.32.C10.1.454.CMB.1.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (318)..(318): a, c, t, g, unknown or other
  misc_feature (318)..(318): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccatccctccctgtctgcatctaagtaggagacagaactcaccatccacgttggccgggngagtcganactattagcatgtactctagtattggtatcaagaacaaaaccgaggaccacgtacccctaactctagactcctagntcgctactcctacgttacggaacgtcggtaccatacgaagttcaggtagagtcggctgtacggactacgttatttacctcactatcgagacgtaggtctcggacgtacgacccgtaaggaaacgtccgtaagtttcgaaacctaacttaacttaacgtttaccgtaacgttaaccaaacggttagttaacgtagttaacgtacccggttaccccgttacccggtaccttaccgggttaacccgggtttccgggggaaccggggggtaaacccgtagggtacgggaacgtacgtaacggaacggtaccgtaacggg

SEQ ID NO: 72810 - DNA, 752 bp, Homo sapiens
  misc_feature: GYAE6OF01CKZ6E.52.32.C10.1.454.CMB.1.raw
  modified_base (143)..(143): a, c, t, g, unknown or other
  misc_feature (143)..(143): n is a, c, g, or t
  modified_base (150)..(150): a, c, t, g, unknown or other
  misc_feature (150)..(150): n is a, c, g, or t
  modified_base (225)..(225): a, c, t, g, unknown or other
  misc_feature (225)..(225): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (478)..(478): a, c, t, g, unknown or other
  misc_feature (478)..(478): n is a, c, g, or t
  modified_base (708)..(708): a, c, t, g, unknown or other
  misc_feature (708)..(708): n is a, c, g, or t
  modified_base (746)..(746): a, c, t, g, unknown or other
  misc_feature (746)..(746): n is a, c, g, or t
tcagcgcagtacgacacgaccggtgctcgatttagtatagacatcaacacacaaagggggcaggagtcagtcccaaccaggacacagcatggacatggacgggtccctgctcagctccgtggggctcctgctgctctggctcncgaggtnccagtatgtatcagtccagactcgaccctagtcctccctacttcccgtccctgtccgctattcgtaggtaagganaacgagtactcaatctactcctacgttggaccgganaacgtnacggnacttaagttaacgttaactttaagtttaagtcggttaacaacgaaaacgtaaccgaaaaccggtaacggtaaacccgtccccgttaagtaaccttccgttaagtaccttacggtttactacggttacctaaccgttaccgtttacgttcggaccggtttagggaccggggttacggttaccctaaggttacggtaacggttaccgngggttaacggtcggtagggtaggttacgtccgggtaagacttaacgtacttcctaaccgttcacctaacctacgtaccgaacccgtggttccaggacgttacggctttagggtacttttagtaaccgttacctttaacggttcttacggtaactacgtaagttactttaaccgttctaccggttacccttaccgttccggttaccggtcccgggtaatacttcgggttanaacgtacttaacccggaataacggtcgttcggtcccgntaaccg

SEQ ID NO: 72811 - DNA, 638 bp, Homo sapiens
  misc_feature: GYAE6OF01EQBDH.52.32.C10.1.454.CMB.1.raw
  modified_base (520)..(520): a, c, t, g, unknown or other
  misc_feature (520)..(520): n is a, c, g, or t
  modified_base (556)..(556): a, c, t, g, unknown or other
  misc_feature (556)..(556): n is a, c, g, or t
  modified_base (569)..(569): a, c, t, g, unknown or other
  misc_feature (569)..(569): n is a, c, g, or t
tcagcgcagtacgacacgaccggtgctcgatttagtatagacatcaacacacaaagggggcaggagtcagtcccaaccaggacacagcatggacatgaggtccctgctcagctcctgggctcctgctgctctggctctcaggtgccagatgtgtcatccagatcgaccctagtcctccactccgtccctgtctgctatctagtaggacgacagaactccaccatcgtacgttggccgggtacgagtacgagactattagctatgtatcgtagtaagttaggtatcgaacgaaccgtaaaaaccggcgggtaaccaccgtaaccccttaaacttcccgtagtaccttccgtacgtactcgacctaacgttaccgtaacgtttaacgggaaaccgtacggggtaccctaagttaccgtaaggttacgtagggtagggtaagtcggtctacggtagggtactaagttttacgttttacctacgtaccctataccgagcgtacgctgactacgctagactactntacgactaatatacttagtactaacaatagtacgtntactacgttcccnccgtcgttacgtaccgggtttcgggacggggaactaggggtacgaaacgtagtacgaaccgtgtaacgg

SEQ ID NO: 72812 - DNA, 831 bp, Homo sapiens
  misc_feature: GYAE6OF01AGKS7.52.32.C10.1.454.CMB.1.raw
  modified_base (207)..(207): a, c, t, g, unknown or other
  misc_feature (207)..(207): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctcctgtctgcatctaagtacgganacaagactccaacctatcgacgttcggccgggtacgagtcgagactattacgctagtcgtatcgtagtaagttgtatacaacgaaccaaaacggacggacaaccgtaccccttaaaccgtccgtacgtaccgtcctacgtacgtacgacctaccttaacccgttaacggtttaaaccggaaaccggtaaccggggttaccctaaacggttaaccgtaacggttacgtaaacgggttaagggtaacggttcggttacggttaccggtaacggggttaacccgtttaagtttaaaccgttttttacccgttaacctaaacccttaacggtaccgtaacgggtacggtaccgggtactaccggtacgaaccggtaccggtaaggtaaacgtaaggtttaacctaacgtaaccgttaaacgttaactttaccgttaaccgttaacgttaaccgtaaacgtaagttacttaacggtagtttaacccgttccccggttaaccccgtacccggttaacccgggtttaacccggggttcccgggggggtaaaccgggggtaacccgggttaaacgggggttacggtaaacgggtaacgtaaaccggttaaaccgggtaccgttaaaccgggg

SEQ ID NO: 72813 - DNA, 705 bp, Homo sapiens
  misc_feature: GYAE6OF01A5H4U.52.32.C10.1.454.CMB.1.raw
  modified_base (204)..(204): a, c, t, g, unknown or other
  misc_feature (204)..(204): n is a, c, g, or t
  modified_base (230)..(230): a, c, t, g, unknown or other
  misc_feature (230)..(230): n is a, c, g, or t
  modified_base (285)..(285): a, c, t, g, unknown or other
  misc_feature (285)..(285): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctagtagganacagaatcaccatcacgttgccgggngagtcgagacattagctatgtatcgtgtaattggtatacgaacgacaaaaaccgngggaccaacgacccctaaactcctagactccgtacgatcgactactaccgtaacgtttagggaaaccgtacggggtacccctagttaccggtaaggttccgaaggtagggtaagtcgggtcttaccggtagggtaactaacggtttacttttaaccttactaaccctaatccgacgacgtaacgggtccttacggaccgtaacggtccgtaacggaacgtacgtaagtttcgaacctaaattacgttaaccgttacgttacgttaaccgtaaactaggttaacaggttacttaccggtccccgttacccgtaccgttacccggttaacccggggtttcccggggggaaacccgggggttaaaccgtacgggggttaacggaacgtaacgtttaccggaaagggttacccgggtaaacggg

SEQ ID NO: 72814 - DNA, 798 bp, Homo sapiens
  misc_feature: GYAE6OF01DB6QC.52.32.C10.1.454.CMB.1.raw
  modified_base (139)..(139): a, c, t, g, unknown or other
  misc_feature (139)..(139): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctntcaggtgccagatgtgtcatccagatcgacccagtcctccactcctccctgtctgctatctagtaggagacagaatccaccattccacgttcggcccggggataggtccgaagtacctaattagactattacgtatcttaggtaagtttggtactaacgaacgaaacgaaaaacccggagggaaccaacccggtacccccttaaacgttcccaacggtaccttcccgtggtaactcggacctacgttacccgttaacgtttacgggaaacgtaccggggttaacccaagttacgtaacggtttacagggttacggtaacggttcggtactcccgggttaggaaccgttacgttttaacttttacctttaccgaaccttaacgtccgtaaacggtccgtaaccgggtccttacggaccccggtacgtacccgttaagtaaacggttaccttaaggtccaaaccgttaaacgttaattttaccggtttaaccttacgaaccttaaacggttagttaacttagttaaaccgttacccgtttacccgtcccccggttagtttacccgggttaacccggggtttccccgggggaaccggggggtaacccggtaaggggtttaacgaacggtttaacgacggtaaagggtaccccggttaaaggg

SEQ ID NO: 72815 - DNA, 726 bp, Homo sapiens
  misc_feature: GYAE6OF01DVZT9.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcgaggtgccagatgtgtcatccagatcgacccagtcctcccactcccctccgtgtctgctatctaagtaggaacacagaactccaacctatcctacggttcggcccgggacgaggtacgaagtactatagctagtgtatactagtaattggtaactacgaacgaaaccgaaaacggacggtaaccaaccgtaccctaaactccgtacgtactcccgtagacgtacactaccgttaccgttaacgttaacgggaaaccggtaccgggttacctaacggttaaccggttaacgggttacggacgggttaagggtaacgggtcggtaccgttacggtacgggtacttaacgttttacctttaccttacactacgtacgtacggacgtacggtacgtcgtacgtacgtacgtaacgaacgtacgtagttaacgaaccttaaacgtaactttaaccgtttaacgtacgtaaccgtaagtacgttagtacgttactacccgtccttacccgtcctttaccgggtaccggggttcgggggggaaccggtaacggtaacgggtagtaacggaaccgtacgaaggtcggtaacg

SEQ ID NO: 72816 - DNA, 712 bp, Homo sapiens
  misc_feature: GYAE6OF01A4MJX.52.32.C10.1.454.CMB.1.raw
  modified_base (146)..(146): a, c, t, g, unknown or other
  misc_feature (146)..(146): n is a, c, g, or t
  modified_base (207)..(207): a, c, t, g, unknown or other
  misc_feature (207)..(207): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtnccagatgtgtcatccagatcgacccagtctccactccctccctgtctgcatctagtagganacagaatccaaccatcacgtggccgggacgagtcgagtactattagcatgtatctaggtaattaggtactacgaacgaaccgaaaaaccgacgggaacaccggtaacccctaaactcctacgtacgttacctacgatcgacctactaccgtacgttaacgggaaaccggtaccgggtaccctaagtacggtaacggttcgtaaggtacgggtaacggtcggtaccgttcggtagggtacgttaacgtttacttttaaccgttacctaacctacgtaccgtaacggtacggtaggtccgtacggaccgtaccgtaccgtaacgaaacggtacttacgtaacgaacttaacgttaacgttaacgttacgtagttaactaacgtacgttaacgagttaaccgttaccgtccccgttaccggtacctttaccgggtaccgggtttcccggggggaccggggtaacgtaacgggtacgggtacgtaggtaacgtaccgggtacggtacgg

SEQ ID NO: 72817 - DNA, 692 bp, Homo sapiens
  misc_feature: GYAE6OF01BOVY3.52.32.C10.1.454.CMB.1.raw
  modified_base (310)..(310): a, c, t, g, unknown or other
  misc_feature (310)..(310): n is a, c, g, or t
tcagcgcagtacgacacgaccggtgctcgatttagtatagacatcaacacacaaagggggcaggagtcagtcccaaccaggacacagcatggacatgaggtccctgctcagctccgtgggctcctgctgctctggctctcaggtgccagatgtgtcatccagatacgacccagtctaccacgttccctcccgtgtctgctatctagtaggagacagtactccaccatcgacgttcggccgggacgagtacgagactagttagactattgtatacgtagtaacgttgtactacgaacgaaccaaaaccggnggaaccaccgtaacccctaagtcctagtaccttccgtacgtactacgaccttacctaccgttaaggttaaccggaaacccggtaccgggttacccaaggttacgtaacggtaccgtaaggggttacggtaagttccggtacttacgggtacgggtaaccttacggttttaaccttttactaacctaccgtactacggagtacgtacggaccgttacgacgaccgtacgtaacggacgttaactcgttaacgaactaacgtttataacgttacgtactacgtaacgtactagtacgtacttaccgtacccgtaccgtacgttaccggtaccgggttcggggaaccgtaccggtaggtacgagacctaggtaacgtcggtaacg

SEQ ID NO: 72818 - DNA, 820 bp, Homo sapiens
  misc_feature: GYAE6OF01DUKEJ.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcgaggtcgccgagtatgtgtcactccagtactcgaccctagtcctaccacttccctccttgtctgactactactaagtaaggacgaacaacgtaactaccacctaacgttaccgtaccggttcggggacccgggtacgaacggtaccggaacgtaacgtaacgttacggaccttaagttaggtaacttcgttaaggttaagtttacggtaacgtacgaaaccgtaaaaccggaaaaaccggtacggaaacccgtaaccccgtaaacccccttaaaccgtaccctacgtacctccggtacgtacgtacctaactaccgttaaccggttaacgtttaacgggaaaccccgttacggggtaccctaggttaaccggtaagttacggacgggtacggtaggtcggtacgtacgggtaacggtacttaacgtttaactttccgtaaccacgtacttacgacgcgggtacgtccgtacgtacgtaccgtacgaaacgtaacggtaacttaccgtaagtaaaccctaagtttacgtaaccgtttaagttaaccgtaacgtaaccgttagttaacctaaggttcttaccccggtaccgttcccgttacgtaccgggtacggggttacccgggggaacgggtaacgtaacggggtacctaggtaactaacggacgttaaaccgtcggg

SEQ ID NO: 72819 - DNA, 669 bp, Homo sapiens
  misc_feature: GYAE6OF01BWKKS.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccatcctcctgtctgcatctataggagacagaactcaccatcacttcggccgggcagtcgagacattagcatgtatctgtaattggtatcagacaaaaccgagggacacgaccctaaactcctacgactcctgactgacacttacctacgtttacggaaacgtaccggggtacccaagttacgtaaggttcaagggtacggtaacggttcggtccgttacgtaggggtaactagtttaactttttaccttaccaacctatcgacggacgtacggcgtacgtacgacgtcctaggaaacgtactatttacgaacctaaacgtatttaacgttacttacgtacctaaagtacgttaagtacgtacgttaccgttacccgttccccggtaccgtttacccggtaacccgggttttccggggggaacccggggggtaaacccgttaaagggggtacggtaacgaaccggttaacggtaacgggtaccggttaaaccggg

SEQ ID NO: 72820 - DNA, 735 bp, Homo sapiens
  misc_feature: GYAE6OF01CI8FV.52.32.C10.1.454.CMB.1.raw
  modified_base (140)..(140): a, c, t, g, unknown or other
  misc_feature (140)..(140): n is a, c, g, or t
  modified_base (146)..(146): a, c, t, g, unknown or other
  misc_feature (146)..(146): n is a, c, g, or t
  modified_base (171)..(171): a, c, t, g, unknown or other
  misc_feature (171)..(171): n is a, c, g, or t
  modified_base (192)..(192): a, c, t, g, unknown or other
  misc_feature (192)..(192): n is a, c, g, or t
  modified_base (202)..(202): a, c, t, g, unknown or other
  misc_feature (202)..(202): n is a, c, g, or t
  modified_base (231)..(231): a, c, t, g, unknown or other
  misc_feature (231)..(231): n is a, c, g, or t
  modified_base (566)..(566): a, c, t, g, unknown or other
  misc_feature (566)..(566): n is a, c, g, or t
tcagcgcagtacgacacgaccggtgctcgatttagtatagacatcaacacacaaagggggcaggagtcagtcccaaccaggacacagcatggacatgagggtccctgctcagctccgtgggctcctgctgctctggctcncaggtnccagtatgtgcatccagatcgaccngtcacactcctcctgctgacntctagagganactagaactcacagtcacgttggccgganagtacgagtatagttacgatagtgtaatcgtagtaactttggtaactacgaaacgtaaccgaaaaaccggacggttaaccaccggtaacccccttaaattccggtacgaaccgttccctaggaacgtcgacctaaccttaccggttaacggtttaacggggaaacgccgggtttacccaattaaccgtaaggtacgttaaaggagggtaacggttcgtacctacgggtagggtaaccttaaggttacctttttaaccgtacctaacccaaaggttccaaacgggccggttaggaaccgttcgggaacctttaacgggtacctaagggaaaccgtnttaaacgggttccgaaacttaaaccgtagtttaactttaacggacctaaacgtagtacggttaaatcgtaaacgtaccggttccctacccgtaccgttacgggttaacccgggttccgggggaacgggttaaccaggggttacgaacttaacgccgaaaggtcgtaagg

SEQ ID NO: 72821 - DNA, 679 bp, Homo sapiens
  misc_feature: GYAE6OF01ETVZY.52.32.C10.1.454.CMB.1.raw
  modified_base (242)..(242): a, c, t, g, unknown or other
  misc_feature (242)..(242): n is a, c, g, or t
tcagcgcagtacgacacgaccggtgctcgatttagtatagacatcaacacacaaagggggcaggagtcagtcccaaccaggacacagcatggacatgagggtccctgctcagctccgtgggctcctgctgctcgtggctctcaggtgccagatgtgtcatccagatcgacccagtcctccactccctccctgtctgctatctaagtaggagacaagaactccaccatcacgttcggccgggngacgtcgagacgtattagactatgtatctagtaattggtatcgaacgaaccaaaaaccggacgggaaccaaccgtaacccccttaaactcccgtagtacttcccgtacgtacgtcgacctaacctccgttaaacggtttacggaaaaccggtaccgggtaccctaagtacgtaacgttgtaagggtaggtagtcggtctaggtcggacttaagtttacttttacttaccgactactacgagtcgtacggacttcgacgtacggtaccgtaaggaactaactacttacggaaccttaaacgtacttaatttaccgacttacaaacgtacgttagttagtaaccgttacgtccccgttcccggtacctttacgggtacccgggtttcggggaccggggtaacgtagggtacggacgtagtaccgaaggtacggtaacgg

SEQ ID NO: 72822 - DNA, 971 bp, Homo sapiens
  misc_feature: GYAE6OF01CVRE9.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctgctctcaggtgccagatgtgtcatccagatcgacccagtcctccacttcctcctgtctagctatctagtaggaagacagaactccaacctataccgtacgttcggacccggggacgaggtccggaaagacctattaggactagttgttactcgttagtaagttcggtactacgaaacgaaaccgaaaaaccgacggggaaccctaacccggtaacccccttaaacgttcccgttacgtaaccgttaccccgttaggaactaccggtacctaacctttaccgtttaaccgggtttaaacgggtaaacccgggtacccggggttaacccctaaacgtttaaccgggtaaaggttttaccggtaaagggttaacggggtaaacgggtttccgtaccgggtttaaccggtaacgggggtaaccttttaaagggtttttaacccttttttaacccgtttaaccccgtaaaccgtttaaccggtaacccgtaacgggttacccggtaacgggttccgttaacccgggcccggtaaacggttaccccggttaaaacggtaaaccgttaaccgtttaaaccgttaccgggaaaaccccttaaacgtttaacgttttaaacgtttaccggttaacgtaaacccgttaaacgtttacggtttaacggttaaccgtaaccgttttaccccggttaccccgttacccccggtttaccgggtttaaccccggggtttaaccggggggtttacccgggggggtaaaccccggggggtaaaacgggttacggggttaaacgggaacgtttaaaccgggaacccggttaaaccgggtaacggtttaaccgggg

SEQ ID NO: 72823 - DNA, 641 bp, Homo sapiens
  misc_feature: GYAE6OF01BKCGW.52.32.C10.1.454.CMB.1.raw
  modified_base (140)..(140): a, c, t, g, unknown or other
  misc_feature (140)..(140): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctnaggtcgccagatgtgtcatccagtactcgacccagtcctccactccctcctgtctgcatctagtaggagacagaactccactatcctacgttcggaccgggcgtaggtcgacgactattacgctaattcgtaactctaggtaaatttggtaatcgaacgaaccgaaaaaccgacgggaacacgtacccctaaactccgtagtactcctacgtatacgcattccacgtttaggaaacgtcgggtaccactacgtaacggtacgaggtaggagtcgcgttcggagggtacctaaggttacttttacttacctaacctatacgacgtcgacggtctcgtacgacgtccgtagaactactattacggacctaatacgttacttactagtactaagtagtactagtacgttaccgtcgttcccgtcgttaccgttccgggtttaccggggacccggggtaacaacggggttacgaaggtaccgtaacgtaaccggtcggtaaacgg

SEQ ID NO: 72824 - DNA, 654 bp, Homo sapiens
  misc_feature: GYAE6OF01BFA6P.52.32.C10.1.454.CMB.1.raw
  modified_base (500)..(500): a, c, t, g, unknown or other
  misc_feature (500)..(500): n is a, c, g, or t
  modified_base (614)..(614): a, c, t, g, unknown or other
  misc_feature (614)..(614): n is a, c, g, or t
  modified_base (619)..(620): a, c, t, g, unknown or other
  misc_feature (619)..(620): n is a, c, g, or t
  modified_base (623)..(654): a, c, t, g, unknown or other
  misc_feature (623)..(654): n is a, c, g, or t
tcagcgcagtacgacacgaccggtgctcgattttagtatagacatcaacacacaaagggcgagtcgagacattagcatgtatctgaattggtatcagacaaaaaccgagggacacgcccctaaactcctgactcctcgatgccacttcctagtttaggaaaccgtacggggtacccatacgaagggtttcaggtggaagtggctcgtagggactagttatttttacgttccaactacttcgacgcgacggtctcgaccgacggtacccgtaagaaacgtacctaagtttacgaactaaaccttagttaactttaccgtacggtaacctaaaacgtaggttaattacggtaacgtttaacccggtcccttccccgggtaacttaccggttaaccccggggtttaccggggggaaccgggggggtaaccgtaaggggtacgggtacgaacgttaccgtaaagggccgtaaacgtcgggtcggaccttccggacctaaccgtnttccgtagttccttacgtacctttcccgacccgtataccgttgtaataaccgttacgaacgtttcgccggtactagggtcgggaccgtggaccgagggacgtacgagtacagtnatcgnnagnnnnnnnnnnnnnnnnnnnnnnnnnnnnnnnn

SEQ ID NO: 72825 - DNA, 695 bp, Homo sapiens
  misc_feature: GYAE6OF01DEYTQ.52.32.C10.1.454.CMB.1.raw
  modified_base (190)..(190): a, c, t, g, unknown or other
  misc_feature (190)..(190): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctcactcctcctgtcngacatcgtaagtaggagactagaactccacctattcctacggtcggcccgggacgtaggtcggaacgactaagtttacgacgtattagttactgttagtaagttggtactaccgaacgaaaccgaaaaccggacggaacccaacccgtaccccttaactcctacgtacctaccgtacgactcgactaccttcgtaacgtttaacgggaacgtcggtaccagtacgtagtcgaggtagaagtcgtacgtcggtaggtacttagttaccttttacctacctactagtcgacgtacgtcggtcgtcgacgtcgacgttagaactacgtacgttacgaactaacgttatttaaccgttacgtacgtaacgttaagtacgttagtacgttaaccgtacccgttaccgtcccggtttaccgtacccggtttacccgggggttaccgggggaacccggggtaagttacggggtacttaacggacccgttaaagaccgggttaccgttacggg

SEQ ID NO: 72826 - DNA, 607 bp, Homo sapiens
  misc_feature: GYAE6OF01CZD2K.52.32.C10.1.454.CMB.1.raw
  modified_base (164)..(164): a, c, t, g, unknown or other
  misc_feature (164)..(164): n is a, c, g, or t
  modified_base (175)..(175): a, c, t, g, unknown or other
  misc_feature (175)..(175): n is a, c, g, or t
  modified_base (203)..(203): a, c, t, g, unknown or other
  misc_feature (203)..(203): n is a, c, g, or t
  modified_base (280)..(280): a, c, t, g, unknown or other
  misc_feature (280)..(280): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagntgacccagtcnccatccctcctgtctgcatctatagganacagaatcaccatcacttggccggcgagtcgagacattagcatgtatctgtaattggtatcgaacgaacgaaaaccngggaaccaccgacccttaaactcctagactccgtacgatgactactaccgtacgtttaggaaaccgtcgggtacccagttacgtaaggttacaggttaggtaacgtggtacctcgtacggggattacgttacgtttttaccttacaccgtatacgtacgacgtaggtccgtacgtcgaacgtccttaaggaacgtactacttacggacctaaacgtattaacgttaccgtagtacctaagtacgtatagtagtaccgtaccgtcccgtacttcgttacggtttccgggacggggtacagggtaggacgttagacgtaaggcgtacgg

SEQ ID NO: 72827 - DNA, 462 bp, Homo sapiens
  misc_feature: GYAE6OF01AY3Z1.52.32.C10.1.454.CMB.1.raw
  modified_base (153)..(153): a, c, t, g, unknown or other
  misc_feature (153)..(153): n is a, c, g, or t
  modified_base (432)..(462): a, c, t, g, unknown or other
  misc_feature (432)..(462): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacnggggtcccatcaaggttcagtggaagtggctctgggacagtattttacttcaccatcagcaggctgcagcctgaagcattgcaacatattactgtacaacagtatgatagtctcccgctctacgtttcggcggggggaccaaggtcggagagtcaaggtcgaacgtggtcgggctgaccacctatcgtcgttccttcattcccttacccgcctatcctagaatacgtacgatccgagtcggacggcggggtctgggaccgtaacgggccacgtaatgcnnnnnnnnnnnnnnnnnnnnnnnnnnnnnnn

SEQ ID NO: 72828 - DNA, 842 bp, Homo sapiens
  misc_feature: GYAE6OF01D0X65.52.32.C10.1.454.CMB.1.raw
  modified_base (199)..(199): a, c, t, g, unknown or other
  misc_feature (199)..(199): n is a, c, g, or t
  modified_base (271)..(271): a, c, t, g, unknown or other
  misc_feature (271)..(271): n is a, c, g, or t
  modified_base (377)..(377): a, c, t, g, unknown or other
  misc_feature (377)..(377): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtcgccagatgtgtcatccagatcgaccctagtcctccatcccgtccctgtcctgnactctatacggagacagactccacactcacttcggaccggtcgacggtcgaagaaccagttacgcgtaattntaagtctagtaagttcggttaactacgaacggaaacaaaaaccggagggaacctaacccggtaaccccttaaacgtccttcgacgttaccccgtacgtagttaacnccgtaaccttacccgtaacggtttacggaaaaccgggtaccggggtaccctaacgtaacgtaacgggttacgtacgggttagggtaaacgggtcggtaccgttacggtacggggttaaacgttacggtttaaccttttttaaacccgttaccctaaacgttaaccggttacccgaaggtaaccgggtacggttacccgttacggaccccgtaacgggtacccttaacggaaacgtaaccgttacgttaacgaaaacccttaacttaaaccgttttaacgttttacggaaccgtttaaccttaaacgtaggttttaacttaggtaaccgttaaccgtttccccgacccgtttaccggttaaccccgtttaggggttacccccgggggggttaaaggggaaacccggtttaaacgggggacggttaaagaacccgtttaaacggaaacggttaccgggttaaccggg

SEQ ID NO: 72829 - DNA, 791 bp, Homo sapiens
  misc_feature: GYAE6OF01DA6FQ.52.32.C10.1.454.CMB.1.raw
  modified_base (174)..(174): a, c, t, g, unknown or other
  misc_feature (174)..(174): n is a, c, g, or t
  modified_base (182)..(182): a, c, t, g, unknown or other
  misc_feature (182)..(182): n is a, c, g, or t
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
  modified_base (662)..(662): a, c, t, g, unknown or other
  misc_feature (662)..(662): n is a, c, g, or t
tcagcgcagtacgacacgaccggtgctcgatttagtatagacatcaacacacaaagggggcaggagtcacgtcccaaccaggacacagcatggacatgagggtccctgctcacgctcgtgggctcctgctgctctggctctcgaggtgccagatgtgtcatccagatcgacccngtcctccnctccctcctgtctnctatctaagtacggaanaacagaactaccactatccgtacgtcggccgggactaaggtacgaacgtactagttagactattacgtacgtcgtaaggtacttacggttaacacgaaacggtaaaccgaaaaccggaggaaccctaacccggtaccccttaaccgtcctacgtaccgttacccgagtacgtccgacctccgttaaccgtttaacggttaaacggaaccgggtaccggtacctaaaggtaacggttacggttacgaggggtttaacggacgttacgggtaccggttacgtaacgggtaactttaccgttttaaccgttttaaccttaccgaaccgtaaggttaccgaacgttacgggacgttaccgtaggaacccgttacgtaaccgtacggtaaataccggttacttaaccgaacggttttaataacgtttttaaccgacgttaactgtaaaccggtntaacggttactacgttaccccgttaccgtacccgtccgttaacccgggttcgggggtaccgggggtaacccgggtaaaggccggggttaacaacccggtagtaacccggaagtttcccgggtaaacggg

SEQ ID NO: 72830 - DNA, 685 bp, Homo sapiens
  misc_feature: GYAE6OF01CO5XO.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatcctccctgtctgcatctataggagacagatccaccatcacgttggccgggagacgtcgaagactattacgctagtagtatcgtagtaattggtatacaacgaaacaaaaccgagggaccaccgacccctaaactccgtagactcctcgatcgctactcctaacgttacggaaacgtcgggtaccaagttacgaaggtttcgaggttacgggtaaggtcggtcgtacggtacggggtacttaacgtttactttttaaccgttacgaaaccctaagttcgaacgtacggtacggtctagggtacctacggaccttaagaacgtactaacgtttacgaaccttaaagtactttaacgttacgttaccgtaactaaacgttacgttaagtacgtaacgttaccgttcccgtacccgtacccggtttacgttacccgggggtttacggggaaccgggggttaccgtaagggtacggtaacgtaacgtaacggtaacggtacggtaaccgg

SEQ ID NO: 72831 - DNA, 769 bp, Homo sapiens
  misc_feature: GYAE6OF01DQK6F.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcaggtgccagatgtgtcatccagatcgacccagtcctccatccctcctgtctgcatctagtaggagacagactcacctagtctacgttcggccggagagtcgaagactaagttagctatgtatcgtagtagttggtactacgaacgaaccgaaaaaccgacggggaaccaaccggtaacccccttaaaccgtccttacggtaaccttacccgtacgtacgtcggtacctaacgttacccgttaacggtttaaacgggaaacccggtacggggttaaccctaacggttaaccgtaacggtttacggaacgggtagggtaacggttaccgggtcgttaacgggtacggggtaaccgttaacggtttttaaccgtttttaaccctttacgaaccgttaactaccggaacggtaccgtacggtacgttacgtaccgtaaccgtaccggtttaacggaaacgtacgtttaactacgtaaacctaacttaactttaacgttaccgtagtaactaacgtattacgaacgttacgtaccgttaccctacccggtacgttaccggttaccgggttaccgggggaaccggggtaacgtaacgggtaggaaaccgtagtaaccgaaggtccgtaacggg

SEQ ID NO: 72832 - DNA, 682 bp, Homo sapiens
  misc_feature: GYAE6OF01BU2A6.52.32.C10.1.454.CMB.1.raw
  modified_base (232)..(232): a, c, t, g, unknown or other
  misc_feature (232)..(232): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctagtaggagacagaatcacctatcacttggaccggngagtcgagacattagcatgtatctgtaattgtatcgagaccaaaaaccgagggtaccacggtacccctaaactccgtagacttcctacgatcgccattcctacgtttacggaaaccgtacggggtacccatacgtaaggttccgagggttcggaaggttcgggcttacggtacgggtaacagtttactttttacgttacccaactactacacgggtaccgagggtcctcggaccacgtacccgtagaaaccggtataccggttagacctaaatactttacgtttaaccgtagtaaccaacgtaagttacgttagacgttaccgttcccgttaccccggtcccgtttaccggttacccggggttttcccgggggaccgggggggttaaacccgtaaggggttacggggaacggttaacgtaacccggtaaagggttccccggttaaagggg

SEQ ID NO: 72833 - DNA, 1028 bp, Homo sapiens
  misc_feature: GYAE6OF01ENHQW.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatcgacccagtcctccactcctccctgtctgctatctataggagacagaatccaccatcacgttcggccgggcgtaggtaccgagtaccgtaattagactagttcgttacttccgttaggttaaagttttagggttaactacgaaaccggaaacccgaaaaaaacccgggtacgggggaaacccgtaacccggtaaacccccccttaaaaccgtttcccgttaggtaaccccgttcccgttaaccggaacgtttcggaaccctaaacctttaccccgttaaaccgttttaacggggggaaaacccggttaacccggggggttaaccccaaacgtttaaccgggtaaaaaccggtttcggtaaacgggggttaaacggggttaaacggggttacgggtaacccggtttaccggggttaacgggggtaaccgtttaaacgggttttaaacttttttttaccccgtttaaacccgtaaacccgtttaacgtaaccggtaaacccgggttcccgggtaaaaccgggtccggtttaaccgggtaacccggtaccggtttaaaccccgggttaagggtaaaacccggttaacccgtttaaacggtttaaacccgtaaaccgtaaaaccgttttaaaacggtttttaaccgttaaacccgttacccgggtttaaaaccggaaacctttaaagggttttaaaccgttcggttaaaaaccgttccggtttacccccctaccccgggtttacccgtttaacccggggtttacccccgggggtttaacccggggggtacccgggggggggtaaacggtacggggggtaacgtaaacgggtaaccgtaaccggtaaacccggtacgggttaaacccgg

SEQ ID NO: 72834 - DNA, 535 bp, Homo sapiens
  misc_feature: GYAE6OF01CGO6C.52.32.C10.1.454.CMB.1.raw
  modified_base (159)..(159): a, c, t, g, unknown or other
  misc_feature (159)..(159): n is a, c, g, or t
  modified_base (249)..(249): a, c, t, g, unknown or other
  misc_feature (249)..(249): n is a, c, g, or t
  modified_base (445)..(445): a, c, t, g, unknown or other
  misc_feature (445)..(445): n is a, c, g, or t
  modified_base (496)..(496): a, c, t, g, unknown or other
  misc_feature (496)..(496): n is a, c, g, or t
  modified_base (498)..(535): a, c, t, g, unknown or other
  misc_feature (498)..(535): n is a, c, g, or t
tcagcgcagtacgacacgaccggtgctcgatttagtatagacatcaacacacaaagggcagtcgagacattagcatgtatctgaattggtatcagacaaaaaccgagggacagcccctaaactcctgactcctcgatgcactccctatttaggaaacgnggggtcccatcgaaggttcagtggaagtggctgtgggactagtatttttacttacacatcagcaggctgacacggctagaagactagttnacaatattacttaactgtacaactagtatagagttactcctaccgtcttacctacgggttcggggacgggggtaactagggtacgagtactacgaaggacgtaacgtggtcggtacacgaccgaacgtacttcggttccgttacttaccggacttttccccgacccgtctaagtcctaagtaagtactacgtaccnggtacgtacgaggccgggttacgaggaccggtacgacgacttaacgagacngnnnnnnnnnnnnnnnnnnnnnnnnnnnnnnnnnnnnnn

SEQ ID NO: 72835 - DNA, 655 bp, Homo sapiens
  misc_feature: GYAE6OF01BA3NI.52.32.C10.1.454.CMB.1.raw
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (613)..(613): a, c, t, g, unknown or other
  misc_feature (613)..(613): n is a, c, g, or t
  modified_base (618)..(618): a, c, t, g, unknown or other
  misc_feature (618)..(618): n is a, c, g, or t
  modified_base (621)..(622): a, c, t, g, unknown or other
  misc_feature (621)..(622): n is a, c, g, or t
  modified_base (624)..(626): a, c, t, g, unknown or other
  misc_feature (624)..(626): n is a, c, g, or t
  modified_base (628)..(632): a, c, t, g, unknown or other
  misc_feature (628)..(632): n is a, c, g, or t
  modified_base (634)..(655): a, c, t, g, unknown or other
  misc_feature (634)..(655): n is a, c, g, or t
tcagcgcagtacgacacgaccggtgctcgatttagtatagacatcaacacacaaagggcgagtcgagacattagcatgtatctgaattggtatcagacaaaaaaccgagggacacgcccctaaactcctgactcctcgatgcactcctacgtttaggaaacgcggggtcccatcgaaggtttcaggtggaagtggctcgtagggactagttactttttacttccacctatcagcaggtccttaggtacgcctaaggaaacgactagttcgaactaacgtaatttacttacgtcgtaacaagtagttacgtacgtacgttccgtcccgtcctacgttaccggttaccgggggttaccggggggaacgggggtaacgtaaggggtacggaacgtaccgtaaccggaaacggtaccgttaaccggttcggtacggtacccgtaccgaaccgttaccttacgtttccgttacgtttaccttaccgtacccgtttccccgacccgttacttacgttaccgtaaggtaaaccgttacgtaccggtaccgttacggtacggttaccggggacgggtcgggtacgtacgggaccggtaacggaccgtataggnancgtagncgcgncgnncnnnannnnncnnnnnnnnnnnnnnnnnnnnnn

SEQ ID NO: 72836 - DNA, 781 bp, Homo sapiens
  misc_feature: GYAE6OF01B1H71.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctccgtgggctcctggctgctcgtggctctcgaggtcgccagatgtgtcactccagtctcgaccctagtcctcctactccctccgtgtcgtcgcctatacgtaagtacgggagaacgacgtaactccaaccgtattccgaacggtttcggggacccgggacggtacgtaccggtaagtaaccgtagttaacgcttagttacgtaacgttcggtaaggttaaggttggtaacgtaccgtaaacgtaaacccgaaaaaccggaccgggaaccaacccggtaaccctaacctccgtacgtaccctaccgtacgtactacgtcctacgtacccgttaacggtaacgggaaaccgtaccgggtacctaacgtacgtaacggttacgtaggtacgggttaacggtgtacggttacggtacggtaacgttacgtttacgttttacctaccgtactacgtacgaagtcgtagtacctacggctaacgtcgtaagtaaccgattacgtacgaaccttactaacgttagtacgttacgaacttaacggtactaagtacgtaacgttccgtaccgttaccgttccggttaaccggttaaccggggtttccggggggaaaccggggtacgttaagggacggggtaactaccgggtaacgtaaccgggtacggtaacccggg

SEQ ID NO: 72837 - DNA, 631 bp, Homo sapiens
  misc_feature: GYAE6OF01DJCZJ.52.32.C10.1.454.CMB.1.raw
  modified_base (146)..(146): a, c, t, g, unknown or other
  misc_feature (146)..(146): n is a, c, g, or t
  modified_base (246)..(246): a, c, t, g, unknown or other
  misc_feature (246)..(246): n is a, c, g, or t
  modified_base (533)..(533): a, c, t, g, unknown or other
  misc_feature (533)..(533): n is a, c, g, or t
  modified_base (571)..(571): a, c, t, g, unknown or other
  misc_feature (571)..(571): n is a, c, g, or t
  modified_base (617)..(617): a, c, t, g, unknown or other
  misc_feature (617)..(617): n is a, c, g, or t
tcagcgcagtacgacacgaccggtgctcgatttagtatagacatcaacacacaaagggggcaggagtcagtcccaaccaggacacagcatggacatgagggtccctgctcagctccgtgggctcctgctgctctggctctcaggtnccgagatgtgtcactccagatcgaccctagtcctccactccctccctgtctgctatctagtaggagtaacagatccacctactccgacgttcggccgggngtacgtcgaaggactaattaacattgtatcttagtaattggtactcaacggtaacaaacggaaaccgaacgggaaacctaacccctaacgtcctagtaccgttcctacgatcgactactacgtaagtttaacggaaacggtaccggtcctacgttacgtacggtacgaggtagggtacgtcggtactcgggtagtacgttaacgtttactttacccttacgaccgtacgtccactacgtactagtactacgcgtaagatagttagtacactaactattaacgtttanaacgtactaagttattagcttaactcctcctacccgtntaaccgttaggttacggacggtacgggtacgaggtcgtaacacgtnaacggcgtagtcgg

SEQ ID NO: 72838 - DNA, 819 bp, Homo sapiens
  misc_feature: GYAE6OF01EXW1E.52.32.C10.1.454.CMB.1.raw
  modified_base (133)..(133): a, c, t, g, unknown or other
  misc_feature (133)..(133): n is a, c, g, or t
  modified_base (158)..(158): a, c, t, g, unknown or other
  misc_feature (158)..(158): n is a, c, g, or t
  modified_base (283)..(283): a, c, t, g, unknown or other
  misc_feature (283)..(283): n is a, c, g, or t
  modified_base (413)..(413): a, c, t, g, unknown or other
  misc_feature (413)..(413): n is a, c, g, or t
tcagcgcagtacgacacgaccggtgctcgatttagtatagacatcaacacacaaagggggcaggagtcagtcccaaccaggacacagcatggacatgagggtccctgctcagctccgtgggctcctgctgctntggctcgtcaggtcgccagatggtntacactcagatccgacctatctccactcccttcctgtcgtagactatcgttaagacgagacataactccacctactcgtaccgttcggaccgggtagtacggacgtaacgtaacgtacgttaacncgtaagtcgtttataccgttaaggtaacgtttacgggtacttaaccgaaaccggaaaccctaaaaaaccgggacgggtaaccctaacccgtaaccccctaaacgttaccgtacctaacgtcctaacgtanaccgtacctaacttacccgtaacgttaaggtaaacccgggcggttaaccctagttaccggtaacggttacgtaaacgggtggtaaacgggtcgtacggtcgggttaacggtactttaacggtttaccttttagttacccccaagttaccgtaccgacgtaccggtaacgggttcctaggtaccggtaaccgttaacccggaagttaaacgtacgtttaacgtaacccggaacttaaaccgtaatttaacgttaccgtaactaacgtaaggtaactttacaacgttacttaaccggtacccggttcccgtacggttacccggggtttacccggtttaccgggggggaaccgggtaacggacggggttaaacggacggtaagtaccggtaaacggggtcgttaccggg

SEQ ID NO: 72839 - DNA, 717 bp, Homo sapiens
  misc_feature: GYAE6OF01BXIYK.52.32.C10.1.454.CMB.1.raw
  modified_base (141)..(141): a, c, t, g, unknown or other
  misc_feature (141)..(141): n is a, c, g, or t
  modified_base (146)..(146): a, c, t, g, unknown or other
  misc_feature (146)..(146): n is a, c, g, or t
  modified_base (545)..(545): a, c, t, g, unknown or other
  misc_feature (545)..(545): n is a, c, g, or t
  modified_base (642)..(642): a, c, t, g, unknown or other
  misc_feature (642)..(642): n is a, c, g, or t
  modified_base (697)..(697): a, c, t, g, unknown or other
  misc_feature (697)..(697): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctnaggtnccagatgtgtcatccagatacgacccagttcctaccactcccttccctgtctcgctatctaagtaggacgacaagaactccaacctactccgtacgttcgggccgggtacgaggtacgaacgtaactattacgctagttgtattacgtagtaagtttcggtactacgaacgtaaaccgaaaaccggacggacccgtaaccgtaacccctaacgtcctacgtaacctacccgtacgtacgtcgaccctaccgttaccgtaacgtttaacgggaaacccggtaccgggttaccccgtaattaccggtaaggttacggtaggtacggggtaacggttcgggtacgtacgggtagggtaaccgttaagttttacccttttacgttaccaaccttagtaaccgngggtacgacggtaccgtacggtaccgaccgtaccgtaagtaaacctcgtacttacgaacttaacgttattacttaacgtacgtaactagtacgtagngtactcctccgtccgtaccttggtacccgggtcggggaccggtaagacgggtaancgtacgagaccggtggtacg

SEQ ID NO: 72840 - DNA, 499 bp, Homo sapiens
  misc_feature: GYAE6OF01AV9K6.52.32.C10.1.454.CMB.1.raw
  modified_base (235)..(235): a, c, t, g, unknown or other
  misc_feature (235)..(235): n is a, c, g, or t
  modified_base (272)..(272): a, c, t, g, unknown or other
  misc_feature (272)..(272): n is a, c, g, or t
  modified_base (373)..(373): a, c, t, g, unknown or other
  misc_feature (373)..(373): n is a, c, g, or t
  modified_base (459)..(459): a, c, t, g, unknown or other
  misc_feature (459)..(459): n is a, c, g, or t
  modified_base (462)..(462): a, c, t, g, unknown or other
  misc_feature (462)..(462): n is a, c, g, or t
  modified_base (465)..(499): a, c, t, g, unknown or other
  misc_feature (465)..(499): n is a, c, g, or t
tcagcgcagtacgacacgaccggtgctcgatttagtatagacatcaacacacaaaggggcgagtcgagacattagcatgtatctgaattggtatcagcaaaaaccagggacagccccctaaactcctgatcctcgatgcatccactttggaaacaggggtcccatcaagttcagtggaagtggctctgggacagtattttactttcaccatcagcaggctgctagcctgaagacnttgacaactatattactgtacaacagtatgatagtcncccgtctactacgtttccgggacggggggtaccaagggtaggagatacgaagcgaaacgtgtggactcgactaccgatctcgtacttctacgtccttcccncgtaactccgttagactagtaaccgtactacgtccgtgggaacggccggggtacttcggacgtaacgggcgacccgtagttagatnacngtnnnnnnnnnnnnnnnnnnnnnnnnnnnnnnnnnnn

SEQ ID NO: 72841 - DNA, 833 bp, Homo sapiens
  misc_feature: GYAE6OF01BB61C.52.32.C10.1.454.CMB.1.raw
  modified_base (148)..(148): a, c, t, g, unknown or other
  misc_feature (148)..(148): n is a, c, g, or t
  modified_base (196)..(196): a, c, t, g, unknown or other
  misc_feature (196)..(196): n is a, c, g, or t
  modified_base (212)..(212): a, c, t, g, unknown or other
  misc_feature (212)..(212): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcgaggtcnccagatgtgtcatccagatcgacccagtcctccactccctccgtgtcngcatactagtacgganaacagactaccactatactacgtcggccgggacgtacgcgaagtactattacgctatcgtatacgtacgttaagttaggttacacaaccgaaactaaaaccggcgggaaccctaaccggtaaccccccttaaacttcccggtaagtaccccgttaccgtacgtaacgtccggtaaccttaccgttaccccgtttaaagggtttaaaccgggaaacccgggttaccccgggtaaccctaacggttaaccggttaaagggtacgggttaaacggtaggggttaacggttcgggtacccgtttacgggtaacggtaacgtttaacgttttaacctttaccgttaccaacgtacgttacgaccggtagacccgggtactacggtaccgaacgggttaccgaagtaaacgttcccgttaagtaccgaaacgtttaaccgtaattttaaaccgttaccggttaactaaaaccggtaaccggttaattacggttaccgtaaccttcccggtaccctttaccccggtggtttaacccccgggggtttacgggtccgggggggaacccgggttaaagggacgggttaccaagggtacccggttaaacgtaaccggttacgggtaaccggg

SEQ ID NO: 72842 - DNA, 858 bp, Homo sapiens
  misc_feature: GYAE6OF01CCPOK.52.32.C10.1.454.CMB.1.raw
  modified_base (118)..(118): a, c, t, g, unknown or other
  misc_feature (118)..(118): n is a, c, g, or t
tcagcgcagtacgacacgaccggtgctcgatttagtatagacatcaacacacaaagggggcaggagtcagtcccaaccaggacacagcatggacatgagggtccctgctcagctccgngggctcctgctgctctggctctcgaggtgccagagtgttgtcactccgagactaccgacccagtcctcccacttcccctcctgtctcgctacttactagtaaggacgaacaagtaactccctaaccgtacttaccgtaccggtttccggggaccccggggacgtaacgggtaccggaacgtaacctaaagtttacgaccgttaatttacgggttcttaaacggttaggtttaaaacgtttagggttaacctaaccgtaaaccgggaaaaaaacccgtaaaaacccggggacggggttaaaccccaacccgtaaacccccctttaaacctccggttagtaaccccgttccgtacgtactaccgtacctccgttaacccgttaacgggtttaacgggaaacccggtccgggtaccctagttaacgtaacggttgacgggttagggtacgtcgtcggttagggtacggttaacgttacgttttaaccttttcctaaccgtacctaacgtacgacggtccgtaggtaccgtcgtacgaccgtacgtaagaacggttcaacgttactaaccgtaaatttcgtaaccttacggaacgtaacttaacggtactcggttaataccggtttccccgaccccgttcccgttacgggttacccggggttaacccggggtaccccggggggaagggtaaacccgggttaggtacgaacggttaaccgacggtaaacccggtaggtaccgggg

SEQ ID NO: 72843 - DNA, 792 bp, Homo sapiens
  misc_feature: GYAE6OF01DVNAE.52.32.C10.1.454.CMB.1.raw
  modified_base (146)..(146): a, c, t, g, unknown or other
  misc_feature (146)..(146): n is a, c, g, or t
  modified_base (774)..(774): a, c, t, g, unknown or other
  misc_feature (774)..(774): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctgaggtnccagatcgtgtcatccagatcgaacccagtcctcccacttccctcccgtgtctcgctattacttaagtaggacgacagaactaccacctactcaccgttcggccgggagtacgtaccgaagtacgattacgactattagtatcgtagtaagttggtactacgaacggaaaccgtaaaaacccggacgggaacccgtaacccgtaacccccttaaacttcccgttaacgtacccttcccgttaacggtactacggtaccttaaccgttacccgttaaccgggtttaaaccgggaaaccgggttacccggggttaacccctaacgttaacgggttaaacggtttacgtaacggggttagggtacggttacgggtaccgttacggtacggggtaacttaacggtttttaaccttttacctttaccgaacctaacgttccgaaccgtagtaccgggtctacggtacctaacggtccgtaagtaaacggttaccctaaggtttaccgaacttaacgtagttttaacgtacgttaacgtacaacgttagttactagtacctaccgtccctacccgtaccgttaccggtacgggttccgggggaacgggtttacaaagggtcggtaaacaacggngtaaaccggtgtaacggg

SEQ ID NO: 72844 - DNA, 806 bp, Homo sapiens
  misc_feature: GYAE6OF01AJZPK.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccacttccctccctgtctgctatctagaggagacagaactcacctatcctacgttcggccgggacgaggtacgagtaacattagctatagtacttacgtagtaagttggtaatacctaacgaaccgaaaaaccggacgggtaacctaacccggtaaccccttaaaacccgttccgtacgtaccgttcccgttacgtacgtacgtacctaacctttacccgttaaacggttttaacggtaaaacccggggttaccggggtacccctaaggttaccggttaaacggtttccggtaagggttacgggtaacggttcggtacgttaccgggtacgggtaacgttacgttttaaccgtttttaacctttaccgtaaccgttacgtaccgacggtacgtaccggtcgtcgtaccgtacggtacgtaacggtaaacgtcgtaacgttacgtaactaaacgttaactttaacgttaaccgttacgtaaactaaccgttaaggttaacgttaaggtaccgttaccgttaaccccgtcccggtttacccgttaccgggttaccccggggtttaccgggggaacccgggggttaaccgggagggttaacggtacgtaacggtacgaacggttaacgtacggg

SEQ ID NO: 72845 - DNA, 895 bp, Homo sapiens
  misc_feature: GYAE6OF01A1TMF.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcccgtggggctcctggctgctctggctctcgaggtgccagatgtcgtcactaccagactgacccctagtcctacctactcccttcctgtccgtctacacttacgtaagtacggagacaagtaactccaacctctaccgtacgtccgggccgggcaaggtcgaacgataagtagacttatcgttattacgtaggttaattggtaactacgaacgtaaccgaaaaccggaggaacctacccggtaacccctaaccttccgtaacgtaccttacccgtacgtacgttacggacccttaccgttaacccgttaaccgggtttaacgggaaacccgggttacgggttaccccgtaacggtttaaaccggtaacggtttaccggtaaggggttaacggggaacggtttacggacccggtttaacggggttaccgggtaacgtttaagttttaccccgtttttaaccgttactaaacccggttacgtaccggaacgttacggaccggttccggaacggtaaccgtacccggtacggtccggtaaaacgttaccggttaattaaccggtaacctaaacgttaaccgtttaacgtttacccggttaaattaaaccggtaacgttaacggtttaacggttaaccgttaacgttccggtttacccccgttacccggtttaccgttacccggggttttacccggggggttaaccggggggggtacccgggtaacgggttaacggggttaccgaaggttaaacggtacggtaacccggttaaggttaccccggg

SEQ ID NO: 72846 - DNA, 699 bp, Homo sapiens
  misc_feature: GYAE6OF01E2B9D.52.32.C10.1.454.CMB.1.raw
  modified_base (343)..(343): a, c, t, g, unknown or other
  misc_feature (343)..(343): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtccatccagactcggacccagtcctccactccctcctgtctgcatactagtaggagacagtaactccacctatcctacgttcggaccgggtcgacgtcgagactattacgcattcgtatcgtatagttgtatcaagaacaaaaccgaggaccaccgaaccccttaaactccctacgacctccgtacgntacgacctacgttaccctaaggtttaacgggaaaccgtaccgggtacccagtaccgttaacggttacgtacgggtacggtaacgtccggtcgttacgggaacgggtaccttaaggtttaacctttttacctaccaacctacttaccggacgtaacggtcgcgtacgacccgtacgtaccgtaagaacgtactagtttacgaactaaacttctttaacgttacgttacgaactaagtaagttactacgtacgttacccgtccgttacccgtcccgttacgttacccgggggtttacgggggaacccgggttaacggacggttacggaagttaccgaacggtaagtaccggttaacgg

SEQ ID NO: 72847 - DNA, 816 bp, Homo sapiens
  misc_feature: GYAE6OF01D4VQQ.52.32.C10.1.454.CMB.1.raw
  modified_base (154)..(154): a, c, t, g, unknown or other
  misc_feature (154)..(154): n is a, c, g, or t
  modified_base (229)..(229): a, c, t, g, unknown or other
  misc_feature (229)..(229): n is a, c, g, or t
tcagcgcagtacgacacgaccggtgctcgatttagtatagacatcaacacacaaagggggcaggagtcagtcccaaccaggacacagcatggacatgacgggtccctgctcagctccgtgggctcctgctgctctggctctcgaggtgccagtntgtgtcatccgagatcgacccagtcctccactccctccgtgtcctgacctatctagtaggagacagaactcactntacgtacgttcgggccgggagtacggtacgaagtacctaagttacgaccttaagttcgttaacttcgtaagttaagttcggttaacaccgaaacggaaaaccgtaaaaccgggacgggtacccaaccccggttaaccccttaaacgttccctaggtacccttacccgtaggtacctgtaccctacgttaacccgttaagggttaaccggaaccggtacgggtaccctaaggtacggtaaggtcgtaagggttacggtacggttcggcgttaacgggtagggtaacgttacgtttaacgttttaccttactaaccgtacgtaccgacgtacggtacgtccgtcgtccgtacgtacggtaagtacgtaacgtacgtacgtaacgtaacgtaacgttacgttacgttaacgtaacgtaacgtagttacttaacgggggggggggttacttacccggttacccgtacccggttacccgtttaccgggttaccggggttacccgggggtaacccgggggtaaccggggttaaacggggtacggttaaacggtaaaccggttaaacccggtaaaccgggttaccggtacgggg

SEQ ID NO: 72848 - DNA, 771 bp, Homo sapiens
  misc_feature: GYAE6OF01E00J6.52.32.C10.1.454.CMB.1.raw
  modified_base (146)..(146): a, c, t, g, unknown or other
  misc_feature (146)..(146): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtnccagatgtgtcatccagatcgacccagtcctccactccctcctgtctgctatctagtaggagacagaactccaccatcctacgttcggcccgggtacgacgtacggaacgtaccgtaatttacggctaagttagtatacgtagtaagttaggtaactaccgaacggtaaaccaaaaaaccggacggggaacctaaccccggtaaaccccctttaaaacgtcccgtacgtaaccctaccgtacgtactacgacctacttacccgtaacgttttaacgggaaaacccggttaccggggtacccaacgttaacggtaaggttaccgtaagggtaagggtacggtacggtccgttacgggtagggtaactacgttttaacttttaccttaccgaaccgtactaacgacggtacgtaccggcgttacgaccgtacgtaccgtaaggtaaccgtactagttacgaactaacgtacttacgttaactagtaaccaacgttagtaacgtagtaaccgtttccgtacccgttacccgtctttaacccgggttccccggggtttacggggggacccgggggtaaacgtagggtaaccgggtaactacggttaaaccgacggtaccgggttaacgg

SEQ ID NO: 72849 - DNA, 918 bp, Homo sapiens
  misc_feature: GYAE6OF01AHI2D.52.32.C10.1.454.CMB.1.raw
tcagcgcagtacgacacgaccggtgctcgatttagtatagacatcaacacacaaagggggcaggagtcagtcccaaccaggacacagcatggacatggagggtccctgctcagctccgtggggctcctgctgctcgtggctctcgaggtcgacccgagattgtcgtactatccgaagtacgtaccggaacccctagttcctccctaccttccccttcccgtgtctcgtactagttaccgtaagtacgggacgaacgtaacgaaacctccgtaaccgtacttaccgaccgggttcggggacccggggtacggtaacggtaccgggaacggtaacttacgttaacggaccttaaagttcgttaacgttcgtaagggttaagtttcggaacgtaaccgaaacggaaaaccgaaaaacccggtacgggaacccttaaccccggtaaacccctaacgttccgtaacgtaccctttaccggacgtagtaccccgtacttaccgttaacccggtttaacggttaaaccgggaacccgggttacccggtaacccgttaaacggtaaccggtttaaccggggttacgtaaaggggttacgggtaacggttcggggtacccgttacgggttacgggttaacgttttaacctttaacgtttttaccctacccgtaaacgttctaaacggaccgtacggtaacggggttccctaccggtaacgtaaccggtacggtaagttaaacccggtatttacgttaacgaaaccgttattaaattaccgttaacggtactaacgtaacgttaagtacgttacgttccgtaacccgttacggtccccgttaggttaacccgggttacggggggtaccggggtacccggggttaaggtacgggtacgtaacggtacgaaccggttacgggactacggg

SEQ ID NO: 72850 - DNA, 735 bp, Homo sapiens
  misc_feature: GYAE6OF01C3GUC.52.32.C10.1.454.CMB.1.raw
  modified_base (148)..(148): a, c, t, g, unknown or other
  misc_feature (148)..(148): n is a, c, g, or t
  modified_base (216)..(216): a, c, t, g, unknown or other
  misc_feature (216)..(216): n is a, c, g, or t
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (343)..(343): a, c, t, g, unknown or other
  misc_feature (343)..(343): n is a, c, g, or t
  modified_base (501)..(501): a, c, t, g, unknown or other
  misc_feature (501)..(501): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcgaggtnccagatgtgtcatccagactcgaccccagtcctccacttccctccctgtctgctatctagtaggacanagactcaccatcacgtcggccggngagtcgaagtacaattacgactattcgttatcgtagtaagttcggtactaccgaacgaaaccgaaaaccggngggtaacccacccgtacccgtaaactccgtntaaccgttccccgagactccgactaccgtaccgttacgttaaggaaaccggcggtacccaagttcgaagttgacgggtgtaacggtgtacgtacggtacggtaacgttactttacttttaccgttaccaacctagttaccgaggttaccgcggttacncggtaaccgacgtaccgtaagtaacgtacccgttagtaccgtaaacttaacgtaactttaagttaccgtaacgtaacgttaaacgtagttaccttaacggtaccgttaccctacccggttaccccggttacttaccccgggggttaacccgggtttacccgggggggaaccggggttaacggtaacggggtccggtaaacgtacggttaacccgaacgggtttacgttaacggg

SEQ ID NO: 72851 - DNA, 813 bp, Homo sapiens
  misc_feature: GYAE6OF01ARTHO.52.32.C10.1.454.CMB.1.raw
  modified_base (147)..(147): a, c, t, g, unknown or other
  misc_feature (147)..(147): n is a, c, g, or t
  modified_base (172)..(172): a, c, t, g, unknown or other
  misc_feature (172)..(172): n is a, c, g, or t
  modified_base (179)..(179): a, c, t, g, unknown or other
  misc_feature (179)..(179): n is a, c, g, or t
  modified_base (249)..(249): a, c, t, g, unknown or other
  misc_feature (249)..(249): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcaggtnccagatgtgtcatccagatcgaccnttcaccntccctcctgtctacgctactacgtaagtacggagactagaactcacctatctacgtcggaccggccagtnaacgtaattacttaaagtagggttcggttacggtctaggtacgttacacgacgtaacgaactaaaccggaacggggtaaaccctaaacccccggtttaaactccggttaactaagttaacgttaaacggttaacgggtaccgtttagtttaaacggtttaaacgggtaaacggggtttccgggtttaccccgtttaggggtaaacgtaccgggtacgggtacccgggtactaaggggtttacggtagtacgggttaaacggggaactagggttaaaccttcccactttccaaaccggtaccgtaacttaactaaccggaaccgttccgacgtacccgacgttccggtagttaaccgttgttagttaccgtacttaactttaacggttccactaccgtaaccttaaggtactttaacggtacttactttacccgtacgttacccgtaacccgttccggtttccggacccgttaaccggggaaactaacgttttaccgggaaaactttacggggttaaaccccgttacggggttaaaagttcccggtaggggtttcccggttaccg

SEQ ID NO: 72852 - DNA, 528 bp, Homo sapiens
  misc_feature: GYAE6OF01EZKBE.52.32.C10.1.454.CMB.1.raw
  modified_base (446)..(446): a, c, t, g, unknown or other
  misc_feature (446)..(446): n is a, c, g, or t
  modified_base (497)..(528): a, c, t, g, unknown or other
  misc_feature (497)..(528): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggagtggctcgtgggacagtatttttacttcacctatcagcaggcctggcagcctagaagactattgacaaactattacttacctgtacaacagtatgattacgccttcccggcttcgtacgttttccgggggacgggggaccaaggggttcggagactacgaaacggtcggtaacgttggtcggtcgttgacccgtaacctagtttcctcggttcctttcgaacctttccccgttccccgactattacctagtaacttaacgtaaccggtnttccgacgttgggaacggcgggtctacgggcgaacgggcgacttacgagtnnnnnnnnnnnnnnnnnnnnnnnnnnnnnnnn

SEQ ID NO: 72853 - DNA, 831 bp, Homo sapiens
  misc_feature: GYAE6OF01D0M96.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctccgtgggctcctgctgctctggctctcaggtgccagatgtgtcatccagatcgaccctagtcctcctacttcccctccctgtctcgctatctagtacggagacagtaactccacctatcctacgttcgggccgggacgacgtacgaggacctagttacgactattcgtattcgtagtattggtactacgaacgtaaccgaaaaccggacgggaaccctacccgtaaccccgttaaaaccgtccgttacgtaccttaccgtaccggtaactcgtacctaccgttacccgttaaaccggtttaacgggaaaccggttaccgggggtaccctaacggttaaccggtaacggttaccgtagggtaacgggtaacggttcggtacggttacgggtacggggttaaccttacggttttaacctttttaacccgttacctaacccggttaactaccgtaacggtacgtaccgggttctacggtaccgaaccgtaccgttacgtaaacgtaccgtagttacggaaaccttaaacgttactttaaaccgtttaccgttaactaaccgttaaccttaaggttaacgttacggtaccgttaccggttccccttaccccggttacgttacccgggttacccggggttacccggggggaccggggtaaaccggttacggggtacggtaacggttaacccgtaacgggtaaacccggtaacggttaccggg

SEQ ID NO: 72854 - DNA, 696 bp, Homo sapiens
  misc_feature: GYAE6OF01BKMPI.52.32.C10.1.454.CMB.1.raw
  modified_base (150)..(150): a, c, t, g, unknown or other
  misc_feature (150)..(150): n is a, c, g, or t
  modified_base (156)..(156): a, c, t, g, unknown or other
  misc_feature (156)..(156): n is a, c, g, or t
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (290)..(290): a, c, t, g, unknown or other
  misc_feature (290)..(290): n is a, c, g, or t
tcagcgcagtacgacacgaccggtgctcgatttagtatagacatcaacacacaaagggggcaggagtcagtcccaaccaggacacagcatggacatggagggtccctgctcagctcctggggctcctgctgctcgtggctctcgaggtcnccagtntgtgtcatccagactcgacctgtcctcctactccctcctgtctcgntacgtctagtaggactacaagtacctccaactnttaccgtacggttcggggcccggtacgacggtacgacgtactagttacgctagtnttacgtagtaggttacgttacgtataccgaaacgaaaccggtaaaaccggacggaacccgtaccctacccgttaacctccgtacgtactccgtacgcgtcaccgtctaccgtaacggttaacgaacgggtacggtaccctagtacgtaggtcggtaggtacggtacgtcggtacgtacggtaggtacttacgttttacttcctacctagtacgtcgacgtcgacgtctcgactacgtcgaagacctgtacgtacgaattaactagttactagttccgtaacacgttatacgtagttcccgtacttccccggttccgaccgttttacccgggtccgggggttaaaccgggggaggtaaccggtaagggttacggaaccgttacggtaacggacgggttcccgtacgg

SEQ ID NO: 72855 - DNA, 897 bp, Homo sapiens
  misc_feature: GYAE6OF01BEML7.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcaggtcgccagatgtgtcatccgagactgacccagttcctccacgttccctcccgtgtctgctattactagtaggactaacgaagtactccacctactccgtacgttcgggccgggtacgtagtaccggaagtacttaagtagcttagttagtacttcggttagtacgttaggtactacaaaccggaaacaaaaccggtacggaaccgtacccgtaaaccccttaactccgtacgtaaccgttcccgttcgaacgtccgaaccgttaccgttaacccgttaaacggggtttaaaccgggaaaaccggggttacccggttaaccctaacgttaccggttaaacgggtttacgtaacgggtaacgggttacggtaccggtacggttacgggtaaccggggtttaacctttaacgggtttttaacccgttttttaaccgttaccccgtaccgtttaacgtaacccggtaggtaacccgttagggtacccgtaccggttacccgggtaacccttaccgggtaagtaaacccgtttccggtaaaccgtttacctaaacccggttacctttaaacgtttacctttaaccgttaacgaaccgttaaacggttaaccgttttaactcgggttaacccgtttcgtaaccccgtttccccggtaacggtttccccgggttaaccggggttcccgggggtaaccggggtaacgttacggggtaaacgggtaagttaaccggtccgggtaaaacgtcgggttaaccgg

SEQ ID NO: 72856 - DNA, 729 bp, Homo sapiens
  misc_feature: GYAE6OF01A5LXN.52.32.C10.1.454.CMB.1.raw
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
  modified_base (285)..(285): a, c, t, g, unknown or other
  misc_feature (285)..(285): n is a, c, g, or t
  modified_base (586)..(586): a, c, t, g, unknown or other
  misc_feature (586)..(586): n is a, c, g, or t
tcagcgcagtacgacacgaccggtgctcgatttagtatagacatcaacacacaaagggggcaggagtcagtcccaaccaggacacagcatggacatgagggtccctgctcagctccgtcggggctcctgctgctcgtggctctcgaggtgccagatgtgtcataccagactcggacctagtcctccactccctccgtgtcgtcgctattacgtagtaggganaacaagtactaccactacgtctacggtcggaccgggngagtacgaagtactagttagctagtntactagtagtagttggtactaccgaacgaaacgaaaaccggacggtaaccaacccgtaaccctaacgtctacgaccttcgagtacgcgtactccttacgtaacggtacgggaaccgtaccgggtacctacggtaacgtaacggtacgagggttacggtaacggtccggtacttgggttaacggtaacgttacgtttttaacctttaccggttaacaaccggtacgtacggtaacgtaccgggtgacctacggtaccgaccggtaactaacgtaacggtacttaccgaattaaccgttaaancggtttaaactactcccgtaaatacggtatccttacgtacgtccggtacccttcgtaccttaggggtttaacccgggggacggggtaaccggggtaaaggttacggcgggtaaaaccttcgggaacgtacggtagggtaccgg

SEQ ID NO: 72857 - DNA, 384 bp, Homo sapiens
  misc_feature: GYAE6OF02JEU5T.52.32.C10.1.454.CMB.1.raw
  modified_base (380)..(384): a, c, t, g, unknown or other
  misc_feature (380)..(384): n is a, c, g, or t
tcagcgcagtacgacacgaccggtgctcgatttagtatagacatcaacacacaaagggcgagtcgagacattagcatgtatctgaattggtatcagcaaaaccagggacagcccctaaactcctgatcctcgatgcatccactttggaaacagggtcccatcaaggttcagtggaagtggctctgggacagattttactttcaccatcagcaggctgcagcctgaagacattgcaacatattactgtcaacagtatgatagtctcccgctcactttcgcgggggaccaaggtggagatcaagcgaactgtggctgcaccatctgtcttcatcttccgcatctgatatacgatcgctgagcgggctggcaaggcgcatagnnnnn

SEQ ID NO: 72858 - DNA, 389 bp, Homo sapiens
  misc_feature: GYAE6OF02GAST2.52.32.C10.1.454.CMB.1.raw
  modified_base (385)..(389): a, c, t, g, unknown or other
  misc_feature (385)..(389): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcgggcgggggaccaaggtggagatcaagcgaactgtggctgcaccatctgtcttcatcttcccgcatctgatatacgatcgctgagcgggctggcaaggcgcatagnnnnn

SEQ ID NO: 72859 - DNA, 474 bp, Homo sapiens
  misc_feature: GYAE6OF02I567J.52.32.C10.1.454.CMB.1.raw
  modified_base (274)..(274): a, c, t, g, unknown or other
  misc_feature (274)..(274): n is a, c, g, or t
  modified_base (347)..(347): a, c, t, g, unknown or other
  misc_feature (347)..(347): n is a, c, g, or t
  modified_base (434)..(434): a, c, t, g, unknown or other
  misc_feature (434)..(434): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagacaaaaaccnggacacgcccctaaactcctgatcctcgatgcatccacttgaaacagggtccatcaagttcagtgaagtgctntgggacagtattttacttcacatcagcaggctgcagcctgaagctattgcaacataattactgtacaacagtatgatagtctcccgntcacgttcgggcgggtacaaggtcgagatcgagcgtaacg

SEQ ID NO: 72860 - DNA, 485 bp, Homo sapiens
  misc_feature: GYAE6OF02HZEKX.52.32.C10.1.454.CMB.1.raw
  modified_base (322)..(322): a, c, t, g, unknown or other
  misc_feature (322)..(322): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacnggggtcccatcaaggttcagtggaagtggctctgggacagtattttactttcaccatcagcaggctgcagcctgaagcattgcaacatattactgtacaacagtatgatagtctcccgctcctacgtttcggcgggggaccagggtggagagtcagcgtaacg

SEQ ID NO: 72861 - DNA, 485 bp, Homo sapiens
  misc_feature: GYAE6OF02HZTPB.52.32.C10.1.454.CMB.1.raw
  modified_base (411)..(411): a, c, t, g, unknown or other
  misc_feature (411)..(411): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcagacaaaaaccagggacagcccctaaactcctgatcctcgatgcatccactttggaaacaggggtccatcaaggttcaagtggaagtggctcgtgggacagtattttacttcacctatcagcaggctgcagcctgaagacattgacaanattatactgtcaacagtatgatagtctccgctctacttcgggacggggacaagggtggagagtacagcgtaacg

SEQ ID NO: 72862 - DNA, 391 bp, Homo sapiens
  misc_feature: GYAE6OF02GN8PM.52.32.C10.1.454.CMB.1.raw
  modified_base (325)..(325): a, c, t, g, unknown or other
  misc_feature (325)..(325): n is a, c, g, or t
  modified_base (383)..(391): a, c, t, g, unknown or other
  misc_feature (383)..(391): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtggctgcacatcngtcttcatcttccgccatctgatatacgatcgctgagcgggctggcaaggcgcatagnnnnnnnnn

SEQ ID NO: 72863 - DNA, 513 bp, Homo sapiens
  misc_feature: GYAE6OF02H20RS.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccactttggaaacagggtccatcaaggttcagtggaagtgctcgtgggacagtattttactttcacatcagcaggctgcagtcctagaagacattcgacaacattattactgttacaactagtatagatagtcctcccgctacctacgtttcgggaccggggggtaaccctaagggtcgggaacggtagttacgacgcgtaacg

SEQ ID NO: 72864 - DNA, 500 bp, Homo sapiens
  misc_feature: GYAE6OF02HDE1L.52.32.C10.1.454.CMB.1.raw
  modified_base (203)..(203): a, c, t, g, unknown or other
  misc_feature (203)..(203): n is a, c, g, or t
  modified_base (227)..(227): a, c, t, g, unknown or other
  misc_feature (227)..(227): n is a, c, g, or t
  modified_base (323)..(323): a, c, t, g, unknown or other
  misc_feature (323)..(323): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccggngagtcgagacattagcatgtatctgaattggtatcagacaaaaaccagggacagacccctaaactcctgatcctcgatgcatccactttggaaacngggtcccatcaaggttcagtggaagtggctcgtgggacagtatttactttcacatcagcaggctgcagcctagaagacattgacaactataattactgtacaactagtatgtatagtcctcccgcttcctacgtttcgggaccgggggtacctaagggtggagatcgaagcgtaacg

SEQ ID NO: 72865 - DNA, 389 bp, Homo sapiens
  misc_feature: GYAE6OF02GS0BE.52.32.C10.1.454.CMB.1.raw
  modified_base (385)..(389): a, c, t, g, unknown or other
  misc_feature (385)..(389): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcgcggggggaccaaggtggagatcaagcgaactgtggctgcaccatctgtcttcatcttcccgccatctgatatacgatcgctgagcgggctggcaaggcgcatagnnnnn

SEQ ID NO: 72866 - DNA, 498 bp, Homo sapiens
  misc_feature: GYAE6OF02IZ85X.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaccagggacagcccctaaactcctgactcctacgatgcatccacttggaaacagggtcccatcaaggttcagtggaagtggctcgtgggacagtattttacttcaccatcagcagctgcagctagaagacattgacaacatattactgtacaactagtaatagatagtcctcccgtctctacggttcggacgggggtaccaagggtcggaacgacgtacgagcgtaacg

SEQ ID NO: 72867 - DNA, 486 bp, Homo sapiens
  misc_feature: GYAE6OF02F8JOQ.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctcgtgggacagtattttacttcaccatcagcaggctgcagcctgaagacattgacaacatattactagtacaacagtatgatagtctccgctcacgttcggcggggacctaagggtggagagtcaagcgtaacg

SEQ ID NO: 72868 - DNA, 477 bp, Homo sapiens
  misc_feature: GYAE6OF02FN0ZA.52.32.C10.1.454.CMB.1.raw
  modified_base (227)..(227): a, c, t, g, unknown or other
  misc_feature (227)..(227): n is a, c, g, or t
  modified_base (405)..(405): a, c, t, g, unknown or other
  misc_feature (405)..(405): n is a, c, g, or t
  modified_base (471)..(471): a, c, t, g, unknown or other
  misc_feature (471)..(471): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgaattggtatcagcaaaaaccagggacagcccctaaactcctgatcctcgatgcatccactttggaaacaggggtcccatcaaggttcagtggaagtggctctgggacagattttacttcacatcagcaggctgcagcctgaagacattgcaanatattactgtcaacagtatgatagtctcccgctcacgttcggcggggaccaaggtggagatcgagngtaacg

SEQ ID NO: 72869 - DNA, 503 bp, Homo sapiens
  misc_feature: GYAE6OF02JCQQP.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacacgacccctaaactcctagactcctcgatgcatccattaggaacacgggtccatcaaggttcagtggaagtggctcgtgggactagtattttacttcactatcagcaggctgcagcctagaagacattgactaacatattactgtacaactagtatgatagtcctccgtctacgtacgtttcgggacggggtactaagggtcggagtatacgacgcgtaacg

SEQ ID NO: 72870 - DNA, 676 bp, Homo sapiens
  misc_feature: GYAE6OF02IWF50.52.32.C10.1.454.CMB.1.raw
  modified_base (202)..(202): a, c, t, g, unknown or other
  misc_feature (202)..(202): n is a, c, g, or t
tcagcgcagtacgacacgaccggtgctcgatttagtatagacatcaacacacaaaggggacgaggagtcagtccaaccaggacacagcatggacatgagggtccctgctcagctcctggggctcctgctgctctggctctcaggtgccagatgtgtcatccagatgacccagtctccatcctcctgtctgcatctatagganacagaatcaccatcacttgccgggcgagtcgagacattagctatgtatctgaagttgtattcagaaccaaaaaccgacgggacaaccgtacccctaaactcccttagacctccgtacgactcgactactacctacgtttaacggaaacgtcggggtaccctagtacgtaacggtttcaaggtgggaagtggactcgagggtactagttaactttttaccttacaaccttactacgacggtacgacgggtccgtaggacctaccggtccgttaaggaacgttaactacggttttacgaaccctaaacgtactttaacgtttacctaacgtaaccgtaaagttaactgggttaaactacgggttaccttccccgggttacctacccgttaacctttcgggggtaacccgggggggtacccgggtaagggtaacgggtacgggaaggttaccaaacggttcggtaaacccggtcggg

SEQ ID NO: 72871 - DNA, 486 bp, Homo sapiens
  misc_feature: GYAE6OF02HT8JM.52.32.C10.1.454.CMB.1.raw
  modified_base (322)..(322): a, c, t, g, unknown or other
  misc_feature (322)..(322): n is a, c, g, or t
  modified_base (447)..(447): a, c, t, g, unknown or other
  misc_feature (447)..(447): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacnggggtcccatcaaggttcagtggaagtggctcgtgggacagtattttactttcacctatcagcaggctgcagcctgaagacattgcaacatattactgtacaacagtatgatagtctcccgctcncgtttcggacggggacagggtggagatacgagcgtaacg

SEQ ID NO: 72872 - DNA, 503 bp, Homo sapiens
  misc_feature: GYAE6OF02IIYWQ.52.32.C10.1.454.CMB.1.raw
  modified_base (228)..(228): a, c, t, g, unknown or other
  misc_feature (228)..(228): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagcaaaaaccagggacagacccctaaactcctgactcctcgatgcatccactttggaaacagggtccatcaaggttcagtggaagtggctctgggacagtattttacttcacctatcagcaggctgcagcctagaagacattgacaacatattactgtacaaacagtatagatagtcctcccgcttacacgtttcgggccgggggtaccaagggtcgggagtacgacgacggacgtacgg

SEQ ID NO: 72873 - DNA, 492 bp, Homo sapiens
  misc_feature: GYAE6OF02H8LFW.52.32.C10.1.454.CMB.1.raw
  modified_base (203)..(203): a, c, t, g, unknown or other
  misc_feature (203)..(203): n is a, c, g, or t
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgcgggcgagtcgagacattagcatgtatctgaattggtatcagcaaaaaaccaggacagcccctaaatcctgatcctcgatgcatccactttggaaacaggggtcccatcaaggttcagtgaagtgctctgggacagtattttacttcacctatcagcaggctggcagctagaagacattagctaaactataagttactacgttacaactagtatagatacgtctccgcttcacggttcggacggggtacaggtagganagtcagngtacg

SEQ ID NO: 72874 - DNA, 498 bp, Homo sapiens
  misc_feature: GYAE6OF02H1V2R.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggagtggctcgtgggacagtattttacttcacatcagcaggctgcagcctgaagacattcgacaaactataacttactgtactaacagtatagatagtcctcccgctccacgtttcgggccggggactagggtggagagtacgaaggcgtaacgg

SEQ ID NO: 72875 - DNA, 511 bp, Homo sapiens
  misc_feature: GYAE6OF02JYZ5L.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccggcgagtcgagacattagcatgtatctgaattggtatcagacaaaaaccgaggacacgacccctaaactcctagactcctcgatgcatccacttaggaacacgggtacccatcaaggtcagtggaagtggctcgtgggacagtattttacttacacctatcagcaggctgcagcctagaacgactattgactaactattacttactgtacaactagtatagtatcgtacctcccgtctaccgtacgttacgggcgggtacgagggtggagtactacgagacgtaacgg

SEQ ID NO: 72876 - DNA, 485 bp, Homo sapiens
  misc_feature: GYAE6OF02GSQ6D.52.32.C10.1.454.CMB.1.raw
  modified_base (321)..(321): a, c, t, g, unknown or other
  misc_feature (321)..(321): n is a, c, g, or t
  modified_base (423)..(423): a, c, t, g, unknown or other
  misc_feature (423)..(423): n is a, c, g, or t
  modified_base (479)..(479): a, c, t, g, unknown or other
  misc_feature (479)..(479): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccattggaaacngggtccatcaaggttcagtggaagtggctcgtgggacagtattttacttcacctatcagcaggctgcagcctagaagcattgacaacatattactgtacaanagtatgatacgtctccgcttacacgttcgggcggggtaccagggtggagatcaagngtaacg

SEQ ID NO: 72877 - DNA, 524 bp, Homo sapiens
  misc_feature: GYAE6OF02ITYRG.52.32.C10.1.454.CMB.1.raw
  modified_base (324)..(324): a, c, t, g, unknown or other
  misc_feature (324)..(324): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctgaattggtatcagcaaaaaccgagggacagacccctaaactcctagactcctcgatgcatccacttggaaacnggggtcccatcaaggttcagtgaagtgctctgggacagtatttacttcacatcagcaggctgcagctgaagacattcgcaactattaattactagttacaactagttaatgtattacgttctaccccgtcttaccgtaccgtttcgggaccggggggtaccaacggggttcggaggtaacgtacgaaggtaccgtaacgg

SEQ ID NO: 72878 - DNA, 387 bp, Homo sapiens
  misc_feature: GYAE6OF02HZRNR.52.32.C10.1.454.CMB.1.raw
  modified_base (384)..(387): a, c, t, g, unknown or other
  misc_feature (384)..(387): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagacattgcaacatattactgtcaacagtatgatagtctcccgctcactttcgcggggggaccaaggtggagatcaagcgaactgtggctgcaccatctgtcttcatcttcccgccatctgatatacgatcgctgagcgggctggcaaggcgcatagnnnn

SEQ ID NO: 72879 - DNA, 499 bp, Homo sapiens
  misc_feature: GYAE6OF02IA8F7.52.32.C10.1.454.CMB.1.raw
  modified_base (321)..(321): a, c, t, g, unknown or other
  misc_feature (321)..(321): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtcctgcatctataggagacagaatcaccatcacttgccggcgagtcgagacattagcatgtatctgaattggtatcagacaaaaaccagggacagcccctaaatcctgatcctcgatgcatccacttggaaacngggtcccatcaaggttcagtggaagtggctcgtgggacagtattttacttcactattcagcaggctgcagcctgaagacatttgacaaacataacttactgtacaactagtatagatagtcctcccgctactacgttccgggacggggtaccaagggtggagatacgaagcgtaacgg

SEQ ID NO: 72880 - DNA, 499 bp, Homo sapiens
  misc_feature: GYAE6OF02FT9DL.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattcgtatcagacaaaaaccagggacagcccctaaactccctgatcctcgatgcatccactttggaaacaggggtcccatcaaggttcagtggaagtggctcgtgggacagtattttacttcaccatcagcaggctgcagcctgaagacattgcaacatattactgtacaacagttatgattagtcctcccgctctacgtttcgggaccgggggtaccaagggtggaagagtacgaggcgtaacg

SEQ ID NO: 72881 - DNA, 509 bp, Homo sapiens
  misc_feature: GYAE6OF02GZXIQ.52.32.C10.1.454.CMB.1.raw
  modified_base (438)..(438): a, c, t, g, unknown or other
  misc_feature (438)..(438): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgactcctcgatgcatccactttaggaaacacggggtcccatcaaggttcagtggaagtggctcgtgggacaggtattttactttcaccatcagcaggctgcagcctagaacgactattcgacaactataatttactgtacaanagttatgattagtcctcccgtctaccgtacgttcgggacggggtacagggttggagtatacgagcgtaacg

SEQ ID NO: 72882 - DNA, 545 bp, Homo sapiens
  misc_feature: GYAE6OF02HZTML.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacacgaccccctaaatcctgatccctcgatgcatccatttggaaacaggggtcccaagtcaaaggttcaagtggaagtggctcgtgggacagtattttacttcacctatcagcaggctgcagcctagaacgacattgcaaactattaacttactagtacaaacgtagtaattagaattacgtaccttccccggcttaccgtacgttttcccggggacgggggtaacccgtaagggtacgggtaagtacgtacgaaggaccgtaacgg

SEQ ID NO: 72883 - DNA, 567 bp, Homo sapiens
  misc_feature: GYAE6OF02IWD7E.52.32.C10.1.454.CMB.1.raw
  modified_base (453)..(453): a, c, t, g, unknown or other
  misc_feature (453)..(453): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggaacagaccccctaaactcctagactcctcgatgacatcctacgttaggaaaccgaggggtcccatacaaggttcagtaggaagtggctcgtgggacagtattttactttcacctatcagcaggctgcagcctagaacgacagttacgactaactaattattacttagtacctaanagttaatagtacttacgtccttcccggtacttaccgtaccggttttaccgggggaccggggggtaacctaaggggtacggggtaacgtaacgtaccgtaacgggccgtaaacgg

SEQ ID NO: 72884 - DNA, 515 bp, Homo sapiens
  misc_feature: GYAE6OF02H6I5W.52.32.C10.1.454.CMB.1.raw
  modified_base (326)..(326): a, c, t, g, unknown or other
  misc_feature (326)..(326): n is a, c, g, or t
  modified_base (429)..(429): a, c, t, g, unknown or other
  misc_feature (429)..(429): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcagacaaaaaccgagggacagacccctaaactcctgactcctcgatgcatccactttaggaaacngggtcccatcaaggttcagtggagtggctcgtgggacagtattttacttcacatcagcaggctgcagcctagaagacattgactaaacatattactgtacaanagtatgtatacgtcctcccggcttaccgtacgtttaccgggaccgggggtaccgtaagggtcggagtacgtacgaacggcgtaacg

SEQ ID NO: 72885 - DNA, 487 bp, Homo sapiens
  misc_feature: GYAE6OF02HWUUP.52.32.C10.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (324)..(324): a, c, t, g, unknown or other
  misc_feature (324)..(324): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggngagtcgagacattagcatgtatctgaattggtatcagcaaaaaccagggacagcccctaaaactcctgaatcctcgatgcatccactttggaaacnggggtcccatcaaggttcagtggaagtggctctgggacagattttacttcacatcagcaggctgcagcctgaagacagttgacaacataattactagtcaacagtatgatagtctcccgctcaagttcgggacggggacaagggtggagatacaagcgtaacg

SEQ ID NO: 72886 - DNA, 501 bp, Homo sapiens
  misc_feature: GYAE6OF02HXEPC.52.32.C10.1.454.CMB.1.raw
  modified_base (426)..(426): a, c, t, g, unknown or other
  misc_feature (426)..(426): n is a, c, g, or t
  modified_base (454)..(454): a, c, t, g, unknown or other
  misc_feature (454)..(454): n is a, c, g, or t
  modified_base (487)..(487): a, c, t, g, unknown or other
  misc_feature (487)..(487): n is a, c, g, or t
  modified_base (495)..(495): a, c, t, g, unknown or other
  misc_feature (495)..(495): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggatcagacaaaaaccagggacacgacccctaaactcctgatcctcgatgcatccactttggaaactaggggtcccatcaaggttcagtggaagtggctcgtgggacagtattttacgtttcacctatcagcagctgcagccgtagaagacattgacaactatattacngtacaaactagtatagatagtctcccgntacctacgttcgggacggggtacagggtcgganagtcaggngtaacg

SEQ ID NO: 72887 - DNA, 385 bp, Homo sapiens
  misc_feature: GYAE6OF02FU4AP.52.32.C10.1.454.CMB.1.raw
  modified_base (382)..(385): a, c, t, g, unknown or other
  misc_feature (382)..(385): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagacattgcaacatattactgtcaacagtatgatagtctcccgctcactttcggcgggggaccaaggtggagatcaagcgaactgtggctgcaccatctgtcttcatcttccgcatctgatatacgatcgctgagcgggctggcaaggcgcatagnnnn

SEQ ID NO: 72888 - DNA, 519 bp, Homo sapiens
  misc_feature: GYAE6OF02F4USL.52.32.C10.1.454.CMB.1.raw
  modified_base (331)..(331): a, c, t, g, unknown or other
  misc_feature (331)..(331): n is a, c, g, or t
  modified_base (367)..(367): a, c, t, g, unknown or other
  misc_feature (367)..(367): n is a, c, g, or t
  modified_base (410)..(410): a, c, t, g, unknown or other
  misc_feature (410)..(410): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacagaccccctaaactccctagactcctgatgacatcctactttaggaaacnggggtacccatacgaaggttcagtggaagtgctcgngggacagtattttacttcactatcagcaggctgcagctagaanactattgacaatatattactgtacaatagtatgatacgtcctcccgtctacctacggtttccgggacgggggtaaccaagggttggaagtacgtacgaagaccgtaacg

SEQ ID NO: 72889 - DNA, 759 bp, Homo sapiens
  misc_feature: GYAE6OF02JWDP3.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacacgacccctaaactcctagactcctcgtatcgactactcctacgttttacggaaacgacggggtacccagtaccgtaagggtttaccaaggtacgggtaaggtcgggtaccgttacggttacgggggaaccttaaggtttaacctttttttaaccgttttaccctaacccgttaacgtttaccgtaaccgggtaccgtaacgggtacccgtttcgggaacccgttacgggtaccccgtttaacgggaaacgttaacccggtaagttttacccgggaaaccgtaaaccttaacgtttaaaccgttttaaccgttacggttaaaccctaaacggttaacgtttaagtaacggttaattaccggttacccttaccccgtccgttaccgttaacccgggtttacccgggggacccgggggggtaaccttaacgggggttacggaacggttaccgtaaccggtaacggtaccgttaaaccggg

SEQ ID NO: 72890 - DNA, 549 bp, Homo sapiens
  misc_feature: GYAE6OF02GH3LX.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacaggacccctaaactccctagactcctcgatgcatccacttggaaacagggtcccatcaaggttcagtggaagtggctgtgggactagtacttttacttcacatcagcaggctgcagcctagaacgctattgacctaatatactttactgtacaaactagttaacgtagtattacgtcctacccgtcttaccgtaccggtttaccggggaccggggggtaacccgtaaggggttcgggaacgtacgttacggaacggtccggtaaccgg

SEQ ID NO: 72891 - DNA, 390 bp, Homo sapiens
  misc_feature: GYAE6OF02GVCLV.52.32.C10.1.454.CMB.1.raw
  modified_base (383)..(390): a, c, t, g, unknown or other
  misc_feature (383)..(390): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtggctgcaccatctgtcttcatctcccgctatctgatatacgatcgctgagcggctggcaaggcgcatagnnnnnnnn

SEQ ID NO: 72892 - DNA, 393 bp, Homo sapiens
  misc_feature: GYAE6OF02GNQGH.52.32.C10.1.454.CMB.1.raw
  modified_base (386)..(393): a, c, t, g, unknown or other
  misc_feature (386)..(393): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaaacatattactgtcaacagtatgatagtctcccgctcactttcggcgggggaccaaggtggagatcaagcgaactgtggctgcaccatctgtcttcatcttcccgccatctgatatacgatcgctgagcgggctggcaaggcgcatagnnnnnnnn

SEQ ID NO: 72893 - DNA, 580 bp, Homo sapiens
  misc_feature: GYAE6OF02IF9WL.52.32.C10.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtcctgcatctatagganacagaatcaccatcacgttgccgggngagtcgagacattagcatgtatctagtaattggtatcagaccaaaaaccaggggaacacgacccctaaactcctagactcctcgatgcatcctacgtttaggaaacgtacggggtcccatcgaacggttcagtggaagtggcgtcgtaggactagtacttttacttcgaactatcagacaggtctgctagaccgtagaacgactagttgacaaacgtattaacgttaacgtcgtaactaactaggttaacttagaacttacgtacccgttacccgcttaccgtaccggtttccggggaaccggggggtaccaaggggttcggaacggtacgtacgaacggtcgtaacgg

SEQ ID NO: 72894 - DNA, 393 bp, Homo sapiens
  misc_feature: GYAE6OF02IY6YC.52.32.C10.1.454.CMB.1.raw
  modified_base (386)..(393): a, c, t, g, unknown or other
  misc_feature (386)..(393): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtggctgcaccatctgtcttcatcttccgccatctgatatacgatcgctgagcgggctgggcaaggcgcagtagnnnnnnnn

SEQ ID NO: 72895 - DNA, 503 bp, Homo sapiens
  misc_feature: GYAE6OF02HWXHH.52.32.C10.1.454.CMB.1.raw
  modified_base (228)..(228): a, c, t, g, unknown or other
  misc_feature (228)..(228): n is a, c, g, or t
  modified_base (321)..(321): a, c, t, g, unknown or other
  misc_feature (321)..(321): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagcaaaaaccagggacagcccctaaactcctgactcctcgatgcatccacttgaaacngggtccatcaaggtcagtgaagtgctctgggacagtatttacttcacctatcagtcaggctgcacgcctagaaacgtacattgactaaacattacttaactgtacaacagtatagtatagtcctcccgattcctacggtttcggacgggggacctaagggtcgaagacgtacaggcgtaacg

SEQ ID NO: 72896 - DNA, 521 bp, Homo sapiens
  misc_feature: GYAE6OF02HOOGV.52.32.C10.1.454.CMB.1.raw
  modified_base (325)..(325): a, c, t, g, unknown or other
  misc_feature (325)..(325): n is a, c, g, or t
  modified_base (405)..(405): a, c, t, g, unknown or other
  misc_feature (405)..(405): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccaggggacacgcccctaaactcctgactcctcgatgcatccacttggaaacnggggtcccatcaaggttcagtggaagtggctcgtgggactagtattttacttcacctatcagcaggctgcagcctagaanactattgacaactatattactgttacaaactagtaatagattacgtcctacccgcttcctaacggtttcggggaccgggggtaaccagggttcggagtacgtacgaaggctaacgg

SEQ ID NO: 72897 - DNA, 387 bp, Homo sapiens
  misc_feature: GYAE6OF02FNFT3.52.32.C10.1.454.CMB.1.raw
  modified_base (377)..(377): a, c, t, g, unknown or other
  misc_feature (377)..(377): n is a, c, g, or t
  modified_base (383)..(387): a, c, t, g, unknown or other
  misc_feature (383)..(387): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtggctgcacatctgtcttcatcttcccgcatctgatatacgatcgctgagcgggctggcaaggcncatagnnnnn

SEQ ID NO: 72898 - DNA, 629 bp, Homo sapiens
  misc_feature: GYAE6OF02H8MCT.52.32.C10.1.454.CMB.1.raw
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccatcctccctgtctgcatctaataggagacagaatcaccatcacttgccgggngagtcgagacattagcatgtatctgaatttggtatcagacaaaaaccgngggacacgacccctaaatcctagactcctcgatgctactccttacgttaggaacgtcgggtacctatacgtaagttcgagtaggtacggtgtctcggtacgggaactaagtttactttttaccgttaccaactactacgtacgacgtaggtcgtacgacgtacgacgtaagaaacgtattaacgttgaaacctaaattatttaacttacttaacgtaacaaacgtagttaagtacgtaagttacgttccccgtaccgtccgttaccgtttaaccggggttccgggggaacccgggggtaaccgtaggggtaccggtaacggttacggttaacggaacggtaccggttaacgg

SEQ ID NO: 72899 - DNA, 558 bp, Homo sapiens
  misc_feature: GYAE6OF02G5BBN.52.32.C10.1.454.CMB.1.raw
  modified_base (323)..(323): a, c, t, g, unknown or other
  misc_feature (323)..(323): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcgagtcgagacattagcatgtatctgaattggtatcagcaaaaaccagggacacgcccctaaactcctagactcctcgatgcatccacttggaaacngggtccatcaaggttcagtggaagtggctcgtggacagtattttacttcacatcagcagctgcagcctagaacgactagttacgactaaacgattaacgttacgtacgttacaaacgtagttaacgttagactttacggtccttacccgtccttaccgtaccggttttccggggacccggggggttaaccaacggggttcgggaacggtacttacggaacggtccggtaaaccgg

SEQ ID NO: 72900 - DNA, 678 bp, Homo sapiens
  misc_feature: GYAE6OF02HNXZK.52.32.C10.1.454.CMB.1.raw
  modified_base (205)..(205): a, c, t, g, unknown or other
  misc_feature (205)..(205): n is a, c, g, or t
tcagcgcagtacgacacgaccggtgctcgatttagtatagacatcaacacacaaaggggacgaggagtcagtcccaaccaggacacagcatggacatgagggtccctgctcagctcctggggctcctgctgctctggctctcaggtgccagatgtgtcatccagatgacccagtctccactcctcccgtgtctgcatcatagganacagaatcaccatcacttcggccggacgagtcgagacattagcatgtatcgtgtaattggtactcaacgtaacgaaaaaaccgagggacaaccggtaaccccctaaaatccctagaaccttccgtagaacttcgaacctatacccgttaacgtttaaggaaaaccggtcggggtaccctaaatacgtaaacgggtttcgaagtagggtaagtcggtactcggtacggggaaccttagtttaacgttttttaacctcgaaaccctattacgaacggactacgggtctcgggtacaacgcccgtaagaacgtaactagttaagaccctaaatagttaccttaaacgttcgtaaacaacgtaaaggttactacgtacgttacggttccctaccccggccgtttaatcccggggtttaacggggggacccggaaacggttaggtggaaacggttactaacggaacacgggttaacgg

SEQ ID NO: 72901 - DNA, 497 bp, Homo sapiens
  misc_feature: GYAE6OF02HHHR9.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccacttggaaacaggggtcccatcaaggttcagtggaagtggctcgtgggacagtattttacttcacctatcagcaggctgcagcctgaagacattgactaacatattactgtacaacagtatgatagtcctcccgctcctacgtttcgggacgggggtacctaaggtcggagatacgaagcgtaacg

SEQ ID NO: 72902 - DNA, 553 bp, Homo sapiens
  misc_feature: GYAE6OF02I4WEK.52.32.C10.1.454.CMB.1.raw
  modified_base (322)..(322): a, c, t, g, unknown or other
  misc_feature (322)..(322): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcagcaaaaaccagggacagacccctaaactccctagatcctcgatgcatccatttgaaacnggggtcccatcaacggttcagtaggaagtggctcgtgggacagtacttttacttcactatcgagcaggctgacagccctagaacgactagttgacaaacattaacttaactcgtacaaactacgttaagtgaattacgtaccttaccccgcttaccgtacgtttaccggggaccggggggtaacctaacggggttcggaaggtacgttaccgaacggtacgttaaaccggg

SEQ ID NO: 72903 - DNA, 535 bp, Homo sapiens
  misc_feature: GYAE6OF02GUAAO.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagacccctaaactcctgactcctcgatgcatccactttaggaaacaggggtcccatcaaggttcagtggaagtggctcgtggactagtattttactttcacctatcagcaggctgcacgtctagaagactacgttgacaactataattactagtactaactagtaatgtatacgtcctcccgtcttacctaccggtttccgggaccggggggtaaccgaggggttacggaggtacgtacgtaaggacggtaacgg

SEQ ID NO: 72904 - DNA, 496 bp, Homo sapiens
  misc_feature: GYAE6OF02FWN0A.52.32.C10.1.454.CMB.1.raw
tcagcgcagtacgacacgaccggtgctcgatttagtatagacatcaacacacaaaggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaatcctgatcctcgatgcatccacttggaaacaggggtcccatcaaggttcagtggaagtggctcgtgggacagtattttacttctacatcagcaggctgcagcctgaagacattcgactaacattattactgtacaacagtatgattacgtctcccgtcttccacgtttccgggcgggggtaccaagggtggagatcgaaggcgtaacg

SEQ ID NO: 72905 - DNA, 485 bp, Homo sapiens
  misc_feature: GYAE6OF02HG8KJ.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctcgtggacagtattttactttcaccatcagcaggctgcagcctgaagacattgcaacatattactgtacaacagtatgatagtctcccgctcacgtttcggcgggggtaccaggtggagatacgagcgtaacg

SEQ ID NO: 72906 - DNA, 519 bp, Homo sapiens
  misc_feature: GYAE6OF02GSQ7J.52.32.C10.1.454.CMB.1.raw
  modified_base (227)..(227): a, c, t, g, unknown or other
  misc_feature (227)..(227): n is a, c, g, or t
  modified_base (322)..(322): a, c, t, g, unknown or other
  misc_feature (322)..(322): n is a, c, g, or t
tcagcgcagtacgacacgaccggtgctcgatttagtatagacatcaacacacaaaggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatcagcaaaaaccagggacacgcccctaaactcctagatcctcgatgcatccacttggaaacnggggtcccatcaaggttcagtggaagtggctcgtgggacaggtacttttacttcaccatcagcaggctgcagcctgaacgacattgactaacgattacttactgtacaaacgtagttaatgattacgtcctcccgcttaccaccgtttcgggacgggggtaaccaaggggtcggacgtacgtacgaaggcgtaacgg

SEQ ID NO: 72907 - DNA, 692 bp, Homo sapiens
  misc_feature: GYAE6OF02H5O8L.52.32.C10.1.454.CMB.1.raw
  modified_base (171)..(171): a, c, t, g, unknown or other
  misc_feature (171)..(171): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccngtctccatcctcctgtctgcatctataggagacagaatcaccatcacttcgccgggcgagtcgagacattagcatgtatctgaatttggtatcaagacaaaaaaccgagggacacgacccctaaactcctagactcctacgatcgacatccacgttttaggaaacacggggtacccaatacgaaaggtttccgagtagggtaagtcggtactcgtgggaactaggttaactttttacttttacgaacctattacacgtaccgaggtcctacggcgtacgtacccgttagaaacgtactaaacgtttcgaacctaaaactagtttaaaccgttttaacgttacgttaaccgtaaaaccgttaagttaaagtttagtaacgtttaccggtttacccgtttcccccggtaactttaccccgttaaccggggttttcccgggggtaacccgggggggtaaaccgtaacgggggttaacgggaacggttaacggtaaccggtaacgggtacccggttaaacccggg

SEQ ID NO: 72908 - DNA, 509 bp, Homo sapiens
  misc_feature: GYAE6OF02FIADE.52.32.C10.1.454.CMB.1.raw
  modified_base (323)..(323): a, c, t, g, unknown or other
  misc_feature (323)..(323): n is a, c, g, or t
  modified_base (400)..(400): a, c, t, g, unknown or other
  misc_feature (400)..(400): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccggcgagtcgagacattagcatgtatctgaattggtatcagacaaaaaccagggacagcccctaaactcctagactcctcgatgcatccactttggaaacnggggtccatcaaggttcagtggaagtggctcgtgggacagtattttacttcacctatcagcaggctgcagcctgaanacattgacaactatattactgtaccaactagtatgacttagtcctcccgtctccgtaccgtttcgggaccgggggtaacctaagggtcggaagagtacgaagcgtaacg

SEQ ID NO: 72909 - DNA, 671 bp, Homo sapiens
  misc_feature: GYAE6OF02H8PH9.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctcctgtctgcatctataggagacagaatcaccatcacttgccgggcgagtcgagacattagcatgtatctgtaattggtatcagaacaaaaccgaggacacgacccctaaactcctagactcctcgatgactactaccctacgtttacgggaaacgacggggtaccctaagtacgtaacggttcgaggttagggtaacggtcggacttacggtaggggtaactaggtttaactttttaccgtttaccaacctatacgacggtaccgtaggtctcgacgtacgtaccgtaaggaacgacgtaagttacgaacctaaactattaactttacgttacgttaacctaacgtagttaagtacgtaacgtttaccggtcccttacccggtcctttaccggttaccggggtttaccgggggtacccggggggtaaccgtaacggggttacggtaacggtacggttaacccggtaacgggtacccggttaaaccggg

SEQ ID NO: 72910 - DNA, 668 bp, Homo sapiens
  misc_feature: GYAE6OF02JQWSF.52.32.C10.1.454.CMB.1.raw
  modified_base (154)..(154): a, c, t, g, unknown or other
  misc_feature (154)..(154): n is a, c, g, or t
  modified_base (307)..(307): a, c, t, g, unknown or other
  misc_feature (307)..(307): n is a, c, g, or t
tcagcgcagtacgacacgaccggtgctcgatttagtatagacatcaacacacaaagggggacgaggagtcagtccaaccaggacacagcatggacatgagggtccctgctcagctcctggggctcctgctgctctggctctcaggtcgtaccgnatgtgtcgatccacgatcgacccacgtcctcctactcctccctcgtctgcacgataggagacacgaatcaccactcgactcgccgggcgacgtacgagacatagctactagtatcgtatacgtagtaactacgcaaacaaacctcgtaacgtnaccgtacccgtaacctaccgtacgtaccgtaccgtactacgcgtacccgttaccgtacgtaacggccggtacgtacgtacgtacggtacgtacggtacgtagtacggtacgtacggtacgtacgtacgttacactttacgtttacctaccgtaccgtacgtacttacggacgtacgacgacgtacctagtaacgtaactaacgtaccgtaaccgtaactaacttaacgtacgtacgtaacgtaacgtaacttacgaacgtacgtaccgtacccgttaccgtaccggtaccgggtgggtaactaggggttacgggaacggtacgttacggaacggtaccgtaaccgttacggtacggtaccg

SEQ ID NO: 72911 - DNA, 397 bp, Homo sapiens
  misc_feature: GYAE6OF02HGSWA.52.32.C10.1.454.CMB.1.raw
  modified_base (389)..(397): a, c, t, g, unknown or other
  misc_feature (389)..(397): n is a, c, g, or t
tcagcgcagtacgacacgaccggtgctcgatttagtatagacatcaacacacaaagggcgagtcgagacattagcatgtatctgaattggtatcagcaaaaaccagggacagccccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccaagggtggagatcaagcgaactgtggctgcaccatctgtctcatcttcccgccatctgatatagatcgctgagcgggctggacaagggcgcatacgnnnnnnnnn

SEQ ID NO: 72912 - DNA, 523 bp, Homo sapiens
  misc_feature: GYAE6OF02FM065.52.32.C10.1.454.CMB.1.raw
  modified_base (227)..(227): a, c, t, g, unknown or other
  misc_feature (227)..(227): n is a, c, g, or t
  modified_base (322)..(322): a, c, t, g, unknown or other
  misc_feature (322)..(322): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgaattggtatcagacaaaaaccagggacacgacccctaaactcctgactcctcgatgcatccattgaaacngggtccatcaaggtcagtggaagtggctcgtgggacagattctactttcacctatcagcaggctgcagcctgaacgactattgacaactattattactgtacaaactagtactagtatacgtcctcccgacttaccgtaccggtttccggggaccggggggtaacctaaggggtagggacggtacgttacgaaggtaccgg

SEQ ID NO: 72913 - DNA, 568 bp, Homo sapiens
  misc_feature: GYAE6OF02IM09F.52.32.C10.1.454.CMB.1.raw
tcagcgcagtacgacacgaccggtgctcgatttagtatagacatcaacacacaaagggggcaggagtcagtcctaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcagacaaaaaccgagggacacgacccctaaactcctagactcctcgatcgcatcctacgttaggaaaccgacggggtacccagtacgaaggttcaaggtggaaggtggtacctcgtacgggtactagttacttttactttaccacctatcacgcgaggtctcgcacgtcctagaacgactatagactaactattattactagtactaactagtaatagtaatacgtcctcccgtcttaccgtaccggtttaccgggacgggggtaaccgtaagggtacgggacgtacgtacgtaacgacggtaacgg

SEQ ID NO: 72914 - DNA, 519 bp, Homo sapiens
  misc_feature: GYAE6OF02GK6HL.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggcgagtcgagacattagcatgtatctgaattggtatcagacaaaaaccagggacacgacccctaaactcctagactcctcgatgcatccactttaggaaacacggggtacccatacgaaggttcagtggaagtggctcgtgggacagtattttacttctacatcagcaggctgcagcctagaagacattgacaactatattactgtacaactagtaatgattagtcctccgtctactaccggtttcgggaccggggtaaccgaagggtcggaagtacgtacgacggcgtaacgg

SEQ ID NO: 72915 - DNA, 670 bp, Homo sapiens
  misc_feature: GYAE6OF02IYIEH.52.32.C10.1.454.CMB.1.raw
  modified_base (203)..(203): a, c, t, g, unknown or other
  misc_feature (203)..(203): n is a, c, g, or t
  modified_base (278)..(278): a, c, t, g, unknown or other
  misc_feature (278)..(278): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatccaccatcacttgccgggcgagtcgagacattagcatgtatctagaattggtatcaagacaaaaacgngggaacacgacccctaaactcctgactcctcgatgccatccacgtttaggaaaccgtacgggtacccagttacgaaaggttcaaggtagggtaagtcggacttcgtaggggtaacctaagtttaacgtttttacttaccgacctaattccgagtaccgaggtccttacgacgtacgtacccgtagaaacgtacaacgtttcgacctaaactaacgtttaacttaacgttacgtaacctaaacgtaacgttaagttacgtaacttaccggttacccgttaccccggtcgtttaacccggttaaccgggggttaccggggtaacccgggggggtaaccgtaacggggttacggaaacggttaccgtaaacccgggtaacggtaccggtaaacgg

SEQ ID NO: 72916 - DNA, 555 bp, Homo sapiens
  misc_feature: GYAE6OF02HVTPQ.52.32.C10.1.454.CMB.1.raw
  modified_base (203)..(203): a, c, t, g, unknown or other
  misc_feature (203)..(203): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggcgagtcgagacattagcatgtatctgaattggtatcagacaaaaaccgagggacacgacccctaaactcctagactcctcgatcgcatccacgtttacggaaacgtacggggtccctaatacgtaaggttcaggtaggagtggctcgtgggacagtattttactttcacctatcagcaggctgcgagactagaacgactattcgaactaactattaacttactacgtacaacgtagtatagtattacgtcctacccgtcttaccgtaccggtttccggggaccgggggtaaccgacgggtaggtaagtacgtacgacggacgtaacgg

SEQ ID NO: 72917 - DNA, 393 bp, Homo sapiens
  misc_feature: GYAE6OF02I9ZSZ.52.32.C10.1.454.CMB.1.raw
  modified_base (383)..(393): a, c, t, g, unknown or other
  misc_feature (383)..(393): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccaaggtggagatcaagcgaactgtggctgcaccatctgtcttcatcttcccgcatctgatatacgatcgctgagcggctggcaaggcgcatagnnnnnnnnnnn

SEQ ID NO: 72918 - DNA, 494 bp, Homo sapiens
  misc_feature: GYAE6OF02HYFQD.52.32.C10.1.454.CMB.1.raw
  modified_base (227)..(227): a, c, t, g, unknown or other
  misc_feature (227)..(227): n is a, c, g, or t
  modified_base (320)..(320): a, c, t, g, unknown or other
  misc_feature (320)..(320): n is a, c, g, or t
  modified_base (488)..(488): a, c, t, g, unknown or other
  misc_feature (488)..(488): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggnagtcgagacattagcatgtatctgaatttggtatcagacaaaaaccagggacagcccctaaactcctgatcctcgatgcatccattggaaacngggtccatcaaggttcagtggaagtggctcgtggacagtattttacttcacatcagcagctgcagcctgaagacattgacaacgtatattactgtacaatagtatgattacgtctcccgtctacacggtttcgggacgggggtaaccagggtcggagactcgaacggntaacgg

SEQ ID NO: 72919 - DNA, 384 bp, Homo sapiens
  misc_feature: GYAE6OF02GCFFM.52.32.C10.1.454.CMB.1.raw
  modified_base (379)..(384): a, c, t, g, unknown or other
  misc_feature (379)..(384): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagcattgcaacatattactgtcaacagtatgatagtctcccgctcactttcggcggggggaccaaggtggagatcaagcgaactgtgctgcacatctgtctcatcttcccgcatctgatatacgatcgctgagcgggctggcaaggcgcatgnnnnnn

SEQ ID NO: 72920 - DNA, 520 bp, Homo sapiens
  misc_feature: GYAE6OF02HJRGE.52.32.C10.1.454.CMB.1.raw
  modified_base (409)..(409): a, c, t, g, unknown or other
  misc_feature (409)..(409): n is a, c, g, or t
  modified_base (432)..(432): a, c, t, g, unknown or other
  misc_feature (432)..(432): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagaccccctaaactcctagactcctacgatgcatcctacttaggaaacacggggtcccatcaaggttcagtggaagtggctcgtggactagtattttacttcacctatcagcaggctgcagcctagaanactattgacaactatacttactntacaactagtatagatacgtcctacccgcttcctacggtttccgggaccgggggtaaccagggtcggagtacgtacgagtcgtaacgg

SEQ ID NO: 72921 - DNA, 721 bp, Homo sapiens
  misc_feature: GYAE6OF02HZ5Z9.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagaatccaccatccacttggccgggcgagtccgagactattagcatgtatctgtaattggtatcaagacaaaaaaccgagggaaccaacgtacccctaaactcctagactcctcgatgacctatccctactttaggaaaccgtacggggtacccaagttaccgaaacgggtttcaagggttacggaaaggttcggtacgtacggttaggggtaacgtaaggtttaacttttttaaccgtttaccctaaccccttaagtaccgtaacgtcgacgggtaccttcggaccgtacggtacccgttaaggaaaacgtacctaagtttacggaacctaaaaccgtaacgtttaactttaaaccgtacgttaacgtaaaccgttaagttaacgttacgtaacttaccggttacccttaccccggtcttacccgggtttaccggtttacccgggggaccgggggggtaaccctaagggggttacgggtaacgtacggttaaccgacgggtaccggttaaccgg

SEQ ID NO: 72922 - DNA, 628 bp, Homo sapiens
  misc_feature: GYAE6OF02G2M6M.52.32.C10.1.454.CMB.1.raw
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgngggaccaccacctaactcagctcgcancactactaccttagttaacgaacggtccggtacctagtacgtacgtacgaggtagtaaggtcgtctggtacgacgtagtttacttttacttaccactatacgacgcgacgtctcgacgacgtcgtaagaactactagtcaactaactatttaacttacgtactaacctaaagtagttagtagttaagttaccgttaccccggttcccgtaccgtttaacccgggtttacccggggtttaaccggggggggaaccccgggggttaaccgtaagggggttacggaaacggtttaccggaaaccggtacgggtaacccggttaacggg

SEQ ID NO: 72923 - DNA, 659 bp, Homo sapiens
  misc_feature: GYAE6OF02ILQ90.52.32.C10.1.454.CMB.1.raw
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagcgcagtacgacacgaccggtgctcgatttagtatagacatcaacacacaaaggggacgaggagtcagtccaaccaggacacagcatgacatgagggtccctgctcagctcctgggctcctgctgctctggctctcaggtgccagatgtgtcatccagatgacccagtctccactcctcctgtctgcatctatagganacagaatcacctatcattcgccggngagtcgagactattagcatgtatactgtaattggtaatctaagaaccgaaaaaaccgtcggggaacctaacgacccccgtaaaacttccgtaacgacttcccgtacgtaacgtcgacctaacgtcccttaacgtttacggaaaccgtacggggtaccccaattacgtaaacggtttccaaggttacggtaacggtttcgggactttcggtagggtaactagtttaactttttaaccgtttactaacccgtattcgaacgtacgacggtctacgtaccgacgtccgtagaacgacgtattacgaacgtaacctaattacttaacgtagtaacaaacttagtaattacgtatacgttccgtccgtacttacgttacggttacgggtaccgggggaacttacggggagtacgtaacgtacgtaaggaccttaacgg

SEQ ID NO: 72924 - DNA, 569 bp, Homo sapiens
  misc_feature: GYAE6OF02F74ZA.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcagacaaaaaccagggacacgacccctaaaactcctagattcctacgattgcactccgtactttacgggaaacctacggggtccccaagttaccgtaaaggtttccaaggttgggaaaggttcggtaccttcgtggggacctagtactttttacgtttcacctatcagaccagggctgcagcctagaagaccattcgactaacatagttactgtacaacagttatcgtattagtcctcccgcttacgtaccggtttcggggaccgggggtaaccgagggttcggacgtagtaccgtaaggcgtaacgg

SEQ ID NO: 72925 - DNA, 775 bp, Homo sapiens
  misc_feature: GYAE6OF02HJ9UE.52.32.C10.1.454.CMB.1.raw
  modified_base (203)..(203): a, c, t, g, unknown or other
  misc_feature (203)..(203): n is a, c, g, or t
  modified_base (228)..(228): a, c, t, g, unknown or other
  misc_feature (228)..(228): n is a, c, g, or t
  modified_base (276)..(276): a, c, t, g, unknown or other
  misc_feature (276)..(276): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccgggngagtcgagacattagcatgtatctagaattggtatcagacaaaaacgngggaacacgcccctaaactcctagactcctcgatcgctagtccctacgtttacggaaactacgggggtaccctaagtacgtaaagggtttccaaggttacgggaaaggttcggccgttacgtacgggggtaactacgggtttaactttttttaaccgttttaccctaaaccttaacgttaccgtaaacggtccgtaacgggtacccgtttacgggaacccgttacgggtacccccgtttaagggaaaacgggtaaccccttaaaggtttaccggtaacccggtaaaaccttaaacgttttaaaccgttttaaaccgttaccgggtttaaacctaaaacccggttaagttaaccgttaaggtaacgtttaccgtttacccgtaccccggttacctttacccggttaaaccggtttttcccgggggtaacccggggggggaaaccctaacgggggtttcggaaacggtacggttaacggtaaaccggtacgtaacccgggg

SEQ ID NO: 72926 - DNA, 524 bp, Homo sapiens
  misc_feature: GYAE6OF02GBB44.52.32.C10.1.454.CMB.1.raw
  modified_base (227)..(227): a, c, t, g, unknown or other
  misc_feature (227)..(227): n is a, c, g, or t
  modified_base (326)..(326): a, c, t, g, unknown or other
  misc_feature (326)..(326): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggngagtcgagacattagcatgtatctgaattggtatcagacaaaaaccagggaccagacccctaaactcctgactcctcgatgcatccactttaggaaacncggggtaccatcgaaggttcagtggaagtggctcgtgggacagtattttacttcactatcagcagctgcacgctagaagactattacgacaactattattactagtacaacagttatagattacgtcctacccgtctaccgtacgttccggggacggggaaccgtaagggtcggaacgtagtacgtaggacgtaacgg

SEQ ID NO: 72927 - DNA, 627 bp, Homo sapiens
  misc_feature: GYAE6OF02JOWUY.52.32.C10.1.454.CMB.1.raw
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
tcagcgcagtacgacacgaccggtgctcgatttagtatagacatcaacacacaaagggggcaggagtcagtcccaaccaggacacagcatggacatgagggtcccttctcagctcctggggctcctgctgctctggctctcaggtgccagatgtgtcatccagatgacccagtctccatccctcctgtctgcatctataggagacagaatcaccatacacgttgccgggacgagtcgagactattagactatgtatctagtaattggtatacagaacaaaaccgagggacacgaccctaaactcctagactcctagactacggctactcctaacgttaggaaacgtcgggtaccatacgtaaggttccgaaggtacggaacgtggtcctacgtcgggactaagtacttttacgttacacctaatccaagcctaggtccctagacctacggctacgtaanaccttanacggaacaactaattcgttaacgtacgttaacaaacgtattaacgagttaatacccgttccgtacccgtaccttccgggtaaccggtttccgggggaaacccgggggtaactaggggtacgggtaataccggaaccggtacggtaccggtacggtaacggg

SEQ ID NO: 72928 - DNA, 678 bp, Homo sapiens
  misc_feature: GYAE6OF02JI63F.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctagaattggtatcagacaaaaaccgaggacacgacccctaaactcctagactcctagatcgactactacctaacgttacggaaacgtacgggtacccaagtacgtaaggttcaaggtacggtaaggtggtccttacggtacggggtactaaggtttactttttaaccgttcgaaccgttaatcgaacggtccgtaaggtcctacggtaccgtaacgtccggtaaggaaacgtaactaggttacgaacctaaaacgttactttaacttaaccgttacgtaaccgtaaacgtaagttaagtacgttaacttaccgttaccctacccgtaccggtttaaccgtaaccggggttttccggggggaaccgggggtaaacctaaggggttacgggaacgtaacccgttaaggaaaccggtccggttaaaccggg

SEQ ID NO: 72929 - DNA, 691 bp, Homo sapiens
  misc_feature: GYAE6OF02JMBF5.52.32.C10.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
tcagcgcagtacgacacgaccggtgctcgatttagtatagacatcaacacacaaaggggcaggagtcagtcccaaccaggacacagcatggacatgagggtccctgctcagctcctggggctcctgctgctctggctctcaggtgccagatgtgtcatccagatgacccagtctccatcctcctgtctgcatctataggnacngaatcaccatcacttgccgggngagtcgagacattagcatgtatctgtaattggtatcagacaaaacgaggacacgaccctaaactcctgactcctcgatgctaactcctaacgtttacggaaactacggggtacccctaagtaccgtaaacgggttcctaaggttacgggaaacgttgggacctttacgtacggggtaaccgttaggttaaactttttaaccgtttttacccaacccttaacgtttaccgaacgtaccgtaagggccgtttacgacgtacgtaccgttacggaacgtaaccgtagttacggtacctaaccttaatactttaaacgttcggtaacctaaacgttaacgtaagttacgttaacggtacgtttaccctacccggtccttaccggttacccggtttaccgggggacgggggttaacccgtaacggggttacggtaacgggttaaccgtacggtaaccggtccggtaaacgg

SEQ ID NO: 72930 - DNA, 410 bp, Homo sapiens
  misc_feature: GYAE6OF02I74A9.52.32.C10.1.454.CMB.1.raw
  modified_base (333)..(333): a, c, t, g, unknown or other
  misc_feature (333)..(333): n is a, c, g, or t
  modified_base (386)..(386): a, c, t, g, unknown or other
  misc_feature (386)..(386): n is a, c, g, or t
  modified_base (388)..(410): a, c, t, g, unknown or other
  misc_feature (388)..(410): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagcattgcaaacatattactgtcaacagtatgatagtctcccgctcactttcggcggggggtaccaaggtgagatcaagcgaactgtggctgcaccatctgtcttnatcttcccgcatctgactatacatcgctgacgcgggctggcaaggcacatagnannnnnnnnnnnnnnnnnnnnnnn

SEQ ID NO: 72931 - DNA, 863 bp, Homo sapiens
  misc_feature: GYAE6OF02IP1A9.52.32.C10.1.454.CMB.1.raw
  modified_base (228)..(228): a, c, t, g, unknown or other
  misc_feature (228)..(228): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccatccctccctgtctgcatctataggagacagaatcaccatcacttgccgggngagtcgagacattagcatgtatctgaattggtatcagacaaaaaccgagggaacacgacccctaaactcctagactcctacgatcgactataccctacgtttacggaaaccgtacgggggtacccaagtacgtaacgggtttacgtaaggtagggtaacggttcgggtaccgttacggttacgggggtaaccgtaacggtttaacgtttttttaaccgttttaccctaaccctaacgtttaccgaacggtaccgtaacgggtccgttacggtaccgtaaccggacccgtttaacgaaaacggtaccgttaaacgtttacggaaccctaaaaccttaaacgttttaaaccgttttaaccgtttaacggtttaacccttaaaaaaccggtttaaacggtttaaaacgtttacgggttaaacgttttaccggttaacccggttttaccccccccgggttaacgtttttaaccccccggtttaaacccgggggttttttaacccccggggggggttaaccccggggggggggggttaaaacccggtttaaaacccgggggggtttacggggggttaaaccggtaaacccgggtttaaacccggtaaaaccggggttaacccggtttaaaaccccggggg

SEQ ID NO: 72932 - DNA, 546 bp, Homo sapiens
  misc_feature: GYAE6OF02F6ZF1.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcagacaaaaaccagggacagcccctaaactcctgatcctgatgcatccactttggaaacagggtccatcaaggttcagtggaagtggctctgggacaggtacttttacgtttcacctatcagccaggctgacagcctgaagacattgcaaactattaacttactgtacaaacgagttaatgtaattacgtccttaccccgcttaccgtaaccgttttccgggggaacccggggggtaaccgtaacggggttgggaacgtaagttaccggaacggtcgtaaaccgg

SEQ ID NO: 72933 - DNA, 655 bp, Homo sapiens
  misc_feature: GYAE6OF02J2CH0.52.32.C10.1.454.CMB.1.raw
  modified_base (203)..(203): a, c, t, g, unknown or other
  misc_feature (203)..(203): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtcctccatccctcctgtctgcatctatagganacagaatccacctatcacttggccgggcgacgtcgagactagttacgctagtgtactcgtagtaagtttggtaactcgaacgaacaaaaacccggagggaaccacggacccccttaaacgtcctagactcctacgatgcctactcctacgttacgggaaacgccgggttaccacttacgtaaggttcaggttaggtaacgtcggctcggtagggactagttaacttttacttaccgacattacgacgtacgacggtctggaccgacgtaccgtgtaaacggacctaagttgaacctaaacttacgtttaactttaacgtcgttaaaccaactagtaacgttagtaacgttcgttacctacccgtcgttaccgttaccgggtttacccggggaccgggggttaacccgtaaggggtcgggtaacgtaacgtacggtaacggtaccgtaaccgg

SEQ ID NO: 72934 - DNA, 556 bp, Homo sapiens
  misc_feature: GYAE6OF02JCVQE.52.32.C10.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
  modified_base (443)..(443): a, c, t, g, unknown or other
  misc_feature (443)..(443): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctatagganacagaatcaccatcacttgccggngagtcgagacattagcaatgtatctgaattggtatcagacaaaaccgaggacacgacccctaaactcctagactcctcgactcgactacttccacgtttacggaaacgtacggggtaccctagtacgtaaggttcaagtaggaagtggacgtagtggactaagttacttttacttacacgtatacagtcaggtctagcacgtcctagaacactagtnacgtaactatacttacgtagtactaagtagtatagactacgttacctccggtctaccgttacggttccgggacggggtacctagggtcgtacgagtacgtaagtcggtaacgg

SEQ ID NO: 72935 - DNA, 405 bp, Homo sapiens
  misc_feature: GYAE6OF02IOVTK.52.32.C10.1.454.CMB.1.raw
  modified_base (254)..(254): a, c, t, g, unknown or other
  misc_feature (254)..(254): n is a, c, g, or t
  modified_base (386)..(386): a, c, t, g, unknown or other
  misc_feature (386)..(386): n is a, c, g, or t
  modified_base (391)..(392): a, c, t, g, unknown or other
  misc_feature (391)..(392): n is a, c, g, or t
  modified_base (394)..(405): a, c, t, g, unknown or other
  misc_feature (394)..(405): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacngtatgatagtctcccgctcactttcggcggggggacccaagggtcggagatcaagcgaactgtaggctggcaccatctgtcttcattcttcccgctatctgatatacgatcgctgagcgggctggcaaggcnatagnnannnnnnnnnnnn

SEQ ID NO: 72936 - DNA, 418 bp, Homo sapiens
  misc_feature: GYAE6OF02IX9TY.52.32.C10.1.454.CMB.1.raw
  modified_base (383)..(383): a, c, t, g, unknown or other
  misc_feature (383)..(383): n is a, c, g, or t
  modified_base (390)..(390): a, c, t, g, unknown or other
  misc_feature (390)..(390): n is a, c, g, or t
  modified_base (392)..(418): a, c, t, g, unknown or other
  misc_feature (392)..(418): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcacgtttcggcggggggaccaagggtggagatcgaagcgaactgtggctgcaccatctgtcttcacttctcccgctatctgatatacgatcgctgagcggctggcaaggcncagtagncnnnnnnnnnnnnnnnnnnnnnnnnnnn

SEQ ID NO: 72937 - DNA, 533 bp, Homo sapiens
  misc_feature: GYAE6OF02G6R4T.52.32.C10.1.454.CMB.1.raw
  modified_base (407)..(407): a, c, t, g, unknown or other
  misc_feature (407)..(407): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctagaattggtatcagacaaaaaccagggacacgacccctaaactcctagactcctcgatgcatccactttaggaaacaggggtccagtacaaggttcagtggaagtggctcgtgggacagtattttactttcactatcagcaggctgcagcagaanacattgactaatatattactagttactaactagtactagtaagtacgttccgtacccgtcttaccgtacggtttaccgggacggggggtaaccaaggggtcggaaggtacgtacgagacgtaacgg

SEQ ID NO: 72938 - DNA, 396 bp, Homo sapiens
  misc_feature: GYAE6OF02GS9YE.52.32.C10.1.454.CMB.1.raw
  modified_base (240)..(240): a, c, t, g, unknown or other
  misc_feature (240)..(240): n is a, c, g, or t
  modified_base (385)..(396): a, c, t, g, unknown or other
  misc_feature (385)..(396): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacntattactgtcaacagtatgatagtctcccgctcactttcggcggggggaccaaggtggagatcaagcgaactgtgctgcaccatctgtcttcatcttcccgcctatctgatatacgatcgctgagcggctggcaaggcgcatagnnnnnnnnnnnn

SEQ ID NO: 72939 - DNA, 638 bp, Homo sapiens
  misc_feature: GYAE6OF02JEZ1A.52.32.C10.1.454.CMB.1.raw
  modified_base (203)..(203): a, c, t, g, unknown or other
  misc_feature (203)..(203): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctatgganacagaatcaccatcacttgccgggcgagtcgagacattagcatgtatctgattggtatcagacaaaaccagggacacgacccctaaactcctagactcctcgatcgactactacctacttaggaaacgtacggggttacccagttaccgtaacggttacaaggttacggaaggttacggtctacgtacggggaactaaggttactttttaacgttcctaacctacgttaccaggtccgaacggtccgtgtaccgtacggtacccttaggaaacgtacgtaagtttcgaaccgtaactacgttaatttaaccgtcgttacctaaacgtagttaacgtagttaacgtacgttcgtaccccgtcttaccgttacggtttcccggggacgggggtaacctaagggtcggaacgtagttaaccggacggtacgtaaccgg

SEQ ID NO: 72940 - DNA, 515 bp, Homo sapiens
  misc_feature: GYAE6OF02IVDFU.52.32.C10.1.454.CMB.1.raw
  modified_base (273)..(273): a, c, t, g, unknown or other
  misc_feature (273)..(273): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaacngggacagacccctaaactcctagactcctcgatgcatccacttaggaaacaggggtacccatcaaggttcagtggaagtggactcgtgggacagtattttacttcgacctatcagcaggctagcagcctgaacgcaattgacaactatattacctagttaccaacgtagttatagtatagtcctcccgcttaccgaccgtttcgggcggggtacaacggtggagtagtacgtacgcgtaacg

SEQ ID NO: 72941 - DNA, 732 bp, Homo sapiens
  misc_feature: GYAE6OF02I2UPH.52.32.C10.1.454.CMB.1.raw
tcagcgcagtacgacacgaccggtgctcgatttagtatagacatcaacacacaaagggggcaggagtcagtccaaccaggacacagcatggacatgagggtccctgctcagctcctggggctcctgctgctctggctctcaggtgccagatgtgtcatccagatgacccagtctccatcctccctgtctgcatctataggagacagaatcaccagtcacttggccgggcgagtcgagacattagcatgtatctgaattggtattcagtacaaaaaccgagggacacgacccctaaactcctagactcctcgatcgctactaccctacgtttacggaaacgtaccgggggtacccagttacgaacggttacgaaggtaggtaaggtcggtacctcgtaggggacctaaggttaacttttaaccttttaccgaaccttaacgtacctaacggtaccgacgggtacctcggtaccgacggtacccgtaggaaaccgtaaccgtaacgtttacggaacgtaaacccgttaagtttaaacgtttaaccgttacggttaaccctaaaacgtacgtttaaagttacggtaaacgtttaccggttaacccgttaccccggttaacccgtttaaccgttacccgggttttaacccggggggaccgggggggtaaaccccggttaaaggggttacggtaaaccggttaacggtaaccgtaacgggtaccgttaaacccgggg

SEQ ID NO: 72942 - DNA, 548 bp, Homo sapiens
  misc_feature: GYAE6OF02IHEM9.52.32.C10.1.454.CMB.1.raw
  modified_base (204)..(204): a, c, t, g, unknown or other
  misc_feature (204)..(204): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctatagganacagaatcaccatcattgccggcgagtcgagacattagcatgtatctgaattgtatcagacaaaaaccgagggacagacccctaaactcctagatcctcgatgacatccactttaggaaacgacgggtccaatcaaaggttcagtggaagtcggactcgtagggactaggttaacttttactttcgaacctattcacggcaggtctgcanacctgaanctatagacaaactntaattactagtactaacagttatagtatagtcctaccgtctactaccggtttacggggaccggggggtaactaacgggtcggtaacggtacgtacgaacggtacgtaaccgg

SEQ ID NO: 72943 - DNA, 564 bp, Homo sapiens
  misc_feature: GYAE6OF02HNWDT.52.32.C10.1.454.CMB.1.raw
  modified_base (276)..(276): a, c, t, g, unknown or other
  misc_feature (276)..(276): n is a, c, g, or t
  modified_base (411)..(411): a, c, t, g, unknown or other
  misc_feature (411)..(411): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcagtcgagacattagcatgtatctagaattggtatcagacaaaaaccgngggacagacccctaaatccctgactcctacgatgcatcctactttgaaacgcgggtacccagtcgtaaggttcagtggaagtggcctgtaggacagttattttacttacgactatcagcaggctgcagctagaanactattcgactaactattaacttacgtgtacctaaacgtggtaaattgaacttacgttcccttacccggtcttaccgttacccgttttacgggggccgggggttaacccgtaaggggtacgggaagtaccggttacgaacggtccggtaacgg

SEQ ID NO: 72944 - DNA, 392 bp, Homo sapiens
  misc_feature: GYAE6OF02HEOTY.52.32.C10.1.454.CMB.1.raw
  modified_base (359)..(359): a, c, t, g, unknown or other
  misc_feature (359)..(359): n is a, c, g, or t
  modified_base (385)..(392): a, c, t, g, unknown or other
  misc_feature (385)..(392): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcgggcgggggaccaagggtggagatcaagcgaactgtggctgcacatctgtcttcatctcccgcatctgatatacgatcgntgagcgggctggcgaaggcgcatagnnnnnnnn

SEQ ID NO: 72945 - DNA, 525 bp, Homo sapiens
  misc_feature: GYAE6OF02JKZ7F.52.32.C10.1.454.CMB.1.raw
  modified_base (268)..(268): a, c, t, g, unknown or other
  misc_feature (268)..(268): n is a, c, g, or t
  modified_base (449)..(449): a, c, t, g, unknown or other
  misc_feature (449)..(449): n is a, c, g, or t
  modified_base (459)..(459): a, c, t, g, unknown or other
  misc_feature (459)..(459): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
  modified_base (477)..(477): a, c, t, g, unknown or other
  misc_feature (477)..(477): n is a, c, g, or t
  modified_base (483)..(483): a, c, t, g, unknown or other
  misc_feature (483)..(483): n is a, c, g, or t
  modified_base (487)..(488): a, c, t, g, unknown or other
  misc_feature (487)..(488): n is a, c, g, or t
  modified_base (492)..(493): a, c, t, g, unknown or other
  misc_feature (492)..(493): n is a, c, g, or t
  modified_base (502)..(502): a, c, t, g, unknown or other
  misc_feature (502)..(502): n is a, c, g, or t
  modified_base (504)..(505): a, c, t, g, unknown or other
  misc_feature (504)..(505): n is a, c, g, or t
  modified_base (508)..(513): a, c, t, g, unknown or other
  misc_feature (508)..(513): n is a, c, g, or t
  modified_base (515)..(515): a, c, t, g, unknown or other
  misc_feature (515)..(515): n is a, c, g, or t
  modified_base (519)..(521): a, c, t, g, unknown or other
  misc_feature (519)..(521): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
tcagcgcagtacgacacgaccggtgctcgatttagtatagacatcaacacacaaaggcgagtcgagacattagcatgtatctgaattggtatcagcaaaaaccagggacagcccctaaactcctgatcctcgatgcatccactttggaaacagggtcccatcaaggttcagtggaagtggctctgggacagtattttcttcaccatcagcaggctgtagcctgaagcattgcaacatattactgtacaacagtactgattagctccgntcacgtttcgggcggggaaccagggtggatagtcgaagcgaaactggtcggctgctaccagtcctgttcctttcagttcctttaccccgcctagttctacggtactacggttaccgagttccggcttagggcggtaccgggtccgtagggaccgttaaacgggccggtactaggttaacgngttaccgagntacgntcncncgngcgangtcgtntgtnntctnntcgtgagtncnncgnnnnnncncgcnnncntn

SEQ ID NO: 72946 - DNA, 624 bp, Homo sapiens
  misc_feature: GYAE6OF02GVO8J.52.32.C10.1.454.CMB.1.raw
  modified_base (483)..(483): a, c, t, g, unknown or other
  misc_feature (483)..(483): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacacgcccctaaactcctagactccctcgatcgcactaccactttaggaaacgacggggtcccaagttcaaagggttcaaggttggaacgtggcttacgtggggaactaggtactttttaactttccgaacctagtaccaggtaccgagggtaccttggacctaacggtcccgtaagaaacggtactaagtttcgaaccaaacttnttaactttaacctaggttaccaaacgtaggtaattagtaattaggttccctacccggtcttaccgtaaccggttttcccggggaccggggggtaacccaaggggtttcgggaaccgtagttaccgaacggtccgtaaacgg

SEQ ID NO: 72947 - DNA, 683 bp, Homo sapiens
  misc_feature: GYAE6OF02HW41T.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcattgccgggcgagtcgagaccattagcatgtatctagaattggtatcagtaccaaaaaaccgagggacacgacccctaaacctcctagactcctcgtatcgacacttacccgacgttttacgggaaaaccgtacgggggtacccagtaccgtaaaggtttacgacggttaggaaacggtggtactcgtaggggaacaggtttaacttttttaccttacctacctaatccgaagccgaagggtccttagggacctaggacccttagggaaactaaccgttacgtttagaccgtaaactattttaaacgttaccgttacgtaacgttaaccgtaaataacgttagaacgttacgtttcccttaccccgacggttttaccctaccgggttttaaccggggggacccgggggggtaaaccgtaagggggttcgggaaacggttacgtaacggtaacggaccgttaacggg

SEQ ID NO: 72948 - DNA, 513 bp, Homo sapiens
  misc_feature: GYAE6OF02JEZP1.52.32.C10.1.454.CMB.1.raw
  modified_base (226)..(226): a, c, t, g, unknown or other
  misc_feature (226)..(226): n is a, c, g, or t
  modified_base (317)..(317): a, c, t, g, unknown or other
  misc_feature (317)..(317): n is a, c, g, or t
tcagcgcagtacgacacgaccggtgctcgatttagtatagacatcaacacacaaaggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacttgccgggngagtcgagacattagcatgtatctgaattggtatcagacaaaaccagggacagcccctaaatcctgactctcgatgcatccattggaaacngggtccatcaaggttcagtgaagtggctcgtgggacagtagtttactttcgactatcagcaggctgcagtcctagaagaccattgactaagattattaactgtacaaactagtactagtactagttccacccggtcttacacgtttccgggaccgggggtaactaaggttcgggaacgagtacctaaggctaacgg

SEQ ID NO: 72949 - DNA, 687 bp, Homo sapiens
  misc_feature: GYAE6OF02IG9SJ.52.32.C10.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (233)..(233): a, c, t, g, unknown or other
  misc_feature (233)..(233): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccactccctcctgtctnctatctagtagganacagaatcaccatcacgttcggccgggngacgtcgagactattagctagtgtatctagaagttggtatcgaagacaaaaaccgaggtacacgtacccctaaactcctagactccgtacgatcgacctactaccttacgttaacggaaaccgacggggttaccccaagttacgaaacggtttcgaaggttacggaaaggttcgtcgtaccgtagggacgttagttactttttaaccttacgaaccctaatccgaagtcgacggtactggaccgtacgtaccgttaaggaacgtacgtaacgtttacgaaccttaaactagttaacgtttaactacggtaactaacgttaacgtacgtaagtactttaccggtcccttaacccgtcccgttaccgttaccgggtttacccgggggtaaccgggggtaaccgttaaacggggtacggaacgttacgggtttaacccaacgggtaccgttaaacgg

SEQ ID NO: 72950 - DNA, 830 bp, Homo sapiens
  misc_feature: GYAE6OF02J1J1M.52.32.C10.1.454.CMB.1.raw
  modified_base (225)..(225): a, c, t, g, unknown or other
  misc_feature (225)..(225): n is a, c, g, or t
  modified_base (273)..(273): a, c, t, g, unknown or other
  misc_feature (273)..(273): n is a, c, g, or t
tcagcgcagtacgacacgaccggtgctcgatttagtatagacatcaacacacaaaggggcaggagtcagtcccaaccaggacacagcatggacatgagggtccctgctcagctcctgggctcctgctgctctggctctcaggtgccagatgtgtcatccagatgacccagtctccatcctcctgtctgcatctataggagacagaatcaccatcacttgccgggngagtcgagacattagcatgtatctgaattggtatcagacaaaaaccgnggaacacgcccctaaactcctagactcctcgtaatcgacactccaacgttttacgggaaactacgggggttaccccaagttaccgtaaacgggtttaccgtaaggttacggggtaaacggttacggggcctttacggttcggggggaacctaacgggttaactttttttaaccgttttcccaaacccgtaagtttacccgaaggtacccgtaacgggtccgttacggtacccgaaacggtccccgttaaaggaaaacccggttaacctaacggttttacgggaaccctaaaaaccgttacgttttaaaacttttaaacccggttaccgggtttaaaccctaaaaaccggtttaacggttaaaacttttacgggtaaacgttttacccgggttaccccttttaccccccgggtaaccgtttacccgggtttaaaaccccgggttttttccccgggggggaacccgggggggggttaaaccccttaaacggggggttaccgggtaaaacggttaacccggttaaaccgggtaaaccgggtaccccggtttaaaaccggg

SEQ ID NO: 72951 - DNA, 771 bp, Homo sapiens
  misc_feature: GYAE6OF02G51HE.52.32.C10.1.454.CMB.1.raw
  modified_base (205)..(205): a, c, t, g, unknown or other
  misc_feature (205)..(205): n is a, c, g, or t
  modified_base (232)..(232): a, c, t, g, unknown or other
  misc_feature (232)..(232): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgaccccagtctccatccctccctgtctgcatctatagganacagaatccaccatcacttggccgggngagtcgagacattagctatgtatcttagaatttggtatcagaaccaaaaacgaggaacacgaacccctaaactcctagacttcctcgatgtaccacttaccctacgtttaacgggaaacgtacggggtacccctaagttaacgtaagggtttaccgaagggttacgggaacggttacggggtacccgttacgggttaacgggggtaaaccgtttaacgggttttaaacgtttttttaaccctttttaacccgaaacccttaaacgtcccgttaaacggccgttaacggtaccttcggtaacccgttacgggacccgtttaacggaaacgaaaccgtttagtaccgtaacctaaacggttaaactttaacgtttaacccggttaagttaacccgaaaaccgttaaggttaacttaaggggactttacgtacccgtttcccggtaacccgtttaccgttacccgggttaccgggggtaaccggggggtaacccggtaagggttacgggaaccgtacggttaaccgaaggttccggtaacgg

SEQ ID NO: 72952 - DNA, 710 bp, Homo sapiens
  misc_feature: GYAE6OF02I584W.52.32.C10.1.454.CMB.1.raw
  modified_base (205)..(205): a, c, t, g, unknown or other
  misc_feature (205)..(205): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctccctgtctgcatctatagganacagaatcaccatcacttcggccgggagagcgagacattagcatgtatctagagttggtatacagaacaaaaacgacgggaacacgaacccctaaactcctagacttccgtacgatacgactacgttcctaacgtttaaggaaaccggtacggggtacccctaagttaaccggtaaacggttaccgaagttagggaacggttcgggtaccttcggtacggggtaactaacgggttttaacttttttaaccgtttaccgtaacctaagttccgaacggtaccgaacggtcgtacggaaccacggttacccgttaacggaaactacgtaactttacggaacctaaaccgtaattttaaaccgtttacgttaacgtaacctaaaacgttagttaacgttaggtaaacgttccttcccggttacccgtcgttaccggtttacccgggttcgggggaacccgggggttaacacggggttaggaaggtacaacgggtacgacggttaacgg

SEQ ID NO: 72953 - DNA, 703 bp, Homo sapiens
  misc_feature: GYAE6OF02GA5U4.52.32.C10.1.454.CMB.1.raw
  modified_base (231)..(231): a, c, t, g, unknown or other
  misc_feature (231)..(231): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatcctcctgtctgcatctataggagacagaactcaccatcacgttggccgggngagtcgagacattagcatgtatctagaattggtatcgagaacaaaaaccgagggacacggacccctaaactcctagtactccgtcgactcgactactcccgtaacgtttacggaaaccgtacggggttaccctaacgttacgtaaacgggttacgaacggttacgggaaacggttcgggtaccgttacggttacggggtaacgtaacggtttaactttttttaaccgtttaccgtaaaccctagttaccgaacggtacgtacggtaccgttcgaccgacgtaccgtacgtaaacgtacctagttacgaacctaaacgtattaacgtttacctagttaaaccgtaacgtaacgttaagtacgtaacttaccgttcccgtacccgtccgttaccggttaccggggttacccggggaccgggggtaacccgtaggggtacggtaaggtaccgtacggtaacggtaccggtaacgg

SEQ ID NO: 72954 - DNA, 507 bp, Homo sapiens
  misc_feature: GYAE6OF02FP3HU.52.32.C10.1.454.CMB.1.raw
  modified_base (323)..(323): a, c, t, g, unknown or other
  misc_feature (323)..(323): n is a, c, g, or t
  modified_base (456)..(456): a, c, t, g, unknown or other
  misc_feature (456)..(456): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagaccccctaaatcctgactcctcgatgcatccacttggaacngggtccatcaaggttcagtggaagtggctcgtgggactagtacttttacttcacctatcagcgaggctgacagcctagaagactattagacaactattacttactgtacaactagtatagatagtcctcccgntcctacgttcgggacggggacctaagggtcggaagcgtacgagcgtaacgg

SEQ ID NO: 72955 - DNA, 656 bp, Homo sapiens
  misc_feature: GYAE6OF02HV1KE.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcactccagatcgacccagtcctccactccctccctgtctgctatctagtaggagacagaactaccaccaatccacgttcggccgggcgtagtcgagtacattcgactatagtatcgtagtaattcggtatcgagaaccaaaaaccggagggaaccaccgtacccctaaactaccgtacgtactccgtacgatacgctactacctacgttaacggaacgtacgggtaccactacgtaacggttcgagtaggtacggtcggtcgtacggtacgggtaacttaacggtttacttttaccgttaccgacctaagtaccgacgccgtaggtcctagaccgtacgacttaagaacgtactagttacacgttaaacttagtaacttactagtaaccaagtagtaagtacgtacgttacgtaccgtcccgtacgtaccgttaccgggtccgggtacggggaaccttaggggtcgtaacggtaaccgttcggaacggaccggttaacggg

SEQ ID NO: 72956 - DNA, 560 bp, Homo sapiens
  misc_feature: GYAE6OF02GYDVZ.52.32.C10.1.454.CMB.1.raw
  modified_base (459)..(459): a, c, t, g, unknown or other
  misc_feature (459)..(459): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgagggacacgacccctaaactcctagactcctcgatcgcactcctacgtttagggaaacgtcggggtacccagtacgtaaggttcaaggtggaaggtcggctacgtggggactagttacttttacttcacctatcgagcaggctgcagcctagaacgtactagttgactaactattacttacgtntacaatagtatagtacttacgtcccgtccgtccttactaccggttccggggaccggggtaccgtaagggtcgggaacgtacgtacgtaacggacgtaacgg

SEQ ID NO: 72957 - DNA, 514 bp, Homo sapiens
  misc_feature: GYAE6OF02JBYYK.52.32.C10.1.454.CMB.1.raw
  modified_base (275)..(275): a, c, t, g, unknown or other
  misc_feature (275)..(275): n is a, c, g, or t
  modified_base (327)..(327): a, c, t, g, unknown or other
  misc_feature (327)..(327): n is a, c, g, or t
  modified_base (398)..(398): a, c, t, g, unknown or other
  misc_feature (398)..(398): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccngggacacgacccctaaactcctgactcctcgatcgcatccacgttggaaacngggtccatcgaagttcagtggatgctgtggacagtattttacttcacatcagcaggctgcagcctagaacncattagacaactactattaactgacaacgtagtantaatgtaccnccgtactcctacggtttcggggaccgggggtaactaacggggtacggaagtagtacggaaggtcgtaacgg

SEQ ID NO: 72958 - DNA, 685 bp, Homo sapiens
  misc_feature: GYAE6OF02IL0WY.52.32.C10.1.454.CMB.1.raw
  modified_base (145)..(145): a, c, t, g, unknown or other
  misc_feature (145)..(145): n is a, c, g, or t
  modified_base (202)..(202): a, c, t, g, unknown or other
  misc_feature (202)..(202): n is a, c, g, or t
  modified_base (279)..(279): a, c, t, g, unknown or other
  misc_feature (279)..(279): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtnccagatgtgtcatccagatgacccagtctccatccctcctgtctgcatctatagganacagaatccaaccatcacttcggccgggcgagtcgagacattagcatgtatctagattggtatcagacaaaaaccgngggaccacgacccctaaacgtcctagaacttcctaggaactggacctagtccctaacgttttaacgggaaaccgtaccgggggttcccctaagttacgtaaacgggttccgaagggttacgggtaaacggttcggaccgtttacgggttacggggaaccttaaggtttaactttttttaaacctttccgaaaccctagtttaccgaacggtacgtacgggtacttcggacctaacgtacccgttaagggaaacgtaacctaacggtttcgaacctaaaccttaagttaactttaccgtagttaaccaaagtagtatacgtaagtcgttacccttcccggtactccgttaccggtttccggggaccggggtactagggttaggacgtaacgtcgaaccgtgtaacgg

SEQ ID NO: 72959 - DNA, 698 bp, Homo sapiens
  misc_feature: GYAE6OF02HM6Q1.52.32.C10.1.454.CMB.1.raw
  modified_base (230)..(230): a, c, t, g, unknown or other
  misc_feature (230)..(230): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatccaaccatcacttggccggngagtcgagacattagcatgtatctagaattggtatcagacaaaaaccgagggacacgacccctaaactcctagactcctcgaatgactatccgtacgtttacgggaaacgtacggggtacccaagttacgaaacgggtttaccgaaggttagggaaacggttcgggtccttacggtacggggtaacgtacggtttaacgttttttaacctttaccgtaacctaacgttccgaacggtaccgtaacgggtaccttacggaccgtacgtaccgttacggaaagtaacccgtagtttacggaacctaaacttattaacgttacgtaacggttaacaaacgttaacgttaatacgttaacgttacgttcccgtaccccgtacgttccgttaacccgggtttacggggacccggggggtaaccgtaggggttacggaacggttaaccgtaacggtaacggccggttaaacggg

SEQ ID NO: 72960 - DNA, 570 bp, Homo sapiens
  misc_feature: GYAE6OF02IMAFF.52.32.C10.1.454.CMB.1.raw
  modified_base (228)..(228): a, c, t, g, unknown or other
  misc_feature (228)..(228): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatccaccatcacttgccggngagtcgagacattagcatgtatctgtaattggtatcagacaaaaaccaggacacgacccctaaactcctgactcctcgatcgcatcctactttacggaaacgtacgggtacccagtacaacggttcaaggtaggaaaggttcggactacggtgggactagttatttttaccgtttcaacctatcgagcgaggctcgcgtagcccgttagaacgtatacgttcgacaaactattaacttacgtacgttacaacgtaagtagtagtaatacgtcctcccgtattccgtaccggttcggggaccgggggtaacctagggtgacgtacgtacgacggacgtaacgg

SEQ ID NO: 72961 - DNA, 598 bp, Homo sapiens
  misc_feature: GYAE6OF02JRZGA.52.32.C10.1.454.CMB.1.raw
  modified_base (203)..(203): a, c, t, g, unknown or other
  misc_feature (203)..(203): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctatagganacagaatcaccatcacttgccggcgagtcgagacattagcatgtatctgtaattcggtatcagacaaaaacaggacacgacccctaaatcctagactcctcgatcgactactcctaacttaggaaacacggggtacccatacgtaagttcgtagtaggtaagtcggcgtcgtgggactacggtttattttactttaccaacctagtactaggtactaggtacttcgacgtacgtacgtacgaaagtacctagttacgaacctaactaattaacgtttaaccgtacgttaacgaaactaaggttactacggtaattacgtacctacccgtcttaccggttaccgttcggggaccggggtaacaacggggtggaacgtctaacggagtaccgtaacg

SEQ ID NO: 72962 - DNA, 549 bp, Homo sapiens
  misc_feature: GYAE6OF02GUU10.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggcgagtcgagacattagcatgtatctgaattggtatcagcaaaaaccagggacacgacccctaaactcctagactcctcgatgcactccactttaggaaactggggtacccatcgaaggttcagtggaagtggctcgtggactagtattttaccgttcacctatacagcaggctgacagcctagaactacagttgactaactatattaactgtacaactagtatagtatacgttcctacccgtcgttaccgtaccggtttaccgggggaccgggggtaacgtaacgggtcgggtaacgtacgtacgtaacggtacgtaaccggg

SEQ ID NO: 72963 - DNA, 726 bp, Homo sapiens
  misc_feature: GYAE6OF02JV4CR.52.32.C10.1.454.CMB.1.raw
  modified_base (191)..(191): a, c, t, g, unknown or other
  misc_feature (191)..(191): n is a, c, g, or t
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (245)..(245): a, c, t, g, unknown or other
  misc_feature (245)..(245): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (534)..(534): a, c, t, g, unknown or other
  misc_feature (534)..(534): n is a, c, g, or t
  modified_base (545)..(545): a, c, t, g, unknown or other
  misc_feature (545)..(545): n is a, c, g, or t
tcagcgcagtacgacacgaccggtgctcgatttagtatagacatcaacacacaaaggggcaggagtcagtcccaaccaggacacagcatggacatgagggtccctgctcagctcctgggctcctgctgctctggctctcaggtgccagatgttgctatccagatcgaacccagtcctccattccctccctntctgctactctagtaggganacagaactccaccattcacttggccggnagtcgngacattancatgtatctagtatggttanacgtanacaaaaccgtggaacgacaccccgtaaactcgtacgtactaccttagacgtacgtacctactacctaccgttttaacggaaaccggtaccgggtacctaacgttaccgtaaacgggtttcctaaagggttacgggtaaacgggtcgtaccggttacggtttacggggaaactcggtttaaccctttttaactcccggtaaacttacgtaccacgtcggtaacgtctaggtaccacggtaccgtagtaaaccgtanaccggtttaanaacctaacgttatttaacttaggtaccgttaaacaacggtttataaactttcggtaagttacctaccccggttactacccgttaccggtttaaccggtttccgggggggaccgggttaaacccttaggggggtaaccgtaggaaaacccgtttaccggtaagggtaaccccggttaacggg

SEQ ID NO: 72964 - DNA, 662 bp, Homo sapiens
  misc_feature: GYAE6OF02GC9ZH.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatgacccagtctccatcctccctgtctgcatctataggagacagaatcaccatcacgttgccgggcgagtcgagacattagcatgtatctgaattggtatcagacaaaacgaggacacgacccctaaactcctagactcctcgatgctaactccgtaacgtttacggaaaccgtacggggtaccctattacgtaaacggttctaagggtagggaaggtcggtacttacggtacggggtactaaggttaacttttttaccttactaacccgtagttaccgacggtaccgacggtcgtcgacgtacgtaccggtaagtaacgtacgtaagtttcgaacctaaacgtactttaacgtttaccttacggttaactaaacgtagttaacgtagtaacgtttaccgtccctacccggtacttacccgttaccggggtttacccggggaaccgggggttaacgtaacgggtagggtaacgagtaaccggaacggtccgttaaccggg

SEQ ID NO: 72965 - DNA, 796 bp, Homo sapiens
  misc_feature: GYAE6OF02JW4KG.52.32.C10.1.454.CMB.1.raw
  modified_base (203)..(203): a, c, t, g, unknown or other
  misc_feature (203)..(203): n is a, c, g, or t
tcagcgcagtacgacacgaccggtgctcgatttagtatagacatcaacacacaaaggggcaggagtcagtcccaaccaggacacagcatggacatgagggtccctgctcagctcctgggctcctgctgctctggctctcaggtgccagatgtgtcatccagatgacccagtctccatccctccctgtctagcatctatagganacagaatccaccatcacgtgccggagtagtcgagacctattacgctagtcgtatcgtagtaacgttaggtactacgaagaaccgaaaaacgacgggtaaccaccgtaaccccttaaacgtccgtacgtaactacccgtacggtactacgtactaccgtaccgttaacgtttaacggaaaaccggtccggggtaccctaacggttacggtaaagggttcgtaaggttacgggtaacgggttccggtacgtttaccggtaaggggtaaccgtaagttttaacctttttaacggttacccaacctagttaccgaacggtacgtacggggtcctaacgggtccgtacggttaccgtaaggtaaacggttattaaccgggtttaacaaccgtttaaaaccgtacttttaaaccggttttacgtaaccgtaacccgtaaaagttcggtttaaacgtagttaacggtttaccctttcccgtacccggtaacccttttacggttaacccggggtttacgggggggaacccggggtttaacctaaacgggggtttacgacccgggtttaaattaaccccgggtaggtaacccggtttacggg

SEQ ID NO: 72966 - DNA, 666 bp, Homo sapiens
  misc_feature: GYAE6OF02I4F0Z.52.32.C10.1.454.CMB.1.raw
  modified_base (205)..(205): a, c, t, g, unknown or other
  misc_feature (205)..(205): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccaggatgtgtcatccagatgacccagtctccatccctccctgtctgcatctatagganacagtaactccaacatccactcggcggcgagtcgagacattagacatgtaatcgtagtaattggtatacgaagaacaaaaaccgagggtaacacgacccctaaacgtcctagacttcctgactgactactccgtacttacggaaacgtaggtaccctatacgtaaggttacaggtaggaacgtggtcgtacgtagggtaactagttagtttacctttacaccttagtctaacggtactaacggtctagaccgtgtaaccgtacgaagtaccgaacgtttacggaacctaaacgttaattaaccgtttaaccgttaaccttaacgaaaccgttaaggttaaacttgtaacttacgttcccgtttaaccccgccgtttaacggtaccggttacccggggtaccgggggtaacccgttaacgggtacggtaacgaacggtaaccgaaggtacccggttaaaggg

SEQ ID NO: 72967 - DNA, 619 bp, Homo sapiens
  misc_feature: GYAE6OF02H01SV.52.32.C10.1.454.CMB.1.raw
  modified_base (230)..(230): a, c, t, g, unknown or other
  misc_feature (230)..(230): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtcctccatccctccctgtctgcatctataggagacagaatcaccatcacttcgccggngagtcgagacattgacagtgtatctagtaattggtatacagtaaccaaaacgagggacacgacccctaaactcctagactcctcgatcgactactcctacgttacgaacgtcggtccatacgtagttacgagtaggagtcgtcgtgtacggatagtttactttaccttacaacctatacgacgcgaggtcgacgtccacgttaccaagaacgtactgttaacaacctaattacttaacgttacgtacttaacaacgtaaggttaactagtaactttaaccgtcccttaccccggtactttacccggttacggtttacccgggggaacggttaccgggtaaaccgtaacggggttaccgaacgtaacggtaccgaaacggttaacccggg

SEQ ID NO: 72968 - DNA, 849 bp, Homo sapiens
  misc_feature: GYAE6OF02G0LZ1.52.32.C10.1.454.CMB.1.raw
  modified_base (718)..(718): a, c, t, g, unknown or other
  misc_feature (718)..(718): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccatccctcccgtgtctgcatctagtaggagacagaactccaacctatcctacgttcggacccggggacgtacggtccggaagtacctaagttacggcctaaggttcgttacttcgttaggtaaagttttgggtaactaaccgaaggtaaacccaaaaaaccggtacggggaaccaacccggtaaccccccttaaaacgttcccgtaaggtaacccgttccgttaaccggtaagttccgaaccttaccgttacccgtaaacgggttttacgggaaaacccgggtcgggggttaaaccccctaagtttaacccgggttaaaccggtttacggtaaacggggttacggtaacggggttaccgggtaccgtttaacgggttacgggggtaaacccgtttaacggttttaacccggtttttttaaccttaccccgtaaccttaaccggttaccgtaacggtccgtaaccgggtcctacggtaacctacccgtacgtacggaaacgtaccgttaagttaccgaacgtaacctatttaccgtttaancggtaacaaagttcgtaagtactacgttccgtacccgtacccggttcttaaccggttccgggttaccgggggaaccgggtaaccgttggggaacggttacgaaccggtacgtaacgggtaacccgttaggg

SEQ ID NO: 72969 - DNA, 488 bp, Homo sapiens
  misc_feature: GYAE6OF02FVZVS.52.32.C10.1.454.CMB.1.raw
  modified_base (228)..(228): a, c, t, g, unknown or other
  misc_feature (228)..(228): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctactctggctccgaggtgccagatgtgtcatccagatgacccagtctccatcctccctgtccgcatctgtaggagacagagtcatcatcacttgccgggnaagtcagagcattagaacgtatttaaattggtatcaacagaaaccagggaaagcccctgaactcctgatctatggttcatccactttgctgagtgggtcccatcaaggttcagtggcagtgatctgggacagattcactctcacatcacagtctgcaggctgaggtattttgctaacttacttctgtcaacagtacgttacagttccctctactttcggccctggaccatagtggatactacaacgactgtgctgctacc

SEQ ID NO: 72970 - DNA, 400 bp, Homo sapiens
  misc_feature: GYAE6OF02GBSRM.52.32.C10.1.454.CMB.1.raw
  modified_base (363)..(363): a, c, t, g, unknown or other
  misc_feature (363)..(363): n is a, c, g, or t
  modified_base (391)..(400): a, c, t, g, unknown or other
  misc_feature (391)..(400): n is a, c, g, or t
tcagcgcagtacgacacgaccggtgctcgatttagtatagacatcaacacacaaagggcgagtcgagacattagcatgtatctaaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaaacatattactgtcaacagtatgatagtctcccgctcactttcgggcgggggaccaaggtggagatcaagcgaactgtggctgcaccatctgtcttcatccttcccgctatctgatatacgatcgntgagcgggctggacaaggcgacagtagnnnnnnnnnn

SEQ ID NO: 72971 - DNA, 642 bp, Homo sapiens
  misc_feature: GYAE6OF02GKRQT.52.32.C10.1.454.CMB.1.raw
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctcctgtctgcatctataggagacagaactcaccatcacgttcgccgggngacgtcgagactattagcagtagtatctgtaattggtactcagaccaaaaacgngggaacaccgtaccctaaactccgtgactcctcgatcgactactcctaacgttacggaaacgtaccggggtaccctagtacggtaacggtttacgaacggttagggtaacggtcggtacgttcggtacgggtaacgtaaggtttaactttttacctttacccgaactacgtacgtacggtcgtacggtcgtacgtacgacgtaccgtagaaacgtactattacggacctaacgtttacttaacgttacgttacgttaccaaacgtagttaactagtactacgtacctcccggtactaccggttacggttccggggaacgggtacgaagggtgtacgtactcgaaggtccgtaacgg

SEQ ID NO: 72972 - DNA, 538 bp, Homo sapiens
  misc_feature: GYAE6OF02GB4MS.52.32.C10.1.454.CMB.1.raw
  modified_base (227)..(227): a, c, t, g, unknown or other
  misc_feature (227)..(227): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaatcaccatcacttgccgggngagtcgagacattagcatgtatctgaattggtatcagacaaaaccagggacacgacccctaaactcctgactcctcgatgcatccactttaggaaactacggggtaccatacaaggttcagtggaagtgctcgtggactagtattttacttcactatcagcgacgtctcgcacgtccgtagaacgactattcgactaactattacgttactgtacaactagtatgtatacgttcgtacccgtctaccggtacgttaccgggaccgggggtaccgtaagggtacgggacgtacgtacgaacgtcggtaacgg

SEQ ID NO: 72973 - DNA, 661 bp, Homo sapiens
  misc_feature: GYAE6OF02I3YJZ.52.32.C10.1.454.CMB.1.raw
  modified_base (207)..(207): a, c, t, g, unknown or other
  misc_feature (207)..(207): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatcccagatcgacccagtcctccatccctccctgtctgcatctatagganacagaatccaaccatcacttggccggcgagtcgagacattagcatgtatctagtaagttggtatcaagtaccaaaaccgagggacacgacccctaaactcctagactcctcgtactcgaccacgttccctacgtttacggaaacgaccggggttacccagtaccgtaaaggttaccgtaggtaggaacggttacgggccttacggtacggggtactaaggtttaactttttaccgtttaccaccgtatccgagtaccgacggctacggcgaacgtaccgtacggtaaacgacctaacgtttcgacaaaccgttattaacctttaacgttaggttaaccaacggttaataagttacgttacgtacttcccgtacccgtaaccttcgttaccgggttcccggggaacggggtaccgtaaggggtcggaaggtacgtacgtaacggtacgttaacgg

SEQ ID NO: 72974 - DNA, 686 bp, Homo sapiens
  misc_feature: GYAE6OF02JVCPC.52.32.C10.1.454.CMB.1.raw
  modified_base (144)..(144): a, c, t, g, unknown or other
  misc_feature (144)..(144): n is a, c, g, or t
  modified_base (162)..(162): a, c, t, g, unknown or other
  misc_feature (162)..(162): n is a, c, g, or t
  modified_base (170)..(170): a, c, t, g, unknown or other
  misc_feature (170)..(170): n is a, c, g, or t
  modified_base (203)..(203): a, c, t, g, unknown or other
  misc_feature (203)..(203): n is a, c, g, or t
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
tcagcgcagtacgacacgaccggtgctcgatttagtatagacatcaacacacaaaggggcaggagtcagtcccaaccaggacacagcatggacatgagggtccctgctcagctcctgggctcctgctgctctggctctcaggtnccagatgtgtcatccagntcgacccngtctccatcctcctgtcctgcatctagtagganacagaactccaccatctacgtcgccgggacgagtcgagtactaattcgactattgtatcgtagtaacttggttaactcgaacgtaaccgaaaaaccgtacgggaactaaccgaacccccttaaactccgtagaaccgtcctacgntcgactactccgtaacgttacggaacggtcgggtaccaagtcgtaacgttanacggtgtacgacggtcgtacggtagggtactagtttaacttttaccgttacaccgtagtaccgtagccgttacggctaggaccttacgtacgtacggtaactactacttacgaacgtaacgttattaaccgtttacgaccttaacgtaaaccgttataagggtttacgtaacgttaccgttaccgtccccggttaaccgtccggtttaccgggttaaccgggttaccgggggaacggttaacggtacgggtaacgtaaccggtacgtaacggtccggttaaacggg

SEQ ID NO: 72975 - DNA, 584 bp, Homo sapiens
  misc_feature: GYAE6OF02JBNCD.52.32.C10.1.454.CMB.1.raw
  modified_base (295)..(295): a, c, t, g, unknown or other
  misc_feature (295)..(295): n is a, c, g, or t
  modified_base (491)..(491): a, c, t, g, unknown or other
  misc_feature (491)..(491): n is a, c, g, or t
  modified_base (517)..(517): a, c, t, g, unknown or other
  misc_feature (517)..(517): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcacatcacttgaccggcgagtcgagacattacgcatgatctagatggtatcagacaaaaacaggacacgaccctaaactccgtanactcctcgaatgactatacctacgttaggaaacgacggggttacccaagtacgtaaaacggtcgtaaggttacgggaagtcggtacgtacggtacgggtaacctaaggtttaactttttaaccttaccgaactaactccgagacgacggctagccgtatccgaggaacatctagacctaagtactattacaacgtntaaacgtagtaagtcgattaccgtcnccgtactacgttacggttaccgggacgggtaccgaaggttaccggagtacgactaaggtccgtaagg

SEQ ID NO: 72976 - DNA, 409 bp, Homo sapiens
  misc_feature: GYAE6OF02GP2D3.52.32.C10.1.454.CMB.1.raw
  modified_base (271)..(271): a, c, t, g, unknown or other
  misc_feature (271)..(271): n is a, c, g, or t
  modified_base (316)..(316): a, c, t, g, unknown or other
  misc_feature (316)..(316): n is a, c, g, or t
  modified_base (361)..(361): a, c, t, g, unknown or other
  misc_feature (361)..(361): n is a, c, g, or t
  modified_base (387)..(387): a, c, t, g, unknown or other
  misc_feature (387)..(387): n is a, c, g, or t
  modified_base (395)..(409): a, c, t, g, unknown or other
  misc_feature (395)..(409): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagattttacttcaccatcagcaggctgcagcctgaagacattgcaacatattactgtcaacagtatgaatagtctcccgntcactttcgggcgggggtaccaaggtggagatcaagacgaactgnggctgcaccatctagtcttcatcttcccgctatctgactatacgntcgctgacgcgggctggcgaagggcncaatcgannnnnnnnnnnnnnn

SEQ ID NO: 72977 - DNA, 598 bp, Homo sapiens
  misc_feature: GYAE6OF02G3ZPL.52.32.C10.1.454.CMB.1.raw
  modified_base (228)..(228): a, c, t, g, unknown or other
  misc_feature (228)..(228): n is a, c, g, or t
  modified_base (511)..(511): a, c, t, g, unknown or other
  misc_feature (511)..(511): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctagattgtatcagacaaaacgacggacacgacccctaactcctagactcctcgatgactactacctacgttacggaaacgtacggggtaccatacgtaaggttcgagtaggaagtggcgtcgtagggacagttattttactcactatcgacgactacggtctggactacggacgtacgaaagtactagttacgactaaactataatttacgtagttaccgaaacgtagttaatacggaattaccgttacctaccccggtnttacccgttacggtttacccggggggaccggggtaacccggtaggggtacggtaacggtacggtaacgtaacgggtcgtaaaccggg

SEQ ID NO: 72978 - DNA, 656 bp, Homo sapiens
  misc_feature: GYAE6OF02JW2FN.52.32.C10.1.454.CMB.1.raw
  modified_base (204)..(204): a, c, t, g, unknown or other
  misc_feature (204)..(204): n is a, c, g, or t
tcagcgcagtacgacacgaccggtgctcgatttagtatagacatcaacacacaaagggggcaggagtcagtcccaaccaggacacagcgatggacatgagggtccctgctcagctcctgggctcctgctgctctggctctcaggtgccagatgtgtcatccagatgacccagtcctccatcctcctgtctagcatctatagganacagaactcaccatcacgttgccggcgagtcgagactattagcatcgtatctgtattggtactacgagaccaaaacgacggaacaccggacccctaaacgtcctagtaactccgtagtatcgactacctaccgtacgttacggaaacgtacgggtacctagtacggtacgtagacggttaggaacgtggtcgtacgtggtactaagttactttaaccgttcaaccgtcttacgacgtcgaaaccgtcgtaggtaccgacgtccggtaagaacgtacgtaacgttacgaaccttaaccgtattaacttaccggttaactaaccgtaaacgtattaagttaacgttacgttacgtcccttacccggtaacttccggtttaacgggttcccggggaacggggttaaccggtacggttacgggaaccgttacgttacggaacggtccgttaacggg

SEQ ID NO: 72979 - DNA, 698 bp, Homo sapiens
  misc_feature: GYAE6OF02II9C4.52.32.C10.1.454.CMB.1.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (284)..(284): a, c, t, g, unknown or other
  misc_feature (284)..(284): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatcctccctgtctgcatctagtagganacagaatccactatccacgttcggccgggngagtcgagactattagcatgtatctgaattggtatcagaacaaaaccgngggactacgacccctaactcctagactccgtacgatcgacacgtacctaacgtttacggaaaccgtcgggtacccaagtacgtaaggttcgaggtaggtaaggtcggacttcggtagggaactagtttaacgtttttaccttacctaaccctattaccgacggtaccgtaacgggtcctacggtaccgtacggttaccctaagggaaacgtaccgttaaacgtttcggaaaccttaaacgtaatttaacgtttaacttaccgtaacgtaaaccttagtaaacgttcgtaacgttaccgttacccgttaccccgtcgttaccggtttaacccggggttaccggggggtaacccgggggtaacgttaacggggtacgggtaacggttaccggtaaccgtacgggtaacgttacggg

SEQ ID NO: 72980 - DNA, 667 bp, Homo sapiens
  misc_feature: GYAE6OF02GTDME.52.32.C10.1.454.CMB.1.raw
  modified_base (276)..(276): a, c, t, g, unknown or other
  misc_feature (276)..(276): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccgngggacacgtacccctaaactcctagtactccgtacgatcgactactacctagtttacggaaacgtcggggtaccctaagtacgtaacggttacgaggtaggaacgttcggaccttacggtacggggacttaaggtttaccgttttttaacctttaccgaacccgtattaccgaacggtacgacggtccgtacggaccgtacgtacccgtaggaaaccgacttacgttacgacctaaattacgtttaacttacgtacgtaacctaacgtaagttaacgtagtaacgttacgtcccgttacccgtcttaccggtttaaccgggttccgggggaccgggggtaaccgtaggggtacggtaacggtaacgtaaccggtaaggtacccggtaacgg

SEQ ID NO: 72981 - DNA, 652 bp, Homo sapiens
  misc_feature: GYAE6OF02IXJ2S.52.32.C10.1.454.CMB.1.raw
  modified_base (207)..(207): a, c, t, g, unknown or other
  misc_feature (207)..(207): n is a, c, g, or t
  modified_base (234)..(234): a, c, t, g, unknown or other
  misc_feature (234)..(234): n is a, c, g, or t
  modified_base (440)..(440): a, c, t, g, unknown or other
  misc_feature (440)..(440): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccatccctccctgtctgctatctatagganacagaactccacatcacgtcggccggngagtcgagactattagcatgtatctagtaattggtatcagacaaaaaccgagggaccacgacccctaaactcctacgtactcccgtagactcgctactacccgtacgttaacggaaaccgtcgggtaccctagtacgtaaggttacaaggtcggtaagtcggtcgtacggtgggtaacgtacgtttactttaaccttcaacccgtntaccgacgcgtacgggtctacggtaccacgtaccgtaaggtaacgtaacgtagttacggaaccttaaacgtagtttaacttacgtacgtaacgttaaacgtagttaactacgtaattaccgtccgtaccgtaccgttaccgtaccgggtttccggggaccgggggtaacgtaacgggtacggaaccgtacgtaccggaaggtccggtaacgg

SEQ ID NO: 72982 - DNA, 1160 bp, Homo sapiens
  misc_feature: GYAE6OF02G05AM.52.32.C10.1.454.CMB.1.raw
  modified_base (336)..(336): a, c, t, g, unknown or other
  misc_feature (336)..(336): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtcctccatcctccctgtctgctatctagtaggagacagaactcaccatcacttcggccggcgagtcgagacattagctatgtatctagtaattggtatcaagaaccaaaaaccgtacgggaaccgacccgtaacccttaacctcgtactcctacgacgtcgtcnctactaccttacgtaacggaacgggtaccgtactactacggttaacgtacgtaggtaacggtacggtcggtacgtcgggtacgtaacgtttaacgttttaccttttaccgtaacctaccgttaacgtacgtaccggtaaccggtcggttaccgtaccgtaacccggtacccgttaacccggggtaaaacgtaaaaccgggtttaacccgttttaaggtaacccccgttaaaaaaacccgtttaaaaccggttttaaaaccgttttttaaaaaccccggggttttttaaaccccggttttattttttaaaaaaaccccccccgttaaaaaaagggggggtttttttttaaaaccgttttaaaaaaacccgggggtttttttaaaaccccggggtttttaaaaaccccgggtttttttacccccccggggttttttaaaaccccccccccccggggttttttaacccccgggggttttttaaaaccccccccccggggttttttttaaaacccccggggggggggttttttttttaacccccccccgggggggggggggggtttaaaaaaccccccgggggggggggggggggggttttaaaaaacccccccccccggggggggggttttaaaaaaacccgggggggggtttttttaaaaccggggggggggtaaaaaacccccggggggtttttaaaaacccggggggttttaaaaaccccccgggggttaaaaaacccccggggggggtttttaaaaaacccccccggggggggtttaaaacccccgggttttttttaaaaaacccccccgggggggggggggg

SEQ ID NO: 72983 - DNA, 552 bp, Homo sapiens
  misc_feature: GYAE6OF02FIB7X.52.32.C10.1.454.CMB.1.raw
  modified_base (230)..(230): a, c, t, g, unknown or other
  misc_feature (230)..(230): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctcctgtctgcatctataggagacagaactcaccatcaacttgccggggngagtcgagacattagcatgtatctgaattggtatcagacaaaaacgagggacacggacccctaaaactcctgactcctcgatcgcatcctatttacggaaacgacgggtccatcgaaggttcaaggtggaagtggtacgtcgtgggactagtactttttacttacacctatcgagcaggtcgtcgcgacgtcctagaacgactagttgcaatactattactacgttacaactagtatagacttagcctccggtctacgtaccggtttcggggaccgggggtaacgtacggggtacggtacgagtacggaagtaccgtaacgg

SEQ ID NO: 72984 - DNA, 735 bp, Homo sapiens
  misc_feature: GYAE6OF02GL32Y.52.32.C10.1.454.CMB.1.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (292)..(292): a, c, t, g, unknown or other
  misc_feature (292)..(292): n is a, c, g, or t
tcagcgcagtacgacacgaccggtgctcgatttagtatagacatcaacacacaaagggggcaggagtcagtcccaaccaggacacagcatggacatgagggtccctgctcagctccgtgggctcctgctgctctggctctcaggtgccagatgtgtcatccagatcgacccagtcctccattccctccctgtctgcatctatagganacagaatcacatcacgttggccggngagtcgagactattagctatgtatctagtaatttggtactacgaacgaacaaaaaaccgngggtaaccaaccggtacccccttaaaactcccgtagtacttcctacgtatcgacctattccctaacgtttaacgggaaaccgtaccggggttaaccctaacgttaaccgtaaacggttaccgaaggttacggggtaaacgttcgggaccttacgggtacgggtaactaacgtttaacgttttttaccttaccaaccgtaagtaccacggtaccgacgggtaccgttgaccgtacggttacgtaacgtaacgtactagttacgaccgtaaacgtatttaactttaaccgttacgtaacctaaacgttagttaaacgttgtaaacgttacggttcccgttacccggttcttaacccggttaccgggtttacccgggggaaccggggggtaaacccttaagggggacgtaaacggtacgtaacggaacgggttacccgtaaacggg

SEQ ID NO: 72985 - DNA, 737 bp, Homo sapiens
  misc_feature: GYAE6OF02I3Z6Q.52.32.C10.1.454.CMB.1.raw
  modified_base (152)..(152): a, c, t, g, unknown or other
  misc_feature (152)..(152): n is a, c, g, or t
  modified_base (164)..(164): a, c, t, g, unknown or other
  misc_feature (164)..(164): n is a, c, g, or t
  modified_base (714)..(714): a, c, t, g, unknown or other
  misc_feature (714)..(714): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcgaggtgccagntgtgtcatcagntgacccagtcctccatccctcctgtctacgcattctaagtaggagacagtaactccaaccctattacctacgttcggcccgggacgtacggttccggaacgtaacgtaattacggactagttacggtaacttcgtagtaagtttacggtactcgaaacgaaccgaaaaaaccgacgggtaaccacccggtaaccccttaaaccgttacctagacctaccgtagtacgtacgacctactaccgtaacgttagggaaaccgcgggtacctagtacgtagttagtacggtaggtagtacgtcgttacgaggaactagtttacttttacttaccgaccttaagccacggacgtacgtcgtgaaccttacccggacgtaacacggttactaggttaaccaacgttaaactcgttaacttaagttccgaaagtaccgttaagttaaccgaagttacccgttccggtttaacccctcccggttacccgttaccggttaaccgggggtttacccggggaaccgggggttacgtaacggttcggaccgttaaaccgggnggttaacccgttacggtaccggg

SEQ ID NO: 72986 - DNA, 796 bp, Homo sapiens
  misc_feature: GYAE6OF02H41MO.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccattcctccctgtctgcatctataggagacagaatcaccatcacgttggccgggcgagtcgagacattagcatgtatctgtaattggtatcaagaccaaaaacgagggacacgacccctaaactcctgactccgtcgatacgactacttacctacgtttaagggaaaaccgtaccgggggtaccctaagttacgtaaaacgggtttccgtaaagggttacggggtaaggttacggggtctttaccgggttaagggggtaaccgtaaacggttttaactttttttaacccttttacccgaaacccttaacgttaccgtaacggtccgtaaacggggtcttacggaccgtaacggtacccgtaacggtaaactaccggttaaacgtttacggaacttaaaccaattttaacgttttaaaccgttacggttaaactaaaacccggttaggttaaaagttaggtaaacgttacccgtttacccgtaccccccggttcgttttaaccccgttaccgggggtttttaacccgggggtaacccggggggggtaaaccccggttaaggggggtacgggttaaaccgggaacgtttaaacccgggaaacgggttaccgttaaaccgggg

SEQ ID NO: 72987 - DNA, 687 bp, Homo sapiens
  misc_feature: GYAE6OF02I07MQ.52.32.C10.1.454.CMB.1.raw
  modified_base (295)..(295): a, c, t, g, unknown or other
  misc_feature (295)..(295): n is a, c, g, or t
tcagcgcagtacgacacgaccggtgctcgatttagtatagacatcaacacacaaagggggcaggagtcagtccaaccaggacacagcatggacatgagggtccctgctcagctcctggggctcctgctgctctggctctcaggtgccagatgtgtcatccagatcgacccagtctccatcctccctgtctgctatctaataggacgacagaatcacatcacttcggccggtcgagtcgagactattacgctacgttgtaactcgtagtaattgggtaatcgaagaccaaaaccgngggaactaccgaaccctaaactcctagtacctcctacgatcgtacactccgtagttacggaaccgtcgggtacctagtacgtaacggttcagggtacgtaaggttcggtcctacggtaggacgtacggtttaacttttacgttaccgaaccttacgttacgaccgtacgtaacgggtcgtacgtaccggtacgtaccgttacggaaactacgtacgtttacgaacctaaaccgttaagtttaaccgttaacgttacgtaacgtaactaacggtaagttaacgttaccgtacgtttaccctcccgggttaacttaacccggttcggggttaacccggggacggggtaaccggttaggtacggaaccgtacgtaacggtaccggtcgttaacgg

SEQ ID NO: 72988 - DNA, 662 bp, Homo sapiens
  misc_feature: GYAE6OF02H7KBV.52.32.C10.1.454.CMB.1.raw
  modified_base (155)..(155): a, c, t, g, unknown or other
  misc_feature (155)..(155): n is a, c, g, or t
  modified_base (171)..(171): a, c, t, g, unknown or other
  misc_feature (171)..(171): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtntcatccagatgacccngtctccatccctcctgtctagcagttctaataggagacagaactccaaccatccacttcggcgggacgagtcgaagacattagcatgtatctagtaattacggtatcaagaaccaaaaaaccgagggaaccacggacccctaaactcgtagacctcctagatacgctaactccgaacgttttacggaacgtacggggtacccattacgaaaggttcaggttaggaaggttcgcgtacgtaggggtactaggtttacttttaccgtttacgaaccctagtcaacggccgtaggtactacggtaccgacgttaccgtaagaagtaccgtaacttcggaactaaacgtattaactttacgtacgtaacgtaaaccgtagttaacgttataacgttacgtcccgttacccgtcgttaccggttaaccggtttcggggaccgggggtaaccgtaggggtaacggtacgtaggttaacgaaccggtacgtaaccggg

SEQ ID NO: 72989 - DNA, 675 bp, Homo sapiens
  misc_feature: GYAE6OF02INOC2.52.32.C10.1.454.CMB.1.raw
  modified_base (513)..(513): a, c, t, g, unknown or other
  misc_feature (513)..(513): n is a, c, g, or t
  modified_base (657)..(657): a, c, t, g, unknown or other
  misc_feature (657)..(657): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctgctcgtggctctcgaggtgccagatgtgtcatccagatcgacccagtcctccactccctcctgtctcgactatctaagtacggagaacaagactaccaaccactacctacgtcgggccggacgtacggtacgaagactaagttaccgataacgttagtacgttataggtaagttaggttaacacgaaagaaaacccgaaaaaccggaggaacccaacccgtaacccctaaaaccgtccgtaagtaccttacctacgatcgtaactactaccgttacgttaaacggacgtacggtacctagtaccgtaaggtcaaggtaggtaattggctacggagaacgttagtttaactttacgtacctacgtactaggacgtacgagtacnggacctacgagtaaacgagtactagaacgaactaatagttactaacgtactaaactaacggtagttaaatacgttaaacgttcctaaccgttccgtccgttacgtaccgggttaacggggacgggtaacagggttgaacgttanaacgttacggagttacgg

SEQ ID NO: 72990 - DNA, 767 bp, Homo sapiens
  misc_feature: GYAE6OF02I2QOY.52.32.C10.1.454.CMB.1.raw
  modified_base (206)..(206): a, c, t, g, unknown or other
  misc_feature (206)..(206): n is a, c, g, or t
  modified_base (284)..(284): a, c, t, g, unknown or other
  misc_feature (284)..(284): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatcgacccagtctccactcctccctgcctgcattctaatagganacagaatcaccatcacgtggccggcgagtcgagactatacgctagtgtatctgaattgtatcgaacgtaacaaaacgnggaacacgacccctaactcctagtactccgtacgtagtcgctactccgtaacgttacggaaaccggtcggtaccctagttaccgtaagttacgtaaggtaggtaaacggttcggtacgtacgggtacgggtacttaaacggtttaacttttaccgtttacccgtaaccgtaacgtaccgtacgtaccgtaacggtccgttacgtaccgacggtcccgtaaggtaaacccgttacttaacgttacggtaaaccttaaacgttaacgtttaacgtttaaccgtaccgttaaaccgttaaacgtaacggtttaacgttacgtaaccggtttacccgttaccccggttaaccccggttacgtttaaccccggggttacccgggtttaacccggggggaaccccgggggggttaaaccgttaacgggggtacccgggtaaacggttaacgggtaaaccccgtaaccggggttaacccggttaaccggg

SEQ ID NO: 72991 - DNA, 708 bp, Homo sapiens
  misc_feature: GYAE6OF02JCRIO.52.32.C10.1.454.CMB.1.raw
  modified_base (232)..(232): a, c, t, g, unknown or other
  misc_feature (232)..(232): n is a, c, g, or t
  modified_base (283)..(283): a, c, t, g, unknown or other
  misc_feature (283)..(283): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatccaccatcacgttcggccgggngagtcgagacattagcatgtatctagtaacttgtaatcagaaccaaaacgnggacaccgacccctaaactctagactccgtcgatcgactactacctacgtttaacgggaaacgtaccggggtaccctacgtacggtaacggttcgaagggttagggtaacgggttcggtaccgttacgggtacggggtaacttacggttttaacttttttaccgttaccctaaccgtagtaccgaacgtaccggtacggtacctaggaccgtacggtaccgtaaaggactaaaccgtagttacgaacctaaacgttacgtttaactttaccgttacgttaacctaaaggtaacgtttaagtacgttaacgttaccgttacccgttccccggtaacgttaacccggttaccgggtttacccgggggaaccggggttaacgtacggggtaacgtaccggtacgtaacggtacggacggttaaccggg

SEQ ID NO: 72992 - DNA, 831 bp, Homo sapiens
  misc_feature: GYAE6OF02HWKH0.52.32.C10.1.454.CMB.1.raw
  modified_base (164)..(164): a, c, t, g, unknown or other
  misc_feature (164)..(164): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagntgacccagtctccatccctccctgtctgcatctagtaggagacagaatccaaccatcacgttcggccgggcgagtcgagacattagacagtgtatacgttagtaagttacggtatacgaacgaaaccaaaaaccggagggaaccaaccgtaaccccctaaacctcctacgtactccctacgacttacgacctactaccgtaacgtttaacggaaacccggtacggggtaccctaacgttaaccgtaaacggttcgtaacgggttaggtaacggtacgggtccgtttacgggtaacggggtaaccgttaacggttttaacgtttttaccccgttttacctaaacccgttagttaacccggtacggtaccggtaacgggttcccgtacgtaccggtaccggtccgttaaacggtaaacctaccgttaaacgtttacggaaaccttaaacgttaacgttttaaacccgtttaacgttaccggttaaaccgtaaacgttaaggttaacgtttaacgtaaccggtttaccgttaccccgtttacccggtacccgttttacccgggttaacccggggtttacccggggggaacccggggggtttaaccggtaacgggggttaaccggaaacggtttaccggtaaaccggttacgggtaacccggttaaccggg

SEQ ID NO: 72993 - DNA, 404 bp, Homo sapiens
  misc_feature: GYAE6OF02IZOUW.52.32.C10.1.454.CMB.1.raw
  modified_base (325)..(325): a, c, t, g, unknown or other
  misc_feature (325)..(325): n is a, c, g, or t
  modified_base (350)..(350): a, c, t, g, unknown or other
  misc_feature (350)..(350): n is a, c, g, or t
  modified_base (388)..(388): a, c, t, g, unknown or other
  misc_feature (388)..(388): n is a, c, g, or t
  modified_base (394)..(404): a, c, t, g, unknown or other
  misc_feature (394)..(404): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacagggtcccatcaaggttcagtggaagtggctctgggacagattttacttcaccatcagcaggctgcagcctgaacgacattgcaaacatacttactgtcaacagtatgatagtacctccccgctctacgtttcggcggggggaacccaagggtggagatacaaggcgaactgnggctgcacatctgtctcatcctccnccatctgatatcgatcgctagagcggatgggacaggcncatagnnnnnnnnnnn

SEQ ID NO: 72994 - DNA, 657 bp, Homo sapiens
  misc_feature: GYAE6OF02H2YIR.52.32.C10.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (504)..(504): a, c, t, g, unknown or other
  misc_feature (504)..(504): n is a, c, g, or t
  modified_base (524)..(524): a, c, t, g, unknown or other
  misc_feature (524)..(524): n is a, c, g, or t
  modified_base (532)..(532): a, c, t, g, unknown or other
  misc_feature (532)..(532): n is a, c, g, or t
  modified_base (583)..(583): a, c, t, g, unknown or other
  misc_feature (583)..(583): n is a, c, g, or t
  modified_base (643)..(643): a, c, t, g, unknown or other
  misc_feature (643)..(643): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcaggtgccagatgtgtcatccagatcgacccagtctcacttccctcctgtctgcatntataggganaacagaatccacctacgtcctattcgggccgggacggacggaccgaagacctagttaacgactattgttagttacgttaggtaagtttacggtactacgaaacgaaccgaaaaaaccgacgggaaccaccgtaacccccttaaacgtacccgtagaaccttaccgacggtacttcgaacaaccgttcccgttaaccgttttaacggaaaccggtacgggtaccctagtaaccgtaagggttctaaggtacggaacgttcgacgtcgtacggtaatacgtttacttttacttacacgntacagagtcgctagaccgtntaccgtanaacgtactagtagaacctaaatcttaagtccgtactactaacgtatagtanatacggtacccttcgccgtttacgcggttacggggacggagttaggacgtagaccgttanacgggtaccttagg

SEQ ID NO: 72995 - DNA, 592 bp, Homo sapiens
  misc_feature: GYAE6OF02HPDLX.52.32.C10.1.454.CMB.1.raw
  modified_base (227)..(227): a, c, t, g, unknown or other
  misc_feature (227)..(227): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggngagtcgagacattagcatgtatctgaattggtatcagacaaaaaccgagggaacacgacccctaaactcctagactcctcgatggacctataccctacgtttacggaaaccgtacggggtacccaagtacgtaaagggttcaaggtagggaaggtggcttcgtaggggtactagttactttttaactttccacctatacagcgaggctagctacgcctagaacactagttcgacaactagttattacgtgtaacaacgtagtaatagtactacgttcctacccgtcttaccgtacgggtttacccggggaccggggggtaaccgtaggggtacggaacgtacgtaacgtacggtaccggtaacgg

SEQ ID NO: 72996 - DNA, 674 bp, Homo sapiens
  misc_feature: GYAE6OF02JZT0R.52.32.C10.1.454.CMB.1.raw
  modified_base (311)..(311): a, c, t, g, unknown or other
  misc_feature (311)..(311): n is a, c, g, or t
  modified_base (315)..(315): a, c, t, g, unknown or other
  misc_feature (315)..(315): n is a, c, g, or t
  modified_base (532)..(532): a, c, t, g, unknown or other
  misc_feature (532)..(532): n is a, c, g, or t
tcagcgcagtacgacacgaccggtgctcgatttagtatagacatcaacacacaaagggggcaggagtcagtcccaaccaggacacagcatggacatgacgggtccctgctcagctcctgggctcctgctgctctggctctcaggtgccagatgtgtcatccagatgacccagtcctccatccctcctgtctgcatctataggagacagaatccaccagtcacgttgccgggacgagtcgagacacttagctatgtatactagtattggtatcagacaaaacgaggacacgacccctaacgtcctgactccngtanagctactaccacgttaacgaacgtacggggtaccctacgtacgtaacggttacaggtaggtaacggtaggctacgttagggaaccgttaggtacttttacgtttacaacctactcgaacgtccgtacggtcgtagactaccgaccgtacgtaaacgtacctagttcgactaaacctagtttaacttaccggtagttaacctaacgtaggtaacgttntaaacgttcgtaccggtttacccaacggttcctttaaccggggtttacccggggggtaacccggggtaacccgggtttaacgggttacccggggaaagggtaccccgttttaaagggtaacccgggtacgggtttaacccgg

SEQ ID NO: 72997 - DNA, 641 bp, Homo sapiens
  misc_feature: GYAE6OF02F4EUQ.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctccctgtctgcatctataggagacagaatcacatcacgttgccggcgagtcgagacattagacatgtatctagtattggtatacagaccaaaacgaggtacacgacccctaaactcctagactccgtacgtatcgctacgtaccctacgttacggaaacgtaccggggtaccaacgttacgtaacgggttacaaggttagggaagtcggtaccgtacgtagggtactaagttacttttaccgttacgtaacctagtacgagtacgtaggtcctacgcgacgacgtagaacgtactagttacgactaactaacgttattaacctgtaaacctacgtaacgttgttagtaacttcgtacccgtacccggtacgttaccgttaccgggtttaccggggaaccgggggtaacgtaacggggttacgggtaagtaaccggtaacggtaacgtacccgttaaggg

SEQ ID NO: 72998 - DNA, 847 bp, Homo sapiens
  misc_feature: GYAE6OF02JMHI3.52.32.C10.1.454.CMB.1.raw
  modified_base (200)..(200): a, c, t, g, unknown or other
  misc_feature (200)..(200): n is a, c, g, or t
  modified_base (729)..(729): a, c, t, g, unknown or other
  misc_feature (729)..(729): n is a, c, g, or t
tcagcgcagtacgacacgaccggtgctcgatttagtatagacatcaacacacaaaggggcaggagtcagtcccaaccaggacacagcatggacatgagggtccctgctcagctcctgggctcctgctgctctggctctcaggtgccagatgtgtcatccagatgacccagtctccatcctccctgtctgcatctataganacagatcaccagtctacgttggccggcgagtcgagaacagttagccagttgtaactctagtaatttggtaactcgtaacgacccaaaaaaccgacggggaacccaacggaccccccttaaaacttccctcggtaacttacccctacgtaacgtaccggactaaccgttacccgttaaccgtttaacgggaaaacccgtacccgggggttaccctaacgttaccggtaaacggtttacgaaacgggtttaggaaacggtacccggttcgttaccgggttaacgggaacccgttaaacgggttttacctttttaaaccgtttttaaccctaaccgtaaccgtttaaccgaaccggtaaccggtaccgggtaccttaccggtaaccgtaaccgttcccgtaacggtaaacggttaaccctaacggttttaaccgaacccgttaaaaccttacgtttaaacgtttaacccgttaacgtttaaccgtaaaacgttaccgttaaagttaccggttaaccgttacggtttaacccnccccggttaaccttaccggttttaacgggttaaccccggggaccgggggggtaaacccttaaccgggggttaacggtaaccgtaaccggtttaaccggaacggtaccgttaacccggg

SEQ ID NO: 72999 - DNA, 732 bp, Homo sapiens
  misc_feature: GYAE6OF02G1ECD.52.32.C10.1.454.CMB.1.raw
  modified_base (205)..(205): a, c, t, g, unknown or other
  misc_feature (205)..(205): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccactcctccctgtctgcatctagtagganaacagaactccaaccatacctacgttcggacccgggcgtacggtccgaagaacctaagttagactaagttcgtactcgttagtaagtttaggtaactacgaagaaacccaaaaaccggacgggaaccaaccgtaaccccctaaacgtcctagacctaccgtacgtactcgactactaccgtaacgttaacggaaacggtaccgggtaccctaagttacaacgggtttacaaggtagggtaacggtcggtaccgttacggtacgggtaacttaaggtttaactttttaaccgttaccaaaccttacgtacgtacggtacgtaacggtcgtacggccgtaagccgtaacgaaacgtaacctagttacgaactaacgtaactttaacttacgtacgtaacgtaaactcggttaagttacgtaacgttcgtacccttcccgccgttaccgggtttacggggttacccggggggaccggggttaccgaaggggtttcggaagtaccggtacgtaaccggtcggttaaccggg

SEQ ID NO: 73000 - DNA, 740 bp, Homo sapiens
  misc_feature: GYAE6OF02F4VQ7.52.32.C10.1.454.CMB.1.raw
  modified_base (228)..(228): a, c, t, g, unknown or other
  misc_feature (228)..(228): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggngagtcgagacattagcatgtatctgaattggtatacagacaaaaaccgagggacacgacccctaaaactcctagactccgtcgaatcgacacttaccctaacttttacgggaaaaccgtacgggggtaccccaaagttacgtaaagggtttacaaggttagggaaaggttgggtaccttcgtagggggaacctaaggtttactttttttaaaccttttacgaaccctaattaccgaaagggtacccgtaaggggtaccgttacggaccgtaaccggtacccgttaaggaaaacggtacctaagttttacggacctaaaacgtactttaaactttaaccgttacggttaacaaaaccgttaaggttaagttagtaacgtttacggttacccttaccccggtacctttacccggttaaccggttttcccggggggacccggggggggtaaaccgttaaacgggggttacgggaaacggtacggttaaccgtaaacgggtaccggttaaaccggg

SEQ ID NO: 73001 - DNA, 925 bp, Homo sapiens
  misc_feature: GYAE6OF02JCDE9.52.32.C10.1.454.CMB.1.raw
  modified_base (180)..(180): a, c, t, g, unknown or other
  misc_feature (180)..(180): n is a, c, g, or t
tcagcgcagtacgacacgaccggtgctcgatttagtatagacatcaacacacaaaggggcaggagtcagtcccaaccaggacacagcatggacatgaggtccctgctcagctcctggggctcctgctgctctggctctcaggtgccagatgtgtcatccagatcgaccctagtcctaccncttccctcccttgtctcgtacattccgttaatagggaactaacaagtaaaccttaccgaacctaacttaccgtacgtttaccgggacccggggacgtacggttaccggaaaggtaactaacggtttaacggaccttaagttacggttaacgttaccgttaaggttaaaggttttacggggttaaactcccggtaaaaacggtaaaccccgtaaaaaaaccggggaccggggttaaaccctaaaccccggttaaaccccccctttaaaaccggttccccttaaaggtacccttaaccccggtagtaacgtttaccggacctaaccgtttaccgtaaaccgggtttaaaccgggtaaaccgtaccggggttaccctaaaggttaccgttaaaaacggtttcgtaagggttacgggtaaccggttacggtaccgtttacggtacggggtaaccttacggtttttaaccttttaacgttacccgtaaactacgttaccaaagggtccgttaaggtacccgttaggaccttaaccgggtaccgttagaaacggttaccttaagtaacgaaccgttaaacttaaggttaaccttaccggttaacgtaaaccttaaacggtaggtaaacttacgttaacgttccgttaccgtacccgtacgttaccggggtaccgtttacgggggggtaacccggtaacgggttaaccgggagttaacccgtaaggtaaccggtacggaacggtttaaccgg

SEQ ID NO: 73002 - DNA, 611 bp, Homo sapiens
  misc_feature: GYAE6OF02GHIWX.52.32.C10.1.454.CMB.1.raw
  modified_base (289)..(289): a, c, t, g, unknown or other
  misc_feature (289)..(289): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccacttccctccctgtctgctatctataggagacagaactcaccatcacgttggccggacgagtcgagactagttagctatgttatctagtattgtactcaagaacaaaacgnggacaccgtaccctaactctgactcctagatgactactctaacgttacggaaacggtcggtacctagtacgtaacgtgtaggtagacggtcgcgtcgtacgggacttacgtttacttttacgtactaacctagtacgtacgacgtacggtctagacgacgtccgtaagaacgtactaagtacgtaactaacgtacgtttactacgtacgtaacctaaacgtaacgtacttagacttacgttcctacccgtccgtaccggttaccggtcggggtaaccgggtaccgtaagggtcgtaagtaccgtaacgacggtacgtaacgg

SEQ ID NO: 73003 - DNA, 696 bp, Homo sapiens
  misc_feature: GYAE6OF02H47RL.52.32.C10.1.454.CMB.1.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (341)..(341): a, c, t, g, unknown or other
  misc_feature (341)..(341): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggttctcaggtgccagatggtgtcatccagatgacccagtctccatccctcctgtcngccatctatagganacagaatcaccatcacgttcgccgggcgagtccganacattacgntatagttatctagtagttggtatacagaaccgaaaaaccgagggaacctaacccggtacccctaaaaccgtccgtacgtacttacccgtanacgtcgtactactacccgttagttaaaccggaaacggtacgggtaccccaagtacgtaaggttacgtaggacggttagcggtcgtacggtgggtaactacgttaacgttttactttacccgtaactacgtacgacgacgtcggtgccggtacgtaaccgtcgtaaggtaacgttaacgtatttacccgtaaacgaactttaaacgttaaccttaacgtttaccggtaacttaaccgttaaggtacttagtacgttacccgttacccgtccgttaccgtacccgtttacggggttaccgggggtaccggggacgtaaggggtcgtacggaacgttaacggagtacccggtagtcgg

SEQ ID NO: 73004 - DNA, 695 bp, Homo sapiens
  misc_feature: GYAE6OF02HWZUA.52.32.C10.1.454.CMB.1.raw
  modified_base (135)..(135): a, c, t, g, unknown or other
  misc_feature (135)..(135): n is a, c, g, or t
tcagcgcagtacgacacgaccggtgctcgatttagtatagacatcaacacacaaaggggggcaggagtcagtcccaaccaggacacagcatggacatgagggtccctgctcagctccgtggggctcctgctgctntggctctcaggtgccagatgtgtcatccagatcgacccagtcctccactcccttccctgtctagctactcttaagtaggacgacagaactaccaacctagtctacgttcggccggggcgagtccggagtactagtacgactagtcgtatctagtaagtttggtatacgaagaaaccaaaaaccggacggaacctaccggtaaaccccttaaacttccgtacgacttcccgtacgtactcggacctaactaccgtacgttaaacgggaacgtaaccggggtaccaacgtacgtaacggttagtaaggtaacgggtacggtcggtaccgtacgggtacggtaacgttaagtttacttttaccgttacaaccgtatacgacgtacggaggtcctaggcaccgtacggtaacgaacgtactacgtacgacctaaactaagttactactaacgtacgtaactaagtacgttacgactccgtaccgtacccgtcgttaccggtaccgggttcgggggaaccggtaggtaacgggtcgtaaccgggtatacggaacggtcgtaacgg

SEQ ID NO: 73005 - DNA, 758 bp, Homo sapiens
  misc_feature: GYAE6OF02GFF5V.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctccctgtctgctatctagtaggacgacaagaactccaaccacttcaccgttggcccggggacgtacggtacggaagacgtagttacgactaattgtacttcgtagtaagtttcggtaactacgtaacgaaaccgaaaaaccggacgggaaccgtaaccggtaacccccttaaacctccgtagtaccttcccgtacgtatcgacctacttaccctaacggttaacgggtaaaccgtaccggggtaaccctagttaccgtaacggttacgtaagggttacgggaacggtcggtccgtacggtagggtaaccttaaggtttaacctttttacgttacctaaccgttactacccgtaggtaccgtacggtccgtacgtaccgaccgtacgtagaacgtactacgttacgaaacctaacttactttaacttaccgtagtaccgttaaacgtagtttaacgtagtacgtttaccgtcccttacccggtacgttacccggttaaccgggtttcccgggggaaccggggttaaccgggtaggggtacggtaacggtacgtaacggaccggttaggtaaccggg

SEQ ID NO: 73006 - DNA, 880 bp, Homo sapiens
  misc_feature: GYAE6OF02JXUYD.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctccctgtctgctatctaagtaggagaacagaactccacctataccacgttcgggacccggcgtaaggtccaagacctattaacgctaagtgtacttcgtagttagttaggtaataccgaaaggaaacctaaaaaccgggacgggaacccctaaacccggttaacccccctttaaaccgtacccttaacggtaccctttaacccgttacgggaacttacggaccccttaaacgttaccccgtttaaacggttttaaccggggaaaacccgggttacgggggttaccccctttaaggttaaaaccggtttacgggtttaaccggttaggggtaaagggttaaccggggtttccggtacggttttaccgggacggggttaaaccgttaaacggtttttaccttttttacccgttaacccgttaaaccttaccgttacggaacggtaccggtaacgggtcgttcgggaccttaaacggtacccggttaacggaaaccgttaaaccttaacggttacgaaccttaaacgttactttaaccgtttaacgtaccttaacgtaacgttaggttacgtaaccgttacgtttccgtaacccttccggtacccgttaccgggttaccgggttaccgggggaaccccggggtttaaagtaccgggttaaggggtaaccgtaggtaaaccgggtactacccgggtaacgg

SEQ ID NO: 73007 - DNA, 815 bp, Homo sapiens
  misc_feature: GYAE6OF02H8PCM.52.32.C10.1.454.CMB.1.raw
  modified_base (174)..(174): a, c, t, g, unknown or other
  misc_feature (174)..(174): n is a, c, g, or t
  modified_base (259)..(259): a, c, t, g, unknown or other
  misc_feature (259)..(259): n is a, c, g, or t
  modified_base (646)..(646): a, c, t, g, unknown or other
  misc_feature (646)..(646): n is a, c, g, or t
tcagcgcagtacgacacgaccggtgctcgatttagtatagacatcaacacacaaagggggcaggagtcagtcccaaccaggacacagcatggacatgagggtccctgctcagctcctgggcctcctgctgctctggctctcaggtcgccagatgtgtcatccagtatgaacccngtcctcactccctcctgtctgctattctataggagacagaactccaactatacctacgttcgggccgggtagtacggtaccgaanacgtaagttcgtactattagttaactcgtagttaagttacgtacaccgtaaacgaacgtaaaaaccgtcggaacctacccggtaaccccttaaaaccgttcctaacggtacctacccgttaacggactacgtacctaaccgttaccgttaacgggttaacggaaaccggttaccgggtaaccctaacgttaccggaaagggtttcccgtaaggttacgggtaacggttcgggtaccgtttacgggacggtaactttacgttttaaccgtttttacccgtacctaacccgtacgtttaccgaacggtacccggttacggtaccgtaccggaccgttaccgaacggttaacgtaacgtacgtaacgttacgtaaccctaaaacggtttntttaaaccgtttacgtacggtaaaccgtaaagtacgttaacgtaacgttacgttaacccgttccccgttaccggtacgtttaaccggttacccggggttaccgggggaaccggggttaaagtcggggttaacgaccggttaaccggtacgtacccggtagttaaccggg

SEQ ID NO: 73008 - DNA, 706 bp, Homo sapiens
  misc_feature: GYAE6OF02IE5BE.52.32.C10.1.454.CMB.1.raw
  modified_base (174)..(174): a, c, t, g, unknown or other
  misc_feature (174)..(174): n is a, c, g, or t
  modified_base (316)..(316): a, c, t, g, unknown or other
  misc_feature (316)..(316): n is a, c, g, or t
  modified_base (537)..(537): a, c, t, g, unknown or other
  misc_feature (537)..(537): n is a, c, g, or t
tcagcgcagtacgacacgaccggtgctcgatttagtatagacatcaacacacaaagggggcaggagtcagtcccaacaggacacagcatggacatgagggtccctgctcagctcctggggctcctgctgctctggctctcaggtgccagatgtgtcatccagatgacccagtcnccatcctccctgtctacgctatctaataggagaccaagaaactcacccatctacgttcgcccgggtacgtaagtccgaaggacctatttaacggacagttacgtatactagtaattaggtatacgaacgtacgaaaaaccgngggaaccacgacccctaaactccgtagaactccgagtaactcggactacctcccgtaacgttttacgggaaaacgtccggggtacctaactaccgtaaaggttcgaacgttagggaacgttggggtactaccgtaggggaacctaggtttaaaccttttacgtttaccgtaacaacgttctaacggacgtaagggtaccttagaccgaacgtacccgttanaaccggtaactaagttaccgactaactacttaagtaccgtagtaacctaacgaagttacgtaggtaacttcgtacgtccccgtctaccgttaccgggttaccgggaccgggggtaaccctaggggtttaacggaccggttaacgtacgggtaaccgtcgggtaacccgg

SEQ ID NO: 73009 - DNA, 827 bp, Homo sapiens
  misc_feature: GYAE6OF02HEJ62.52.32.C10.1.454.CMB.1.raw
  modified_base (161)..(161): a, c, t, g, unknown or other
  misc_feature (161)..(161): n is a, c, g, or t
tcagcgcagtacgacacgaccggtgctcgatttagtatagacatcaacacacaaagggggcaggagtcagtcccaaccaggacacagcatggacatgacgggtccctgctcagctccgtgggctcctgctgctctggctctcgaggtcgccgagtatggtntcatccgagtactcgaccctagtcctaccaccttccctccgtgtacctcgactattccgttaagtacggaacgaaccgaagtaacttccgaaccctacgttccgtaaccggttccgggacccgggggacggtaccggtaacggtaacgtaaccgttaaagttaccggaattacggttacgttaacggttacgttaacggttaaaggttttacgggtaacttaacggaaaccgaaaaacccgaaaaaacgggtaccgggtaaaccctaaccccggtaaaccccttaacccgttcgttaaccgaacctttacccggtaacgtacgaccgtaaccgttaccttaccgtttaaacggttaaccggggaaaccgttacccggtacctaacgtttacgaacgggtttacgaagggttacgggtacgtaccggtgtaacgggtcgtaatttacggtttacttttaccgacgtacctacgtacgtacgtacgtacgtcgtacgtacgtaccgtagtacgtacgaagttcgactaacacttactacgtacgtacgaactacggtagtaagttacgtacgtttaccgaccgttccgtaacgttaccgggtaccgggttaacggggaccggtaacggttaagggccgtaattacgggaacttacgggacttaccggg

SEQ ID NO: 73010 - DNA, 650 bp, Homo sapiens
  misc_feature: GYAE6OF02F65QT.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtcctccactccctccctgtctgcatctagtaggagacagtaactccaaccagtccacgttcggcccggggcgaggtcggaagactattagctatagtatctagtagttggtatcaagaaccgaaaaccgacgggaaccaaccgtaacccctaaactccgtagtacctcctacgactcgactactactacgttacggaaacgtcggggtaccagtacgtaacgttataggtaggacggtggcgtgtagggactaaggttacttttacttacctactactacgacgtacgtaggtcctacgcgacgtaccgtaacggaacgtacgtagttactacgaacttattaacgtttactacgtaacctaacgtagttaatagtacgttaccgtaccgttcccgtacgttacccggttccgggttaccggggacgggtaacggtaaggggtacgaacggtacgtacggaacgtaccggttaacgg

SEQ ID NO: 73011 - DNA, 758 bp, Homo sapiens
  misc_feature: GYAE6OF02JHLFG.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagtatgacccagtctccatccctccctgtctgcatctataggagacagactcaccatctacttcggccgggacgagtcggacgactagttagacctagttagtagtcttaggtaagtttggttaactcgtaacggaacctaaaaaaccggacgggtaaccaaccgtacccctaaactcccttagtacttacccgtacgtacgtacgtacctacgttaccctacgtttaacgggaaaaccgggtccgggttaacccaacgttaccgtaacgggttacgtacgggttaggtaacgggtcgtaccgggttacgtacggggtaacttaacggtttactttttttaacccgtaccgtaacctaattaccgggacggtacccgtaacggtccgttaggacccggacttaacccgtaaggaacccttaacgttggttaacccgtaaaccgtaacgttaacttttacgttaacgttacgtaacctaaacgttaagttacgacgttacgtacgtttaccgcccgttaacgttcccggttaacggtacccgggggaaccgggtagttaacggtcggaaccgtacgtaaccggtacggtcgttaccgg

SEQ ID NO: 73012 - DNA, 781 bp, Homo sapiens
  misc_feature: GYAE6OF02HWP4F.52.32.C10.1.454.CMB.1.raw
  modified_base (571)..(571): a, c, t, g, unknown or other
  misc_feature (571)..(571): n is a, c, g, or t
tcagcgcagtacgacacgaccggtgctcgatttagtatagacatcaacacacaaagggggcaggagtcagtcccaaccaggacacagcatggacatggagggtccctgctcagctcctggggctcctgctgctcgtggctctcaggtgccagatgtcgcactccaagatcgacccagtcctccacttcccgtcctgtctacgctatcttagagggacaacacgtaaactccaaccgtatacgtacgtcgggccgggagacgtacgaagaacgtattagacagtagtatacgtagtaacgttagtatacgaagaaaccgaaaaaccgaggtaaccaccgtaaccccgtaaactccgtacgtactccgtaacgtagtacgtacctacgttaccgttaacggttaacggaaaccggtacgggtaacccgtaacgttaacggtaacggttacgtaacggttacgggtaacggtaccggtacggttaacggtaggtaaacttcggttttaaacctttttacccgttaacaacgttagtacctaaggaccgtacggtactacgacgtaccgacgtanaaagcgtataccgaacgtaaactactttaactacggtaacctaacgtaaaacggtcgttaaaagtccggttaaccgttacccgtaccccgtttcccggaaccggttttacccgttaacggggtaccccgggggggggttaaaaccggaccgggtttaaacgggtcggtaaaacccgttaaggtaaccggtaaccggtaccgttaacgggg

SEQ ID NO: 73013 - DNA, 659 bp, Homo sapiens
  misc_feature: GYAE6OF02GMBMU.52.32.C10.1.454.CMB.1.raw
  modified_base (203)..(203): a, c, t, g, unknown or other
  misc_feature (203)..(203): n is a, c, g, or t
  modified_base (230)..(230): a, c, t, g, unknown or other
  misc_feature (230)..(230): n is a, c, g, or t
  modified_base (239)..(239): a, c, t, g, unknown or other
  misc_feature (239)..(239): n is a, c, g, or t
  modified_base (248)..(248): a, c, t, g, unknown or other
  misc_feature (248)..(248): n is a, c, g, or t
  modified_base (283)..(283): a, c, t, g, unknown or other
  misc_feature (283)..(283): n is a, c, g, or t
tcagcgcagtacgacacgaccggtgctcgatttagtatagacatcaacacacaaagggggcaggagtcagtcccaaccaggacacagcatggacatgagggtcctgctcagctcctggggctcctgctgctctggctctcaggtgccagatgtgtcatccagatcgacccagtctccatcctcctgtctgctatctatatganacagaactcacatcacgttcggccggngacgtcganactattacncatgtatctagtaattcggtatcagacaaaaccgnggaacacgaccctaactctgtacctctacgatgactactcctacgtttaggaaaccgtacggggtaccctagtacgtaacggttacgtacggttagggtaacggttgggtaccttcggtacgggtaaacgtaggtttttaaacctttttacctttacctaacctagttacctaaggtccggtaacggtcctacggtactacggtacccgtaagaacgtactaacgttagacctaaactagtttaacttacggtactaactaaattacgtagtagtacttaccggttcctacccgttacttaccggttacgggttaccggggaccgggggttaaccgtaaggggttaggaacggtacttacgggtaaggtaacccgg

SEQ ID NO: 73014 - DNA, 436 bp, Homo sapiens
  misc_feature: GYAE6OF02F3FPM.52.32.C10.1.454.CMB.1.raw
  modified_base (410)..(436): a, c, t, g, unknown or other
  misc_feature (410)..(436): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttacttcaccatcagcaggctgcagcctgaagcattgcaaacattacttactgtcaacagtatgatagtcctcccgctcgtactttcgggcgggggaccaagggtggagatcaagcgaacgtggtggctgcacatctgtcttcatccttcccgctatctagatactacgactcgcgtagacggcgggtctgggacgaacgggcactagtacgnnnnnnnnnnnnnnnnnnnnnnnnnnn

SEQ ID NO: 73015 - DNA, 734 bp, Homo sapiens
  misc_feature: GYAE6OF02HRC18.52.32.C10.1.454.CMB.1.raw
  modified_base (134)..(134): a, c, t, g, unknown or other
  misc_feature (134)..(134): n is a, c, g, or t
  modified_base (146)..(146): a, c, t, g, unknown or other
  misc_feature (146)..(146): n is a, c, g, or t
  modified_base (210)..(210): a, c, t, g, unknown or other
  misc_feature (210)..(210): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctcnggctctcaggtnccagatgtgtcagtccagtatcgacccagtctccactccctcctgtcctgctatcagtacgganacaagtaactaccaacctataccgtacgttacggaccgggagacggtaccgaaggaactagttacgacattaggttacttcgtaggttaattcggtaactacgaacgaaaccgtaaaaaccggaggaaccaccgtaaccccttaacctcgtactacgtacccgtcgtagtcgacctactacccgttaaggtttacggaaaccggttacgggtaccctaacgttacggaacgttacgtaaggggtaacggttacggtacggtcgttaacgggcggtaactaacgttttacgttttaaccttacgaccgttagtaccgaaggtccgaggtctacggactaccgacgtttaacgaacgtacgtaacgtactaaaccgtaatacgtttaacgttaacgttacgtaaccaaagttaccggtattacgtaagggttacccttcccgttaaccggtcccttaacccggttacgggttccggggaacggggttacgtaagggtacgaacgtacgtaacgacggacgtaacgg

SEQ ID NO: 73016 - DNA, 506 bp, Homo sapiens
  misc_feature: GYAE6OF02I6Y5M.52.32.C10.1.454.CMB.1.raw
  modified_base (263)..(263): a, c, t, g, unknown or other
  misc_feature (263)..(263): n is a, c, g, or t
  modified_base (372)..(372): a, c, t, g, unknown or other
  misc_feature (372)..(372): n is a, c, g, or t
  modified_base (469)..(475): a, c, t, g, unknown or other
  misc_feature (469)..(475): n is a, c, g, or t
  modified_base (477)..(506): a, c, t, g, unknown or other
  misc_feature (477)..(506): n is a, c, g, or t
tcagcgcagtacgacacgaccggtgctcgatttagtatagacatcaacacacaaagggcgagtcgagacattagcatgtatctgaattggtatcagcaaaaaccagggacagcccctaaactcctgatcctcgatgcatccactttggaaacaggggtcccatcaaggttcagtgaagtggctcgtggacagtattttactttcaccatcagcgaggtctgcagcctggaagactattgacaaactattacttactgtacaanacggtaattgaactagtaccctcccgcctacctacggtttccgggaccgggggggaacccaagggtggtagatacgaagaccgaacgtggtggcctgtccaacgtactntacgttcttacgtacttccttccccgacctgtcttagattacgtacgacgttccgacgtggacgtccggggctcgggacgtaacggcgacaagtagnnnnnnngnnnnnnnnnnnnnnnnnnnnnnnnnnnnnn

SEQ ID NO: 73017 - DNA, 781 bp, Homo sapiens
  misc_feature: GYAE6OF02IC9LV.52.32.C10.1.454.CMB.1.raw
  modified_base (402)..(402): a, c, t, g, unknown or other
  misc_feature (402)..(402): n is a, c, g, or t
tcagcgcagtacgacacgaccggtgctcgatttagtatagacatcaacacacaaagggggcaggagtcagtcccaaccaggacacgagcatggacatggagggtccctgctcagctccgtggggctcctggctgctctggctctcaggtgccagatggtgtctatcccaagagtgacccagttcctccattcccctcctgtctcgctacttctaagtaggaagacaagtaactcaaccctattccgtacgttcggcccggggtaccgtaggtaccggaagacgtaagttacggactagtagttaacgttcgtagttaacggttacggttactacgtaaccggaaaaccaaaaaaccggtaacggggaacctaaaccgtacccccgttaaaactcccgttaanaccttaccgacggtactcggactaccgtaaccgttaacggtttaacggaaaacccgggtacgggtaccctaacgttaaacgtaacgggttactaaggtaaccgggtaaggttacgacgtttacggtacggggtaaacttacgtttttaaccgttttaaccgtttaccaacgttataccgtaggaccgtaggtactcgtacgtacggtaaccgagaaacgtacacgttacgacctaaacttattaacgtacgttaacgtaaccgtagtacgttaagtactacgttaccgtaccggttccgtacggttaccgttacggggttacccgggtaacgggaacggttagggacggttaacggtacgtacgaaacgccgttaacgg

SEQ ID NO: 73018 - DNA, 655 bp, Homo sapiens
  misc_feature: GYAE6OF02HAY1Y.52.32.C10.1.454.CMB.1.raw
  modified_base (316)..(316): a, c, t, g, unknown or other
  misc_feature (316)..(316): n is a, c, g, or t
  modified_base (469)..(469): a, c, t, g, unknown or other
  misc_feature (469)..(469): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctactcaggtgccagatgtgtcatccagatcgacccagtctccatccctccctgtctagactatactagtaggacgacaagaatccaaccatactaccgttcggccgggtacgaggtaccgagtaacctattaacgcgtaatgtactacgtagtagttcggtatcaagtaaccaaaacgnggaccacgtacccctaatctagactcctagactcgactactaccgtagttaacggaacgtacggacctagagtacggtcgtggtaacggtagtcggtacttacgggtagaacgttcggtttacttttacctacctactacacgagtcgagtcncgacgcgtacgtaagagtactacgtactacgtaatacgtttacgttacctaacggtaaccgtaagtacgttaagacgttagttacccttacggttccccgtaacgttaccggttacccgggttacgggggacccgggttaacggtagggtacggtaattacgggaaccgtaacggtccgtaacggg

SEQ ID NO: 73019 - DNA, 804 bp, Homo sapiens
  misc_feature: GYAE6OF02HNH93.52.32.C10.1.454.CMB.1.raw
  modified_base (155)..(155): a, c, t, g, unknown or other
  misc_feature (155)..(155): n is a, c, g, or t
  modified_base (231)..(231): a, c, t, g, unknown or other
  misc_feature (231)..(231): n is a, c, g, or t
  modified_base (243)..(243): a, c, t, g, unknown or other
  misc_feature (243)..(243): n is a, c, g, or t
tcagcgcagtacgacacgaccggtgctcgatttagtatagacatcaacacacaaaggggacgaggagtcagtcccaaccaggacacagcatggacatgacgggtccctgctacagctccgtcggggctcctgcctgctcgtggcctctcaggtcnccgagatgtcgttcacgtccagactcggacccagtcctcactcccgtcctgtctgaccattcagtacggatacganaactccaacgtntccgagtcggccgggacgacgtacgagactagttacgatagtagtactcgtataagttacgtaacgtacgaacgaacgaaaaacccgaaggaaccgtaaccgaaccccgttaaacctaccgttacgtaaccgttcctaacgtacgtacgacctacgttaaccgtacgtttaaacggaaccgggtaacggttaccccggtttaactaacggttaaccgggttacgttaacggtacggggttaaggtcccggtagttaccgggtagggtacgttaaccggttttacggttttaacctttaaccggtaaccgttaacttcccgtaagggtaccggtaccggtacgttacggaaggtttaaccccgtccgggaaacgtacggttaaaccaggtttaacgaaaccgtttaaacttaagtaaaccgtttacgttaacccggttaactaaaccgggtactttaaacgggtacttaacgttccgtacccgttacccgtccgtttaccggtacgggtaccggacgggggtaacgtaccggtagggtacgtaggaccgtacggagtaccgg

SEQ ID NO: 73020 - DNA, 687 bp, Homo sapiens
  misc_feature: GYAE6OF02FYBJ3.52.32.C10.1.454.CMB.1.raw
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatcgacccagtctccatccctccctgtctgcatctanagganacagaactcaccatcctacgttcggcccgggacgaggtcgaagtacattacgctagtgtaatctagtaagttggtatacgtaacgaacctaaaaaccgacgggaaccaaccgtaccccctaaactccgtacgaaccttccacgtactcgactacctccgtaacgttacggaaaccggtacggtaccaagtacgaacggttcaaggtaggtagtcgtcgtggtagggacctaagttacttttacgtacctaactacgttaccgacgtaccgacgggtccttaggccctaaggtaccccgttaaggaaaccgtactttaacggtacgtaacctaaattacctttacgtttaactacgtaacctaaacgtagttacaggtttaccttaccgtcccgtaccgttcgtaacccgtttccggggtaccgggggaaccggggtaacgtacgggtacggaacgtaccggtaacgaccgggtaactacggg

SEQ ID NO: 73021 - DNA, 487 bp, Homo sapiens
  misc_feature: GYAE6OF02I2GNQ.52.32.C10.1.454.CMB.1.raw
  modified_base (75)..(75): a, c, t, g, unknown or other
  misc_feature (75)..(75): n is a, c, g, or t
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (445)..(445): a, c, t, g, unknown or other
  misc_feature (445)..(445): n is a, c, g, or t
  modified_base (448)..(449): a, c, t, g, unknown or other
  misc_feature (448)..(449): n is a, c, g, or t
  modified_base (457)..(457): a, c, t, g, unknown or other
  misc_feature (457)..(457): n is a, c, g, or t
  modified_base (459)..(464): a, c, t, g, unknown or other
  misc_feature (459)..(464): n is a, c, g, or t
  modified_base (466)..(466): a, c, t, g, unknown or other
  misc_feature (466)..(466): n is a, c, g, or t
  modified_base (468)..(469): a, c, t, g, unknown or other
  misc_feature (468)..(469): n is a, c, g, or t
  modified_base (471)..(476): a, c, t, g, unknown or other
  misc_feature (471)..(476): n is a, c, g, or t
  modified_base (478)..(481): a, c, t, g, unknown or other
  misc_feature (478)..(481): n is a, c, g, or t
  modified_base (483)..(487): a, c, t, g, unknown or other
  misc_feature (483)..(487): n is a, c, g, or t
tcagcgcagtacgacacgaccggtgctcgatttagtatagacatcaacacacaaagggcgagtcgagacattagnatgtatctgaattggtatcagcaaaaaaccagggacagcccctaaactcctgatcctcgatgcatccactttggaaacaggggtcccatcaaggttcagtgaagtggctctgggacagtatttttacttcaccatcagcaggctgcacgcctgaaacgacattgacaactattattactgtacaactagtatgatacgtctcccgctcgtacgtttcgggcggggacaaggnggagatacgaagcgaacgtgtggctcgcacctntcttcgtcttacgacttccttccgctatctgtaactacgtacgatccgtcgtcgtacggccgggtgtcgggacgtaaacggcgcctaagtacgtcgntcngntgncgnntcgcgtcncnnnnnntngnncnnnnnngnnnngnnnnn

SEQ ID NO: 73022 - DNA, 734 bp, Homo sapiens
  misc_feature: GYAE6OF02IVZD1.52.32.C10.1.454.CMB.1.raw
  modified_base (580)..(580): a, c, t, g, unknown or other
  misc_feature (580)..(580): n is a, c, g, or t
tcagcgcagtacgacacgaccggtgctcgatttagtatagacatcaacacacaaagggggcaggagtcagtcccaaccaggacacagcatggacatgaggtccctgctcagctcctgggctcctgctgctctggctctcaggtgccagatgtgtcatccagactcgacctagtcctccactccctccctcgtctcgacctattctaacgtagggaacgtacggaacgtacctacccactacgtccgtacggtcgggccggacggtacggtacgacgtacttacggtactactagttacgtacgttcgtaagttaggttaacgtactaacgaaaccgaaaaccggaaacggtaccgggtaacccgtaaccctaaacccttaaccgtcgtaccgttaccgtacgttacgctaccgtacttaccgttaacgttaacggtaaaccggttaaaccggaccggttaacctaccgtaacggttaccggtaggtacggtaaggaccgggttcgttaccgtacgggtacggtttaacgttacgtttttaaacctttaccgaacttacggtactaccggatccgggtacnggtccacggtctaccgaggtaactactcggtaacaaggttacttaaccgttacttaggacctaacggtaatagtaacgtgtaaccgtccgtcccgtacgtacggttcccgtaggggaccgggtacgagttacggcgtagacgtaagtcaggtcg

SEQ ID NO: 73023 - DNA, 687 bp, Homo sapiens
  misc_feature: GYAE6OF02IONXO.52.32.C10.1.454.CMB.1.raw
  modified_base (227)..(227): a, c, t, g, unknown or other
  misc_feature (227)..(227): n is a, c, g, or t
  modified_base (275)..(275): a, c, t, g, unknown or other
  misc_feature (275)..(275): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctcctgtctgcatctataggagacagaatcaccatcacttgccggnagtcgagacattagcatgtatctgaattggtatcaagacaaaaaaccngggaacacgtaccccgtaaatccgtagaactccttacgaatgactaatccctaacgtttaggaaaccgtacggggttacccaagttacgtaaaggtttccgaaggtacggtaaacggttcggtcttaccgtagggggtaactacgggtttaaacttttttaaacctttacccgtaaaccgtaacgttaccgtaacggtacctaacggggtaccttacggtaccgtaaacggtcccgttaaggtaaaacgtacctaacgtttccgaacctaaacgtacgtttaaacgttacgtacgtaactaaacgtatagtacgtaatacgttacctcccggtacttaccgtacggtttacccggggaaccggggtaaccgtacggtagggtacctaaggtaccctaaggtaccgtaacggg

SEQ ID NO: 73024 - DNA, 777 bp, Homo sapiens
  misc_feature: GYAE6OF02HS6X4.52.32.C10.1.454.CMB.1.raw
  modified_base (141)..(141): a, c, t, g, unknown or other
  misc_feature (141)..(141): n is a, c, g, or t
  modified_base (159)..(159): a, c, t, g, unknown or other
  misc_feature (159)..(159): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctcgtggctcncgaggtcgccagatggtntacactccgagactacgacccgtagtcctacctactccctccgtgttcgcgtactattactaaggtaggacgacaagtaactccaacgtacttacctacggttcgggaccgggtagacggtacggaacgaacttagttacgactagttacgtacttcgttaagttaacgtttagtaacgttaccgaacggtaaaaccggaaaaaccggtaaccggaaccgtaacccggtaaacccccttaaaccggttaccggttaaccgtaccgttaccgtacgtacgtacgacctaaccttaaccttaacggttaacggaaaccggtaccgggtacctaagtacgtaagttacgaggtacggtacggtcgtcgtacggtacggtacgtaacgtttacttttaacgttaccgaacctagacgtacgacggtacgtcgtacggtacgtacgttacgaacgtaacgtactacgttagaaacgtaacttacttacgttacgtactaacgtaactacgtaagtacgttacttaccgtacgtcccttacggttaccggttaccgggttacggggtaacccggggacggttaacggtacgggtaactacggtaaccgtaggtacggtaacggg

SEQ ID NO: 73025 - DNA, 716 bp, Homo sapiens
  misc_feature: GYAE6OF02FLGQH.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccgagatcgacccagtcctccacttccctcctgtctgctatcgtataggagacagaatccaccatctacgttcggcccggggacgtacgtacgaacggactaagtttacgctagttcgttaatcgttagtaacgtttggttactacgaacggaaacccaaaaaccggacgggaacccaaccgtaacccctaaaccgtccgtagtaactccttacgtatcgtacctacttacccgtaacgttacggaaaccggtaccgggttaccacgttaaccgtaaggttaccgaagggttgggtaacgggttggtccgttacggtacgggtattaaggtttaccttttaccgttacaccgtaatccgacgcgtacggtctacggactaccgacgtagtaacactatacgtaactaaacttattaactacttacgtaacgaactaggtactgtaccgttaccgtccgttaccgtccgtttacccggttaccggggtttaaccggggacggggttaacgtacggggttacggtaacgtaacggtaccggtaacgggttcgtaacggg

SEQ ID NO: 73026 - DNA, 641 bp, Homo sapiens
  misc_feature: GYAE6OF02FYGM0.52.32.C10.1.454.CMB.1.raw
  modified_base (205)..(205): a, c, t, g, unknown or other
  misc_feature (205)..(205): n is a, c, g, or t
  modified_base (230)..(230): a, c, t, g, unknown or other
  misc_feature (230)..(230): n is a, c, g, or t
tcagcgcagtacgacacgaccggtgctcgatttagtatagacatcaacacacaaagggggcaggagtcagtcccaaccaggacacagcatggacatgagggtccctggctcagctcctggggctcctgctgctctggctcgtcaggtgccagatggtgtcatccagatgacccagtctccatcctcctgtctgcatctatagganacagaactcaccatcacttgccggngagtcgagactattagcatgtaactctagtaattggtatcaagacaaaaacgacgggaacacgaccctaaacgtctacgactccgtacgactgctactccgtaacgttagggaaacgtacggggttaccctaaggtaccgtaaagggtttccgaaggttacgggaaagggttcggtaccgtcggtaggggtaactaggttaacttttaaccgttcgtaaccattaccgtacgacgtacggtcttacgactacgtaccgttagaacgtactagttacactaaactagttatttactacggttaccaaacgtagttatacgtacttacgcccgtacccggtctaccgttacggtttaccggggacggggtaacgtaacgggtcggtaacgacggtacgtaacggagtaaccgg

SEQ ID NO: 73027 - DNA, 640 bp, Homo sapiens
  misc_feature: GYAE6OF02HGWJQ.52.32.C10.1.454.CMB.1.raw
  modified_base (206)..(206): a, c, t, g, unknown or other
  misc_feature (206)..(206): n is a, c, g, or t
  modified_base (241)..(241): a, c, t, g, unknown or other
  misc_feature (241)..(241): n is a, c, g, or t
  modified_base (441)..(441): a, c, t, g, unknown or other
  misc_feature (441)..(441): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagactgacccagtctccacttcctccctgtctgcatctatagganacagaactcaccatcacttgccgggcgaggtcganacagttagcatagtatctgtaattggtatacgacgaacgtaaaaaccgacgggaacacgaccccgtaacctaccgtgtactcctacgatcgactactacctagttaacgggaaacacgggtccatacgacgttacagtaggacgtaggtctacgtaggtactgtttaacttttacttaccactaacgtacacgtacgcgngtacgaccgcgtacctagaataccgtattacgactaacgtagttaacttacgtagttaacctaagtacgttaagtgtaacgttcggtaccccttacccggtctttaaccggttaccggtttaacccggggggaccggggttaacccgggtaacgggttcggtaaggtaccggtaacggtaaccgggtccgttaaacggg

SEQ ID NO: 73028 - DNA, 794 bp, Homo sapiens
  misc_feature: GYAE6OF02INC4G.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctcgtggctctcaggtgccagatgtgtcatccagatcgacccagtcctccatccctcccgtgtctgctatctaagtaggacgacaagaactccaacctattacctacgttcggacccgggacgaaggtccggaagtaactaagttacgacctattgttactctagtaacgtttggtacttacgaacgaaaccgaaaaaccggtacggggaacctaaccgtaaccccctaaacgttcccgtagtaccttccgtacgtactacgaccgactacccttaacggttacggtaaaaccggtcggggttaccctaagttccggtaaacggttaccgtaaggttacgggtaacgggttacggtccttacgggtacgggtaaacgttacggttttaacgtttttaccgttaacctaccggtaaacttaccgaacggtaaccgtaacgggtacctacggtacgtaaccggtcgtaaacggtaagttacctaacgtttacgaaactaacttaacgttaacgtttacgtaacgtaaccgtaaagtacgttaaggttacgtaacgttaccgttacccggttacccgtcggtttaacccggtccgggtttaacgggggaccgggggttaacgtacgggttacggaacgtacggtaaccgtacggtacgttaaccggg

SEQ ID NO: 73029 - DNA, 742 bp, Homo sapiens
  misc_feature: GYAE6OF02IONQG.52.32.C10.1.454.CMB.1.raw
  modified_base (226)..(226): a, c, t, g, unknown or other
  misc_feature (226)..(226): n is a, c, g, or t
  modified_base (540)..(540): a, c, t, g, unknown or other
  misc_feature (540)..(540): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctggctgctctggctctcaggtgcagatgtgtcatccgagctagacccagtcctccactcctcccgtgtctacgcactactagtacggagtacaacgtaanccaccgtactccgacgttcggaccgggtacgtacgtaccggaacgaccgtaattacgcgtacttacgtattacgtagttaagttcgtactacgaacgaaaccgaaaaacgagggaacctaaccgaaccccgtaactccgtacgtaactccgtcgattcgactacgtaccgtaacgttaaacggaaccggtaacggtaccctaagttaacgtaaggtaccgtaaggtaacggtacggtcggtacgttacggtcggaaacgttagtttaacttttaaccggtttccaaacgtacgtacgacggtaccgaacggttntaaccggtacgtaacccgggtactaacggtaaacgaaccgtttaagaccgttaaacgttaaacctaatttaccgttaacgttacgtaaaccgaagtttacgtaaacgtgtaactttacgtaccctcccgtagttacccgtacgggttaccggggacgggaacgttaacggtggaactaccgtaagtacggtagtaacccggg

SEQ ID NO: 73030 - DNA, 693 bp, Homo sapiens
  misc_feature: GYAE6OF02F88JX.52.32.C10.1.454.CMB.1.raw
  modified_base (216)..(216): a, c, t, g, unknown or other
  misc_feature (216)..(216): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctgctctggctctcgaggtgccagattgtgtcactccagactcgacctagtcctccacttccctcctgtctcgctatctagtacgganacacgtaactccacatacgtacgtcggacggcacggtacgacacgtagttagactatagttatcgtagttagttacgtactacaacgtaaccgtaaaccgacggtaacccgaacctaccgttaaccgtctacgtaccgtacctacggtagtaccacttaccgtacgttacgggttaaacgaaccgggttaccggtacctaacgtaacggttacggttacggtacggtaagtacgggacggttcgtacggtacgtacgtttaactttacgtttacctaccgtacgtaacgtcgacgtacgcggtacgtcggtacagttaccgtaagtaactactacgttacgtagttaacgttataacgttagtaccgtaataacgttactacgttacgaccttctacccgtacggtacggttcccggtaacggggtaccggtacgggtaagtcggaacggtacggaacgtacggtacgtaacgtcgg

SEQ ID NO: 73031 - DNA, 722 bp, Homo sapiens
  misc_feature: GYAE6OF02IPBDD.52.32.C10.1.454.CMB.1.raw
tcagcgcagtacgacacgaccggtgctcgatttagtatagacatcaacacacaaagggggcaggagtcagtcccaaccaggacacagcatggacatgaggtccctgctcagcctcgtgggctcctgctgctctggctctcaggtgccaggactgtcgtctatccagactcgacccagtctccattccctcccttgtctgctaattctaagtaggacgaatacgaaacttccaactactccgtacgttacggcccggggtacgaacgtcggaagtaccgtaattacgactagttagtagttcgttagtaagttcggtactacgaacgtaaaccgaaaaccgacggaccaacgtaaccccttaaactcctacgtaccttctacgtaactctaccgtaactaccgttaacgttacggaaacgtaccgggtacctagttacgtacggttacgacggttaggaacgttcggtactacgggtacgtaagtacgttttaactttacgttaccacgtactaccgtagtacgcggtactcgacgaccgtacgaagtaacggtactactacggtaacttaaagtactttaaggtaacttacgtaaccgtaagtaagttaccttaggtacgttaccgtaccgttccggtaaccggtttaccgtacggggtttaccggggaacgggtacggttaacggacggtacggtaaccgtaacggaccgtaccgttacgg

SEQ ID NO: 73032 - DNA, 844 bp, Homo sapiens
  misc_feature: GYAE6OF02JJISB.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagactcgaccctagtcctccacttccctccctgttcctgtacctatcctaagtacggaacgacaacgaactccaacctacttccgtaaccgttcgggacccggggacgtacggtacggaacgtactacgtttaacggacctagttacggtaacttccgttaaggttaaactttacgggttaacgttaaccgtaaaccggaaaacccgtaaaaaaccccgggtacgggtaacccgtaaaccccgtaccccccgttaaaaacccgttccccgttaacgtacccgttaccccgttaacggaactccggtaccttaccgtaccgttaaccggttacgggaaaccggttacccggggtaccctaagtaaccgggtaacggttacgaacgggtacgttacgggtaccgtaccgtttacgggacgggtaaccttacggtttaacctttttaccgttaccctacgtaccgttacgaaccggtcgtaccggtcgtaccgacggtaccggttacctaaggaccttacgtacggttacaaccgtaaccgttatttacttaccgtaacttacctaacggtaattacgtacgtaaccttccgtccctccggtacctttaccggttacccggggttacggggaaccggggtttaccgaaggtaggtaacccgtacgtaccggaacggacgttaacgg

SEQ ID NO: 73033 - DNA, 659 bp, Homo sapiens
  misc_feature: GYAE6OF02HH4RQ.52.32.C10.1.454.CMB.1.raw
  modified_base (204)..(204): a, c, t, g, unknown or other
  misc_feature (204)..(204): n is a, c, g, or t
tcagcgcagtacgacacgaccggtgctcgatttagtatagacatcaacacacaaagggggcaggagtcagtcccaaccaggacacagcatggacatgagggtcccctgctcagctcctgggctcctgctgctctggctctcaggtgccagatgtgtcatccagatgacccagtctccatccctccctgtctgcatctatagganacagaatccaccatcacttcggccgggtacgagtcgagactagttagctatgtatcgtagtaattggtatacaacgaaccaaaaaccgagggaaccaccgacccctaaacgtcctagactccgtcgatcgactactacctacgttacgaaaccgtcggggtaccctaagtacgttaagggttacgaagggttagggtaacggttcgggtccgtttacggtcggggtaacgttacgtttaacgtttttaccgtttacctaacctagtaccgtaaggaccgtacggtcttacggaccgtacgacccgttaaggaacgtaactcgtacgactaaacgtattacgttacgtacgttaactaacgtactagtagttacgtaccgttcctaccggtctaccggttaccggttaccggggtaccggggaacttagggtacgagtacgtacgtaggactacgg

SEQ ID NO: 73034 - DNA, 687 bp, Homo sapiens
  misc_feature: GYAE6OF02ICTU8.52.32.C10.1.454.CMB.1.raw
  modified_base (156)..(156): a, c, t, g, unknown or other
  misc_feature (156)..(156): n is a, c, g, or t
  modified_base (173)..(173): a, c, t, g, unknown or other
  misc_feature (173)..(173): n is a, c, g, or t
  modified_base (194)..(194): a, c, t, g, unknown or other
  misc_feature (194)..(194): n is a, c, g, or t
  modified_base (210)..(210): a, c, t, g, unknown or other
  misc_feature (210)..(210): n is a, c, g, or t
  modified_base (355)..(355): a, c, t, g, unknown or other
  misc_feature (355)..(355): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcgaggtgccagatgtntcatccagatcgacccngtctccattccctcctgtccngcatactagtaagganactagaactccaaccatccatcggcggacgagtacgagtactagttagactagtagtactagtagtaattaggtatacgaacgaaaccgtaaaaaccgagggaacctaaccgtaacccctaaactccgtacgtactaccgtacgntaccgacgtaacctacgttacgttaacgaaaaccggtcggtaacccaagttaaccgtaacggttcgtaaggtacgtaaacggttcggaacttcgggtaaacggtaacttaagttttaacgttttaccttacaccgttaagtacgagaccgtacggtactacgaacccgtaggaccttagaaaccgttataacgtcgaaacctaaagtacttaacttaacgtacgtaaacaaggtacagttaacgtattccgacgttaccgcgtaaccgttccggttaccggggaacgggtacgtaaggtacggtaacggacttaacgaacggtaccgtaagg

SEQ ID NO: 73035 - DNA, 731 bp, Homo sapiens
  misc_feature: GYAE6OF02GTDH8.52.32.C10.1.454.CMB.1.raw
  modified_base (213)..(213): a, c, t, g, unknown or other
  misc_feature (213)..(213): n is a, c, g, or t
  modified_base (250)..(250): a, c, t, g, unknown or other
  misc_feature (250)..(250): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcactaccagatcgacccagtcctaccacttcccctcctgtctgcatactagtagganacagactccacatcacgtcggccgggctaggtacganactattagctatcgtatactagttattggtactacgaacgaaaccaaaaacgggacggaaccaccgtaacccctaaactcctacgtacctccgtacgtactcgtacctacttaccgtaacggttaacggaaaccggtaccgggtcctaacgtacgtaacgggttacgtaggtaggaagtcggtacttacgggtaaggtcttaagtttacctttaactccgaactacgttaccgacgacggtacgctacggtactcggtacgtaagtaactacgttaacgacgtaaactaaacgttagtttaacccgtaacgttacgtaaaaccttaaggttaacgttaaggtaaccgttacgttacccggtaccccgttaccgtcggtttacccgggttaaacccgggggtttccgggggaaacccgggggttacgtaaagggttccgggaaacgttacggaacccgggttaaagggccctttaaacgggg

SEQ ID NO: 73036 - DNA, 755 bp, Homo sapiens
  misc_feature: GYAE6OF02IDGIX.52.32.C10.1.454.CMB.1.raw
  modified_base (591)..(591): a, c, t, g, unknown or other
  misc_feature (591)..(591): n is a, c, g, or t
tcagcgcagtacgacacgaccggtgctcgatttagtatagacatcaacacacaaagggggcaggagtcagtcccaaccaggacacagcatggacatgagggtccctgctcagtctccgtgggctacctggctgcctcgtggtctctcgaggtcgaccaggtatcgtagctatccagtatcgaccctagttactcctactcccttcctgtccgtagcattacgtaacgttacggacggacaggaactccgaacctattccgaacgttcgggccggtacgtacggtcgagtaactagtagctaatgttactcgttagtaacgtttacggtataccgaagtaaccgtaaaaacgacggtaaccaacgtaacccccgtaaagtccgtacgtacctacgtacgtaacgttcgacctacgtaccttaacggttacggaaacggtccgggtacctacggtaactaacgggttacgtaacggttagggtacggtacggttaccgtacggtaccggtaacgttactttaacgtttaccttaaatacccgtacgtaacgtcacggtacgtcgttacgccgttacgacgtaacgtaaacgtntaaccgttacgaacgtaaacttcgttacctttaaggacttacccggtaatcgggtaattacggtacttaccgtacccgtacggtcccgttaacggtacccgggttaacgggtcccggggtaagtagggtaacggacgttaacgtacggtaacccgaggttacgg

SEQ ID NO: 73037 - DNA, 757 bp, Homo sapiens
  misc_feature: GYAE6OF02G4BPD.52.32.C10.1.454.CMB.1.raw
  modified_base (204)..(204): a, c, t, g, unknown or other
  misc_feature (204)..(204): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatccctcctagtctgcatctatagganacagaactcacctagtctacgttcggccgggacgagtcggaagacctagttagctagttgtacttcgtacgtaagttaggtaactacgaacgtaaccgaaaaaacgacgggaaccaaccgtaacccccgttaaaactccgtagtaaccgttaccgacgtacgtcgtactaccgttaccgtaacggtttaacggaaaccggtacgggtaccctaacgtaacggtaaacgttacgtaaggttacgggaagggttcggtaccgttaggtacgggaaacttaacggttttaacttttttaccttcgaaacccttagttaccgaaggtacccgaaggtccttaccggacgaccgttaccggtagtaaacggtaccctaagggttacaaaccgtaaacttaacgtttaactttacgtaacgtaacctaaagtaagtacgtttaacgtaagtaccgttcccgtacccgtcgttaacccggttaccgggggttacggggaacccggggtaaacgttacggggtaccaaggttaacccaaccggaacgggtacccttacggg

SEQ ID NO: 73038 - DNA, 720 bp, Homo sapiens
  misc_feature: GYAE6OF02GB0K5.52.32.C10.1.454.CMB.1.raw
  modified_base (307)..(307): a, c, t, g, unknown or other
  misc_feature (307)..(307): n is a, c, g, or t
  modified_base (652)..(652): a, c, t, g, unknown or other
  misc_feature (652)..(652): n is a, c, g, or t
  modified_base (662)..(662): a, c, t, g, unknown or other
  misc_feature (662)..(662): n is a, c, g, or t
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
  modified_base (680)..(680): a, c, t, g, unknown or other
  misc_feature (680)..(680): n is a, c, g, or t
  modified_base (682)..(683): a, c, t, g, unknown or other
  misc_feature (682)..(683): n is a, c, g, or t
  modified_base (685)..(685): a, c, t, g, unknown or other
  misc_feature (685)..(685): n is a, c, g, or t
  modified_base (688)..(690): a, c, t, g, unknown or other
  misc_feature (688)..(690): n is a, c, g, or t
  modified_base (693)..(694): a, c, t, g, unknown or other
  misc_feature (693)..(694): n is a, c, g, or t
  modified_base (696)..(696): a, c, t, g, unknown or other
  misc_feature (696)..(696): n is a, c, g, or t
  modified_base (698)..(699): a, c, t, g, unknown or other
  misc_feature (698)..(699): n is a, c, g, or t
  modified_base (701)..(701): a, c, t, g, unknown or other
  misc_feature (701)..(701): n is a, c, g, or t
  modified_base (703)..(703): a, c, t, g, unknown or other
  misc_feature (703)..(703): n is a, c, g, or t
  modified_base (705)..(705): a, c, t, g, unknown or other
  misc_feature (705)..(705): n is a, c, g, or t
  modified_base (708)..(708): a, c, t, g, unknown or other
  misc_feature (708)..(708): n is a, c, g, or t
  modified_base (710)..(713): a, c, t, g, unknown or other
  misc_feature (710)..(713): n is a, c, g, or t
  modified_base (717)..(720): a, c, t, g, unknown or other
  misc_feature (717)..(720): n is a, c, g, or t
tcagcgcagtacgacacgaccggtgctcgatttagtatagacatcaacacacaaagggcgagtcgagacattagcatgtatctgaattggtatcagacaaaaaccgagggacagcccctaaactccctagactcctcgatgcactcctacgtttaggaaaccgacgggggtccccatacgtaacggttcgaagttgggaaggttcggacgttccgtaggggaactaggttaacttttttaccttttaccgaacctatacgaacgtcgaaggtccgtgaccacggtcccgtaaggaaacgtaaccgtnttacggaacctaaaccgtaattttaacttaccggttaccgtaaccgttaaactaggtttactaggttaagtttaacgttcccccgtccccgttaacccgttacccgtaaccggggttttccgggggaccgggggggttaaaccccgtaaggggtaggtaacggacggttaacaaaccgggtaccggttaacggtgggtacgtcggttaccaccccgtacgttacgtcgtaccgtttcctagtaacccttcccttcccgaaccttcgtacgttactacgtaactaccgactaccggtacgtcggtaccggtccggtcgtacggacgacggtaccggacgtacgtanaggggggtcncgancgngngngngncgngnngngannnganngngnntngngntgngnnnnagannnn

SEQ ID NO: 73039 - DNA, 616 bp, Homo sapiens
  misc_feature: GYAE6OF02FF8EM.52.32.C10.1.454.CMB.1.raw
  modified_base (191)..(191): a, c, t, g, unknown or other
  misc_feature (191)..(191): n is a, c, g, or t
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
  modified_base (522)..(522): a, c, t, g, unknown or other
  misc_feature (522)..(522): n is a, c, g, or t
  modified_base (542)..(542): a, c, t, g, unknown or other
  misc_feature (542)..(542): n is a, c, g, or t
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (587)..(587): a, c, t, g, unknown or other
  misc_feature (587)..(587): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
tcagcgcagtacgacacgaccggtgctcgatttagtatagacatcaacacacaaaagggcgagtcgagacattagcatgtatctgaattggtatcagcaaaaaaccagggacagccccctaaactcctgatcctcgatgcatccactttggaaacaggggtcccatcaaagggttcaagtggaagtggctntgggacngtattttacttcacntcagcaggctgcagcctgaagactattgcaaacatattactagtacaacagtattgaattacgtacttccccgcttcgtaccgttttccggggaccggggggggtacccaaacgggttggaacggtactaccgaagaccgtaacgtggtcggactggaccaccgtattcgtcgttcttactacttccgtttaccccgaccgtacttaccgttgtaaacgtttaacgtaaccgtaagttcccggaccttaggtacgggccccggggtaggtacggtaaccgaacggggtaccgaccgaacgttaacggtntacgcgtagcgtgacgcgantagacgtcganagacgnacngnacncgcgtacgtatagtcgctanacgtacacgagcgtacgtacagtangntn

SEQ ID NO: 73040 - DNA, 816 bp, Homo sapiens
  misc_feature: GYAE6OF02HA5ZA.52.32.C10.1.454.CMB.1.raw
  modified_base (152)..(152): a, c, t, g, unknown or other
  misc_feature (152)..(152): n is a, c, g, or t
  modified_base (156)..(156): a, c, t, g, unknown or other
  misc_feature (156)..(156): n is a, c, g, or t
  modified_base (166)..(166): a, c, t, g, unknown or other
  misc_feature (166)..(166): n is a, c, g, or t
  modified_base (243)..(243): a, c, t, g, unknown or other
  misc_feature (243)..(243): n is a, c, g, or t
tcagcgcagtacgacacgaccggtgctcgatttagtatagacatcaacacacaaagggggcaggagtcagtcccaaccaggacacagcatggacatgagggtccctgctcagctcctggggctcctgctgctcgtggctctcaggtgccagntgtntcatccagtntcgacccagtctaccactcctccctgtctcgcatcgtagtaggaagtacaagaactccactatctacgttggccggngtagacgagactagttacgacagttagtatacgtagttaacgttggttactacgaaacgtaaccgtaaaaaccggacggtacccgaaccgtaacccccttaaacgtcccgtacgtaacctccgtacggtaacttccgacgttaccttaccgtaacggtttaacggaaaccggttccggggtaaccctaacgttaaccggttaaaggttaccgtaaagggttacggtaacgggttaccggttaccgttaacggggttagggtaaaccctttaacgggttttaaaccttttacccgttttaaacccgaacgtttaaccgtaaccgtacggtaaccgtacgggtaccgtacggttaaccgaccggttaaccgtaagtaaccgtaacgttaactcggaaaccttaaacgttacgttaccgttaacgtacgtaaccgtaagtaccgttaagtagtaccgttccggtaacccctcccgtaaggtttaccccggttaacggggtttcccgggggaacccgggtttaagtacggggttaaccgggtattaacccggttacggaaccggtagttaacccggg

SEQ ID NO: 73041 - DNA, 743 bp, Homo sapiens
  misc_feature: GYAE6OF02INCUV.52.32.C10.1.454.CMB.1.raw
  modified_base (333)..(333): a, c, t, g, unknown or other
  misc_feature (333)..(333): n is a, c, g, or t
  modified_base (545)..(545): a, c, t, g, unknown or other
  misc_feature (545)..(545): n is a, c, g, or t
  modified_base (575)..(575): a, c, t, g, unknown or other
  misc_feature (575)..(575): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcgaggtcgccagatgtgtacactccagatcgacccagtcctacactccctcctgtctgctatctaagtaggaacaccaagactcccgactactaccgacgttcgggccggagtcgtacggaatactaacgttacgactagttacgttatcgtaagtacgttcggtaactaccaaacgtaaccgaaaaaccgggnggtaaccctaaccccgtaaacccttaaccgttacccgttacgtaccttacccggtaagacctacgtaccctaactttaccgtaaccggttaacgggtaaccggtccgttaacgtagtacggtaacggtgtaacgggtaggtaacggccgtacggtcgtacggtaacttacgtttaactttccgtaacaccaggttacacggtacgctaccgngaacgtaccgaataccgacttcgaacttanaacgttaactacgtagtacctaagtaaactagtacgtaacgttaccgtaacggttccctaccgttaccgggtacttaaccccgggggttacgggtaacccggggttaacgggaacgttacggggaaccgtttacggtaaacccgtcccgttaacgggtacgtaccggg

SEQ ID NO: 73042 - DNA, 729 bp, Homo sapiens
  misc_feature: GYAE6OF02ICGJV.52.32.C10.1.454.CMB.1.raw
  modified_base (161)..(161): a, c, t, g, unknown or other
  misc_feature (161)..(161): n is a, c, g, or t
  modified_base (361)..(361): a, c, t, g, unknown or other
  misc_feature (361)..(361): n is a, c, g, or t
  modified_base (510)..(510): a, c, t, g, unknown or other
  misc_feature (510)..(510): n is a, c, g, or t
  modified_base (621)..(621): a, c, t, g, unknown or other
  misc_feature (621)..(621): n is a, c, g, or t
tcagcgcagtacgacacgaccggtgctcgatttagtatagacatcaacacacaaagggggcaggagtcagtcccaaccaggacacagcatggacatggagggtccctgctcagctccgtggggctcctgctgctcgtgctctgagtcgccagatgtcgtanactccgagatacgaccctagtccctctacctcccgtccctgtctgcctatacgtagacgggacaagagaaactccaactagtcgtaccgtcggaccgggagagtacggtatagaacgttagacagtagtactactagtaagttaggtacacgtaacgaaacgaaaaccgtaggacctaaccggaccccttaacgtacctnaaacctccgttaagaccttgaacctacgtaaccgtagttaaccgggaacgtacgggttacaacgtacggtaagtacgtaggtacggtaacggttgtaccgggttagacgggtaacgttaacggttttacgttttaccttaaccgttaanaaccgttaccgacgaacggtacgttcgaccggataccgtaacgaggtaaacgtataagtactaacttaacgttaactaccgttaagtacctaagtaaccgtattaaacggnttaacgtccgttaccgtaccgtcggttaaccgttccggggttaccggggaacgggttaccgggaacggtttacggaaaccgtccggaagttacccggtcggtaaacgg

SEQ ID NO: 73043 - DNA, 784 bp, Homo sapiens
  misc_feature: GYAE6OF02IKDRZ.52.32.C10.1.454.CMB.1.raw
  modified_base (148)..(148): a, c, t, g, unknown or other
  misc_feature (148)..(148): n is a, c, g, or t
  modified_base (158)..(158): a, c, t, g, unknown or other
  misc_feature (158)..(158): n is a, c, g, or t
tcagcgcagtacgacacgaccggtgctcgatttagtatagacatcaacacacaaagggggcaggagtcagtcccaaccaggacacagcatggacatgagggtcctgctcagctccgtggggctcctgctgctctggctctacgaggtncagatcggtntctatccagactcgacccagtcctaccacttccctccgttgtcctagactacttcgtaagagggacgaacaacgtaaatccaacctaacttaccgtacggttccgaccggggacgtaaggttaccggaggtaaccaagtttaacgactacttacggtactttacaggtaattacggtaactcgaacgtaaacaaaaaccgggtagggaacctaaccggtaaacccctaaccgttacctacgggaaccttaccgtacgtacctagtacctaacgttaccgtaaccgttacgggaaaccgtacggggtaccaagtaacgtaaggttacgacggttaggtacggtacggtaccgtccggtaggtaacgtacggtttaactttaaccgtttactaaccgtaacggtactacggtacgttaacggcggttacgaccgtaacgtaccggtaacgtaaacgtaacggtaacttacggtaactaaacgtacgttaagttaccgtactaaacgtaacgtataacggtagtaacgttcgttacccgtaccggtactacccgggtttcggttaaccggggacggggtaacgttaaacggggcggtaaggtaccggtaacgtaccggtaccggtaagg

SEQ ID NO: 73044 - DNA, 622 bp, Homo sapiens
  misc_feature: GYAE6OF02JC98F.52.32.C10.1.454.CMB.1.raw
  modified_base (148)..(148): a, c, t, g, unknown or other
  misc_feature (148)..(148): n is a, c, g, or t
  modified_base (157)..(157): a, c, t, g, unknown or other
  misc_feature (157)..(157): n is a, c, g, or t
  modified_base (212)..(212): a, c, t, g, unknown or other
  misc_feature (212)..(212): n is a, c, g, or t
  modified_base (314)..(314): a, c, t, g, unknown or other
  misc_feature (314)..(314): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
  modified_base (489)..(489): a, c, t, g, unknown or other
  misc_feature (489)..(489): n is a, c, g, or t
tcagcgcagtacgacacgaccggtgctcgatttagtatagacatcaacacacaaagggggcaggagtcagtcccaaccaggacacagcatggacatgacgggtccctgctcagctccgtggggctcctgctgctctggctctcaggtnccagatgtntcatccaagatcgacccagtcctacactccctcctagtctgctatctagtagganacaagactccactatctacgttcggccggagtacgtgacgtactagttagcctagtgtattcgtagtaagttggtactacgaacgaaaccgtaaaaaccggngggtaaccaaccctaccccttaaactcctaagaccttacccgtgtaactcgaactcttaaccgtacgttaacggaaacggtcccggtacactaacggagttnaggtgtaagngtctagtggacttagttactttctacacntacgatacggcgtatcgagacgtcgtaagaactntaagttaccgactaactatttaacgtacgtaccgtaaatacgtagtatagtaacctcgttaccgccgtcgttaaccggtccgggttcggggaacggtagtagggaccgtaagacgtacggtaacgcttaacgg

SEQ ID NO: 73045 - DNA, 763 bp, Homo sapiens
  misc_feature: GYAE6OF02HX0BJ.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatccaccatcacttcggccgggcgacgtcgagactagttagcatgtatcgttagtaagtttggtaatacgaacgaaaccgtaaaaaaccgaacgggaccgaacccggtaaccccccttaaaaccgttaccccttacgtaaccttacccgtacggactaccgactaccttacccgtaacggttttaacgggaaaaccggtacggggtaccctaacgttaacggtaaacggttacgtaacggtagggtaacggtcggtacgtcgtacggggtaactagttttaacttttactttaccaaccttacgtacgtacgacgtacgggtacctacggccgtaccggtaccttaaggaaaccgtacgttaccgttacgaacccttaaacgtaatttaaccgtttaaccgtacgttaacctaacgtaagttaacgttaagtacgtttaccgtcccgtaccccgtcgtttacccggttaaccgggtttaccggggggacccgggggtaaacgtacgggggtaccggtaacgaaccgggttaaccgtaccgggtaccggttaacgg

SEQ ID NO: 73046 - DNA, 823 bp, Homo sapiens
  misc_feature: GYAE6OF02IRH5U.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctcctgctgctctggctctcaggtcgccagatgtgtcatccagatcgacccagtcctccatccctcctgtctgctatctagtaggacacaagtaatccacctattccacgttcgggcccgggcgtaggtacggaacgactattacgctaagttgttactacgtagtaagtttggtactaccgaacgaaaccaaaaccggtacgggaaccaaccgtaacccccttaaactccgttacgacttacccgtacgtactccgactaccttacccgttaacgtttaaccggggaaaccggtcccgggttcccaaacgttacggtaacgggttaccgtaagggttaacggggtaacggttccgggttacgttaacgggttacgggtaaaccgtttacgtttttaaaaccgtttttccgttaaacccgaacccgttacgttaccgaacgggtaccgtaccggggtcccgtagtacccgtacggttacccggtaagaaaccggttacctaaacgttaccggaaaccttaaacgttaacctttaacgtttaaccgtacgtaaaccttaaacggttagttaacgtacgtttaactacccgttaccccgttacccgtaccgtttacccgggttaacggggttccggggtaaccggggtaaccgttaaggggtaccgggtaagtacgggtaaccggtaacggtagggttaaccgg

SEQ ID NO: 73047 - DNA, 773 bp, Homo sapiens
  misc_feature: GYAE6OF02HDHFF.52.32.C10.1.454.CMB.1.raw
  modified_base (215)..(215): a, c, t, g, unknown or other
  misc_feature (215)..(215): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagtactcgacccagtcctcctatcccctccctgtcctgactatctataggacganagatccacctatcctacgtggccgggacgacgtacgagactagttacgctagtgtctacgtagtaagttcggtaactacgaacgtaaccaaaaaccggtaggacctaccgtaaccccttaacgtacctacgtactcccgttagtacctacgcctaccgtaccttaacggttaaccgggaaacgttaccggggtacctacgtaacggtaacggttaccgggaggtttaggggaaccggttcgggtccgtttacgggtacggggttaaccttaacggttttaacctttttaaccggttaaccctaaccgtacgtacgtaccggtaggtaacccggtccgtagtacccggttaacgacccggttaacgaacgttacccgtacgttaacgtaccgtaaacttaacgtttaaccttacgtacgtaaaccttaagtaacgtaacgttacgaacgttacccggttccctacccgggttcttaccgggttaaccgggttacccgggggtaacgggtaacgtaccgggttaggtaaccgaacgttacgggtaacgacggttaacggg

SEQ ID NO: 73048 - DNA, 745 bp, Homo sapiens
  misc_feature: GYAE6OF02F3K9D.52.32.C10.1.454.CMB.1.raw
  modified_base (151)..(151): a, c, t, g, unknown or other
  misc_feature (151)..(151): n is a, c, g, or t
  modified_base (155)..(155): a, c, t, g, unknown or other
  misc_feature (155)..(155): n is a, c, g, or t
  modified_base (167)..(167): a, c, t, g, unknown or other
  misc_feature (167)..(167): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (556)..(556): a, c, t, g, unknown or other
  misc_feature (556)..(556): n is a, c, g, or t
tcagcgcagtacgacacgaccggtgctcgatttagtatagacatcaacacacaaaggggggcagggagtcagtcccaaccaggacacagcatggacatggagggtccctgctcagctccgtggggctcctgctgctctggctctcaggtcncagntgtgcatccagntcgacctatcctcctactccctccgtntctnctactctagtacgganacanactaccactatctacggtcggccgggacgagtcgagatacgtagatcgtagtactgtagtattaggtacgactaacggaaacaaaaccggtaacggtaccaaccgtaacccgttaacctcgtaccgtaacttaccgtccgtacgacgtactaccgtaccttaaacggttaaccgggtaaaccggtacgggtacctacgtaccggtaaaggttaccgaagggttcggtaacggtcggttaccgtcgggtaacggtacgttaacttaccgtttttaacttacgacctacgtcgaacgtcggaaccgtcggacgtaccgacgttacgggtacacggttaanacgtacaccttaatactacgttacgtacgttaaccaaggtaccttaaagtccgtacgtttccgtcccgttaccccgttacggtttaccgggttaacccgggggttaccggggggtaacccgggtaaaccggggtcgggttaaacgggacggttaaaccggttaaccggttaacggtacccggttaaggg

SEQ ID NO: 73049 - DNA, 836 bp, Homo sapiens
  misc_feature: GYAE6OF02GSMSI.52.32.C10.1.454.CMB.1.raw
tcagcgcagtacgacacgaccggtgctcgatttagtatagacatcaacacacaaagggggcaggagtcagtcccaaccaggacacagcatggacatggagggtccctgctcagctcctggggctcctgctgctctggctctcgaggtgccagactggtgtctactaccagatcgacccagtctccacttccctcctgtctcgactattctaagtacggagaccgaagtaactaccaacctactcctacggttccgggcccgggggtacgaacgggtacggaacgtaacgtaacgttaggactaagtttacggtatttaccggtagttaaggtttacgggtaactaccggaaaacggtaaaaccccgaaaaaaccgggaccgggaaacccgtaacccgtaacccccctttaaaacgtcccgtacgtaccccgtaccgtacgtacgtcgacgtacctaacccgttacgttaaacgggaacccggacgggtaccctaagtaacgtaacggttacgtagggtaacgggacggtcgtaccgtggtacggtacttacgtttacttttacgtaccactacgtcaccgtacggtacgccgtaacgacacgttcgtaatacgtacgtactacgacgttaaacttactttaaccgtacgtaacgttaacgaaacgtttggtaaaactttacggtaaccttacccgggttcccttaaccccgggtccgtttaccccggggttaaccgggggttaccccgggggggtaaccgggggttaacggttaaccgggggttacggtaaacgggtttacccgaaacggggtaccggttaaccggttaccggggg

SEQ ID NO: 73050 - DNA, 736 bp, Homo sapiens
  misc_feature: GYAE6OF02G4KAY.52.32.C10.1.454.CMB.1.raw
  modified_base (661)..(661): a, c, t, g, unknown or other
  misc_feature (661)..(661): n is a, c, g, or t
  modified_base (718)..(718): a, c, t, g, unknown or other
  misc_feature (718)..(718): n is a, c, g, or t
tcagcgcagtacgacacgaccggtgctcgatttagtatagacatcaacacacaaagggggcaggagtcagtcccaaccaggacacagcatggacatggagggtccctgctcagctcctgggctcctgctgctctggctctcgaggtcgccagatgtgtcatccagactcgaccctagtcctccacttcccgtcccttgtctgactatactagtaggacgaactagaactccacctactacctacgttcggccgggacggacgtacgaagactagttacgactattacggtatacgtaggtagttacggaacgttacgaaacgtaaaccggtaaaaccggaacgggaaccctaaacccgtaacccccgtttaaaccttaccgtacggtaccccttaccgttacgaacgttccgaaccgttaccttacccgtaaccggttttaaaccggggaaaccgggttccggggttaccctaacggttacggtaaacgggttacggtaagggtacgggtaacggtcgggttaccgttacgggtaggtaaccgttaacgtttaccttttacgttaaccctacgtaactacggacgtacgacggtctacggactaccgtacgaagtactaagtacgtacactaactattacttactaagtacaacgtagtanacgtactccgttacctccgtcgttacggtacgggttcgggaccggtaggaggttacnggttacagcgtaagtcgg

SEQ ID NO: 73051 - DNA, 815 bp, Homo sapiens
  misc_feature: GYAE6OF02GIO5Z.52.32.C10.1.454.CMB.1.raw
  modified_base (169)..(169): a, c, t, g, unknown or other
  misc_feature (169)..(169): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctgctcgtggctctcaggtgccagagtgtagtctatccagntcgacccagtctccactccctccgtgtctcgctatctagtacggagaacaagaactccaccactctacgttcggccggacgagtcgacgtaacgtagttacgactattagttaattacgttaggtaagtttacggtaattacgaacgtaaaccgaaaaaccggacgggaaccaccggtaacccccttaacgtccctacgaccgttccctacgactgaccttattacgtaacgtttaacgggaaaccggtaccgggttaccctaacgttaacggtaacggttacggtaacgggttaggtaacgggttcgtaccgttacggtacggggtaacttaacggttttactttttaacccgttaacgtacccttaagttaccgtacccgggttaggtacccggtacgacccggttccgaaccggttcgttaacggaaccgttaacggttaacgttaccggaaacctaaaaggttacgttttacgtaaacgttcgtaaactaaccggtaattaagtaccgtaacgtttaccgttacccggtaccgtttcccgggttaaccgtttacccgggggttaccggggggaacccggggttaaccgggttacggaaacggttaaccggtaacggaacgggttaaccggccgggttaaacg

SEQ ID NO: 73052 - DNA, 781 bp, Homo sapiens
  misc_feature: GYAE6OF02FE3AK.52.32.C10.1.454.CMB.1.raw
  modified_base (114)..(114): a, c, t, g, unknown or other
  misc_feature (114)..(114): n is a, c, g, or t
tcagcgcagtacgacacgaccggtgctcgatttagtatagacatcaacacacaaaagggggcaggagtcagtccccaaccaggacacagcatggacatgagggtccctgctcanctcctggggctcctgctgctctggctctcgaggtgaccagactagtggtcactccagatcgaacccagtcctccatccctccctgtctgcctaatccttaatacggagtaaacccgagaaactccaaccgtactccgtaaccgtttggccccgggggtacgaacggtcgaacgactaacgtttacgcgtatagtactctaagtaagtttcgtactacgaaagtaaccaaaaaccgacgggtaaccaaccggtaaccccctaaaaccgttccctacggtaactacccgtacgtacgttacgactaaccgttacccgtaacgtttaacgggaaaaccggtccggggttaacccagttaacgtaaacggttacgtaagggttcgggaaacgggttcggtactcggttacgggtaacgttagttacgtttttacctaacctactactcgacgacgtacggtctcgtacgacgtacgaacgttaacgaccgtacgttacgtaactaacgttaactttacgtaaccgttattaaccgaaatacggtaactaggttaccgttacgttcccgtacccgttcctaccggttaacccggggttaccgggggtaaccgggggtaaaccgacggggttacggaacggtaaccggtacgttaaccgggtaccgttacggg

SEQ ID NO: 73053 - DNA, 607 bp, Homo sapiens
  misc_feature: GYAE6OF02JYUDL.52.32.C10.1.454.CMB.1.raw
  modified_base (148)..(148): a, c, t, g, unknown or other
  misc_feature (148)..(148): n is a, c, g, or t
  modified_base (269)..(269): a, c, t, g, unknown or other
  misc_feature (269)..(269): n is a, c, g, or t
  modified_base (321)..(321): a, c, t, g, unknown or other
  misc_feature (321)..(321): n is a, c, g, or t
  modified_base (451)..(451): a, c, t, g, unknown or other
  misc_feature (451)..(451): n is a, c, g, or t
  modified_base (500)..(500): a, c, t, g, unknown or other
  misc_feature (500)..(500): n is a, c, g, or t
  modified_base (507)..(507): a, c, t, g, unknown or other
  misc_feature (507)..(507): n is a, c, g, or t
tcagcgcagtacgacacgaccggtgctcgatttagtatagacatcaacacacaaagggggcaggagtcagtcccaaccaggacacagcatggacatggagggtccctgctcagctcgtgggctcctgctgctcgtggctctcgaggtnccagatgtgtcatccgagactcgacccagtcctccactcccgtcctgtctcgctatcttagaggagacagactccaacatcacgtcggccggtacgaggtcgatacattagctatcgtatntaggtattgtacacagaaaccaaacgtacggacacctaccctaactccgtanctcgactagctacactactaggtaacgaacgtccggtctaagtcctaagtcgtaggtaggtacgtcgtcgtacgtaggtaactaacgttttactttaaccgttacaactcgtacgaacgtacgcggtacngtaaccgcgtataaccggataccaagttaccaagtaactattaccgtanactaaanacgtattaagatcgtcgtacctttccggcgttaaccggttcggggtaccgggaacgggtaactcgggaagtacgttaaccggatacccgggtgtaaccgg

SEQ ID NO: 73054 - DNA, 640 bp, Homo sapiens
  misc_feature: GYAE6OF02GAKGL.52.32.C10.1.454.CMB.1.raw
  modified_base (206)..(206): a, c, t, g, unknown or other
  misc_feature (206)..(206): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctggctctcaggtgccagatgtgtcatccagatcgacccagtcctccactccctccctgtctgcatctatagganacagaataccaccatcacgttcggccgggacgagtcgaagactagttacgctagtgtacttcgtagtaagtttaggtatacgaacgaaaccgaaaaaccgacgggaccaaccgtaacccctaaactcctacgtactcctacgatcgactacttaccgtacgttaacggaacgtacgggtacctagtacgtaaggtacgtaggtaggtacggtcggtacgtcggtacgggtacttaagtttactttttaactacccaacgttactcgtaacgtcgacgggtctacggtaccgacgtacgtacgaactacgttagtaccgtaacaacgttattaacgttagtactaacgaacgtataactgtaccttacgtcctaccgtctaccgtacgggttacgggaccgggtaagtacgtgaacgacgtacgtacggatacgg

SEQ ID NO: 73055 - DNA, 685 bp, Homo sapiens
  misc_feature: GYAE6OF02GPHOH.52.32.C10.1.454.CMB.1.raw
  modified_base (570)..(570): a, c, t, g, unknown or other
  misc_feature (570)..(570): n is a, c, g, or t
tcagcgcagtacgacacgaccggtgctcgatttagtatagacatcaacacacaaagggggcaggagtcagtcccaaccaggacacagcatggacatgagggtccctgctcagctccgtggggctcctgctagctctggctctcgaggtcgccagagtgtacgtcatccagatcgacccagtctaccactccctcctgtctcgatatctagtaggacgacagaactcacatctacgtgaccgggcagtcgacgacgtagttagctatacgtagtcgtagtagtttcgtatacgtaacgaaccaaaaacgcgggaacctaccggaaccccttaaactcccgtacgaacttaccgtcctagtcgacctactaccgttaacgttacgggaaaaccgccgggttaccacgttacgtacgttacgtacggaaggtaaggtcggtagtcggtaggtacgttagtttaccgttttaacttacgacccgtagtccgtaaacggcgtaaggtccgtcgaccgtaccgttaggtaacgtaaccattacgtaccaacttaacgtaactttataaccggttanaaactaacggttaactaagtagtaccgttacgttccaccgtcgttccggttaacggtccggggtaacgggaacccgtaggggttaccgagacggtaacggtaccgaggttaacgg

SEQ ID NO: 73056 - DNA, 638 bp, Homo sapiens
  misc_feature: GYAE6OF02JLQ86.52.32.C10.1.454.CMB.1.raw
  modified_base (499)..(499): a, c, t, g, unknown or other
  misc_feature (499)..(499): n is a, c, g, or t
  modified_base (516)..(516): a, c, t, g, unknown or other
  misc_feature (516)..(516): n is a, c, g, or t
  modified_base (549)..(549): a, c, t, g, unknown or other
  misc_feature (549)..(549): n is a, c, g, or t
tcagcgcagtacgacacgaccggtgctcgatttagtatagacatcaacacacaaagggggacgaggagtcagtcccaaccaggacacagcatggacatgagggtccctgctcagctccgtgggctcctgctgctctggctctcaggtgccagatgtgtcatccagatcgacccagtcctccactccctccctgtcctgtcacttactataggagtaacagtaactccaacctacgtactacgttcggacccggcggaacggtacggaagacctaagttagctagtagttatacttacgtagttaggtatacgacgaaaaccgtaaaaccgaacgggaccaaccgtaacccctaaccgtccgttacgactcctacgatcgaccacgtctaaccggttaacggtaaacgtccggtacctagtacgtaacgttacgagtaaggtacgtcgtcgtgtacggacgtaactttattttacgttacccactatgactgtaacggcngacacgtcaggaacgtntagtctaacaattataactgttctaacgaattntagtatagtacctgtaccctgttacggttacgggtaccgggggacggtaaaccggttaggaggacccctagtacggttacggaagtacg

SEQ ID NO: 73057 - DNA, 725 bp, Homo sapiens
  misc_feature: GYAE6OF02J14PP.52.32.C10.1.454.CMB.1.raw
  modified_base (140)..(140): a, c, t, g, unknown or other
  misc_feature (140)..(140): n is a, c, g, or t
  modified_base (149)..(149): a, c, t, g, unknown or other
  misc_feature (149)..(149): n is a, c, g, or t
  modified_base (180)..(180): a, c, t, g, unknown or other
  misc_feature (180)..(180): n is a, c, g, or t
  modified_base (366)..(366): a, c, t, g, unknown or other
  misc_feature (366)..(366): n is a, c, g, or t
  modified_base (701)..(701): a, c, t, g, unknown or other
  misc_feature (701)..(701): n is a, c, g, or t
tcagcgcagtacgacacgaccggtgctcgatttagtatagacatcaacacacaaagggggcaggagtcagtcccaaccaggacacagcatggacatgagggtccctgctcagctcctgggctcctgctgctctgctctcnggtgccagntgtgtcacgtccagatcgacctgtcctaccncttccctcccgtgttctcgactacttcgtagtaggacgaactagaactccaccgtactctaccgttgggcccggagtaacggtcgaacgacgtaacgttacgactacgttgtactgtagttagttggtactacaacgaaacgaaacgtcgactaccgtaaccctaactccggttcaacgtcccgtntacgacgtccgttaccgtaaccgttacggttaaccggaaacccggttcgggtaccaacgttaacggtaccgtagtacggttacggtacggtccggtacgttacgggtacggtaacgttacgtttacttttaacccgttaccgtaaccttaggtaaccgtaggtaccggacgttccgtagccgttaaccgacgttaacggtaactacgtactaacggtaaccctaacttagtttaccttacgggtaccttaaacgtaagtagtacttacgttagacccgttcgttacccggtaagttccggtaacggttccggggaacggtacgtaggtacgtaanacgggtttaccaaagtcgtaccgg

SEQ ID NO: 73058 - DNA, 779 bp, Homo sapiens
  misc_feature: GYAE6OF02GF3B3.52.32.C10.1.454.CMB.1.raw
tcagcgcagtacgacacgaccggtgctcgatttagtatagacatcaacacacaaagggggcaggagtcagtcccaaccaggacacagcatggacatgagggtccctgctcagctcctggggctctgctgctctggctctcaggtgccgagtagtgtgtcatccagatgacccagtcctccatcctcctgtctgcatctagtaggacgaacagaactaccaactactaccgtacgttcggcccggggacggtaaggttacggaacggactaacgttaaggcctaatcgttacttcgtaggtaacgtttaggtactaacgacgtaaaaccgaaaaacgtacggggaaccaccggtaaccctaaacgtccgtagtactaccgtacggtaacgtcgactacgtaccgtaacgtttaacgggaaacgtcgggtaccctagtaacgtaacggtttacgaacggttagggaaacgttcggtccttacggtaacggggtaacttaacgttttaacgtttttaaccgttaccgtaaaccttaactacgaacgggtcaaccgggtacttaacgaccggttagtcccgtaaacgtaagaacccggtttatacgaaaccttaacgtaaagtttaccgttaaccgttaaggaaaccgtaaactaagtaccgttaagtaccttacggtacccgttaccgttacgttaaccggtaaccgggggtttccggggtaaaccgggggtaccgtaagggttacgggaacctacgtaaccggtaagtaccggttaacggg

SEQ ID NO: 73059 - DNA, 527 bp, Homo sapiens
  misc_feature: GYAE6OF01DU7TE.16.59.F04.1.454.CMB.1.raw
  modified_base (479)..(479): a, c, t, g, unknown or other
  misc_feature (479)..(479): n is a, c, g, or t
  modified_base (519)..(519): a, c, t, g, unknown or other
  misc_feature (519)..(519): n is a, c, g, or t
tcagtgtactactccacgaccggtgctcgatttagtacacacacttagggattggggggcaccaggggtcccttccaatatcaacaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctggaccctgccccggttctcaggctccctcgttgggggcaaagctgccctgaccctttcgggtcgcgcagcctgaggatgaggctgagtattactgcttgctctctatagtggtgttcgggtgttcggcggaggacagctgaccgtctagcagccaaggcncgcccctcggtcactctcgtcccgcctcctcgagtgtacncgtgacgg

SEQ ID NO: 73060 - DNA, 562 bp, Homo sapiens
  misc_feature: GYAE6OF01DZWM0.16.59.F04.1.454.CMB.1.raw
  modified_base (540)..(540): a, c, t, g, unknown or other
  misc_feature (540)..(540): n is a, c, g, or t
  modified_base (554)..(554): a, c, t, g, unknown or other
  misc_feature (554)..(554): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcctactggttccaacagaagcctggccaagccccaggacacctgatttatgatacaaacaacaaacactacctcggaacccctgacccggttctcgacggcctcccgtcggttcgggacaaagcctgccctcgtacccgtttcggtgcgccgagccgtgaggacgtgaggctgtagtactactggcttgctctcctatgtggtggttcgggtgttcggcgggtacggacaaggctcgaccgtcgtacgcgacgccgaaggcctacgccccgtcggtcaccgttctcgtccccncctcctcgacgtcncgcgtcgg

SEQ ID NO: 73061 - DNA, 650 bp, Homo sapiens
  misc_feature: GYAE6OF01EMW0H.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgccccaggacacctgatttatgataacaaacaacaaacactcctcggacccctgcccggttctccacggcctacccgtcggttcgggggacctaaagccgtacgcccgtcgtaccccgtttcgggcgcgccacggcctggaggtatggaggtctgagttattacgtgtcttgcttcgtccttagttacggttggttcggtttcgggtgttccgggcgggacgggtaacccaaggtccgtcgtacccgttcgtacgggtcaaccggcccgaacgggtcccgtaccgtccccccggttcggtaccctacccgttccgttcccgttacccccaccccgttcccgtaccggaacgtttacgtaccgaccgtacggg

SEQ ID NO: 73062 - DNA, 548 bp, Homo sapiens
  misc_feature: GYAE6OF01A0I0G.16.59.F04.1.454.CMB.1.raw
  modified_base (296)..(296): a, c, t, g, unknown or other
  misc_feature (296)..(296): n is a, c, g, or t
  modified_base (541)..(541): a, c, t, g, unknown or other
  misc_feature (541)..(541): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatcctactggttccaacagaagcctggccaagcccccaggacactgatttangatacaacaacaaacactcctgacccctgcccgtctcaggctcccgtcgttggggcaaacgctgccctgaccctttcgggtcgcgcagccctgaggatggaggctggagttattacgtgtcttgctctcctataggtgtgttcgggtgttcgggcgggaggaccaaggctggaccgtctaacggcacgcccaggctcgccccctcggtccactcttccgtccccaccctccgtcgacgttcgtcncgtcggg

SEQ ID NO: 73063 - DNA, 569 bp, Homo sapiens
  misc_feature: GYAE6OF01EST3C.16.59.F04.1.454.CMB.1.raw
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccgttctcaggctccctcgttggggcaaagctgccctgaccctttcgggtgcgcagcctgaggatgaggctgagtattactgcttgctctcctatagtgtgttcgggtgttcgggcgagggaccaagctgaccgtcctaggtccaggccccaaggcctcggccccccgttcgggtcccaccttccgtcgttccccccaccccgttccctcccggtaacgttacgtaaccgcgttaccggg

SEQ ID NO: 73064 - DNA, 534 bp, Homo sapiens
  misc_feature: GYAE6OF01EARS0.16.59.F04.1.454.CMB.1.raw
  modified_base (383)..(383): a, c, t, g, unknown or other
  misc_feature (383)..(383): n is a, c, g, or t
  modified_base (528)..(528): a, c, t, g, unknown or other
  misc_feature (528)..(528): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccaggacactgatttatgatacaaacaacaaacactcctgacccctgcccggttctcagctccctcgttcggggcaaagctgccctgaccctttcggtcgcgcngcctgacggatgaggctgagttattactgtctgccttctcctatagtggtgtttcgggtgttcgggcggacggtacaagctgaccgtcgtagtcacgccagctcgccccgtcgtcactctcgtcccaccctcctacgatacgtcngtacgg

SEQ ID NO: 73065 - DNA, 599 bp, Homo sapiens
  misc_feature: GYAE6OF01BO8AM.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaagcccccaggacactgatttatgataacaaacaacaaacactcctcggacccctgcccggttctcgagcctcccgtcggtcggggcaaacgctcgccctcgacccgtttcgggcgcgcacgccgtggaggtatggaggctagtacgtattacgtgcttgccttctcctagtagtggttgttcgggttgttcgggcgggtacgggacctaaggcgtacggacccgttccgtaggtccacggcccgaaggtccctcggcccccgtcggtccaccgttctccggttcccccgcccgttccctacggtacgtacgtaccgcgtacggg

SEQ ID NO: 73066 - DNA, 458 bp, Homo sapiens
  misc_feature: GYAE6OF01AVQIS.16.59.F04.1.454.CMB.1.raw
  modified_base (443)..(444): a, c, t, g, unknown or other
  misc_feature (443)..(444): n is a, c, g, or t
  modified_base (446)..(458): a, c, t, g, unknown or other
  misc_feature (446)..(458): n is a, c, g, or t
tcagtgtactactccacgaccggtgctcgatttagtacacacacttagggatggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtcgtggggccaagggaccacggtcaccgtctcctcaccctccaccaagggcccatcggtccttccccctcggccaccctccctccaacgacgccacctccgtcgggggccacgacggccggccccgtgggcctcgccgtggtccaaggacctacgttccgagtagtacacgtgagcgggctggcgaaggcgcatagnngnnnnnnnnnnnnn

SEQ ID NO: 73067 - DNA, 615 bp, Homo sapiens
  misc_feature: GYAE6OF01A4ZVS.16.59.F04.1.454.CMB.1.raw
  modified_base (451)..(451): a, c, t, g, unknown or other
  misc_feature (451)..(451): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggtttccaacagaagcctggccaagcccccaggacactgatttatgatacaaacaacaaacactcctggacccctgcccggttctcagctccctcgttgggcaaagctgccctgaccctttcggtcgcgcagcctgagatgaggctgagtattacgtgcttgctctcctatagtggttcgttcgggttggttccgggngggacgggaccaggcgtcggacccgtcgtacggtcgacgccccgaaagggtccgtcccgtcccccccgttcgggtaccctacccgttcccgttaccccggtttcccccgaccccccgttcccggttaccggtaccggttaacggttacccgtccggttaccggg

SEQ ID NO: 73068 - DNA, 687 bp, Homo sapiens
  misc_feature: GYAE6OF01BFR0W.16.59.F04.1.454.CMB.1.raw
  modified_base (299)..(299): a, c, t, g, unknown or other
  misc_feature (299)..(299): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaacgccccaggacactgatttangatacaaacaacaaacactacctcggacccctgccccggttctccgacggcctccccgtcggttcggggacaaacggctcgccctcgtacccgtttcgggcgcgcagccgttagacggtagtggaggtcgtgtagtactttacgtgtacgttcggtcttccttccgtagttaggttcgggttggtttcgggttcggtttcgggcgggtaacgggaccgaaggtccgttacggtacccggttacccgttacgggtaccgaaccggtccccgtaaacgggtcccgtacccggtccccccgttcgggttacccgtacccgtcccgttaccgttaccccccgtacccccgtttccgttaccgtaacggttaccgtaccgtacgttaccgggg

SEQ ID NO: 73069 - DNA, 585 bp, Homo sapiens
  misc_feature: GYAE6OF01BE0PT.16.59.F04.1.454.CMB.1.raw
  modified_base (298)..(298): a, c, t, g, unknown or other
  misc_feature (298)..(298): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggagctgtcaccaatggtcattactccctactggttccaacagaagcctggccaacgcccccaggacactgatttangataacaaacaacaaacactcctcggacccctgcccggttctccaggcctcccgtcggttggggacaaagctcgccctcgtaccccgtttcgggtcgcgtcacgtcctgacggatggaggtctgatattactgcttgctctcctagtagtggtgttcgggtgttcgggcggaggacagcgtgaccgtcgtaggtcacgcccgaggtcctccgacccccgttcggtacctaccgtccttcccggttaccccaccccgttccgtaccgtagtacgtaccgtacgtcggg

SEQ ID NO: 73070 - DNA, 682 bp, Homo sapiens
  misc_feature: GYAE6OF01BO0DM.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccagggagggacagtcactctcacctgtggctccagcactggagctgtcaccaatggtcattatccctatcggttccaacagaacgcctggccaacgccccaggacactgtatttatagataacaaacaacaaacactcctcggacccctgcccgttctcacggctcccgtcggtcggggcaagctcgccctcgtacccgtttcgggcgccgcgacgccgtgacggtagtcggaggtcgtaggtaacgttacttacgtgtcgttcgtcctcttccgttagtacggtttgggttcgggtttacggggtttcgggttccgggtacggggaacgggtaccgtaaggccgttaccggtaccgttcccgtacgggtccaacggccccgtaacggtcccgtccggtccccccgttcgggttccctaccggttcccgttacccggttccccccgtcccccgttacccgtacccggtaacgtttaccggttacctcggtaccgggg

SEQ ID NO: 73071 - DNA, 561 bp, Homo sapiens
  misc_feature: GYAE6OF01B4I59.16.59.F04.1.454.CMB.1.raw
  modified_base (378)..(378): a, c, t, g, unknown or other
  misc_feature (378)..(378): n is a, c, g, or t
  modified_base (391)..(391): a, c, t, g, unknown or other
  misc_feature (391)..(391): n is a, c, g, or t
  modified_base (553)..(553): a, c, t, g, unknown or other
  misc_feature (553)..(553): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcagctcctcgttggggcaaagctgccctgaccctttcggngcgcagcctgagntgaggctgagtattactgtcttgctctcctatagtggtggttcgggtgttcgggcggagggaccaaggtctaggaccgtcgtacggtcacgcccgaaggcctcggcccccgtcggtccacgttcctccgttccccctaccctcccgtcgacgttacgtaccncgtacggg

SEQ ID NO: 73072 - DNA, 672 bp, Homo sapiens
  misc_feature: GYAE6OF01E0KSQ.16.59.F04.1.454.CMB.1.raw
tcagtgtactactccacgaccggtgctcgatttagtacacacacttagggattggggggcaccaggggtcccttccaatatcagcaccatggcctggactcctctcttttctgttcctcctcacttgctgcccagggtccaattcccaggctgtggtgactcaggagccctcactgactgtgtccccaggagggacagtcactctcacctgtggctccagcactggagctgtcaccaatggtcattactccctacttcggttccaaacagaacgcctggccaacgcccccaggaccactgtactttatagatacaaaacaaacaaacacctcgtacggacccctgccccggttctccacggccttccccgtcggttcggggaccaaaggccgtcgcccgtcgtaccccgtttcggggtcgccgctacgcccgtggacggagtggaggtctaggagttattactgtcttgacctcttacctagttggttgggttggtttcgggttggttcggggcgggtaacgggtaccgaaggccgttacggtaacccgttcgtacgggtaccaccggaccgtaacggtccgtcccggtccccccgtcggttccctacgttcccttcccgttaccccctacccgttcccgtacggtaacgttacgtaaccgtccgtacgggg

SEQ ID NO: 73073 - DNA, 560 bp, Homo sapiens
  misc_feature: GYAE6OF01EHBXI.16.59.F04.1.454.CMB.1.raw
  modified_base (469)..(469): a, c, t, g, unknown or other
  misc_feature (469)..(469): n is a, c, g, or t
  modified_base (551)..(551): a, c, t, g, unknown or other
  misc_feature (551)..(551): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgccccaggacactgatttatgataacaaacaacaaacactcctcggaccctgtcccgttctcaggcctcccgtcggttcggggacaaagctcgcccgtcgtacccgtttcgggtcgtcgtacgccgtggacggatggaggtctggtagttattacgtgcttgctctctatagttggtgttgggtgttcggnggaggacagctgaccgtctgcagcccgagcctcgcccctcggtcctactccgtccgttccccacctccgtcgacgtactacncgtggacgg

SEQ ID NO: 73074 - DNA, 644 bp, Homo sapiens
  misc_feature: GYAE6OF01A48ZB.16.59.F04.1.454.CMB.1.raw
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcacgtggagctgtcaccaatcggtcattatccctatggttccaacagaagcctggccaaagccccaggacactgattatgatacaaacaacaaacactcctaggacccctgcccggttctcacggtctcccgtcgttcggggcaaagctacgcctggtacccgtttcggtgccgctacgccgtggagggtatcggagggtactaggtagtaacgttactacgtcttacgtccgttccttccgtacgttaggttcggttacggtttcggggttagttccggggtacgggtacgggtaccgaacggtcgtacggtacccgtcgtacgggtcacgtcccgaacggtcgtaccggcccccgttcggtaccgtccttccgtccgttcccccacccgttaccctaccggtaacgtacgtaccgtcgtaccgg

SEQ ID NO: 73075 - DNA, 675 bp, Homo sapiens
  misc_feature: GYAE6OF01DBBXX.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctacgtcggttccaacagaagcctggccaacgccccaggaccactgattatgataacaaacaacaaacacctcctacgacccctcgtcccggttctccgaggcctcccgtcggtcggggacaaacgctcgccctcgtacccgtttcggtcgacgtcgacgccgtagacgggatcggacggtctaggtacgttaatttacgttcgtcgttcgcctttccgtcgttagttaggttcgggtttcgggtttcggggttgggttaccggggcggggtaacgggtaccgtaacggtcgttaccggacccggttcgtacggtacgaccgacccgtaacgggtccctaccgtccccccgttcggtaccctccgtcctttcccggtacccccgtccccttcccgtcggtaacggttaccgtaccgtcgtacggg

SEQ ID NO: 73076 - DNA, 549 bp, Homo sapiens
  misc_feature: GYAE6OF01AGRE3.16.59.F04.1.454.CMB.1.raw
  modified_base (406)..(406): a, c, t, g, unknown or other
  misc_feature (406)..(406): n is a, c, g, or t
  modified_base (542)..(542): a, c, t, g, unknown or other
  misc_feature (542)..(542): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaaacagaaagcctggccaagccccaggacactgatttatgatacaaacaacaaacactcctgacccctgcccggttctcaggctccctcgttggggcaaagctcgcctcgaccctttcggtcgcgctagcctgaggatgagctgatntactgcttgctctcctatacgtggtgtttcgggtgttcggcgggagggaccaagctcggaccgtccgtaggtcacggcccaaggcctcgcccccgtcggtccactcctacgttcccgccccttcgctagtcgtacncgtacgg

SEQ ID NO: 73077 - DNA, 621 bp, Homo sapiens
  misc_feature: GYAE6OF01AJM2P.16.59.F04.1.454.CMB.1.raw
  modified_base (321)..(321): a, c, t, g, unknown or other
  misc_feature (321)..(321): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctatcggttccaacagaacgcctcggccaacgcccccaggacactgatttatgataacaacaacaacactcncgaccctgcccggtctcagctccctcggttgggaccaagctcgcccgtgtaccccgtttcgggtcgcgcacgcctggaggtatggaggcttaggagttacgttactgtacttgtcttcctacgttataggttgggtggtttcgggtgttccgggcgggtacggaaccgaggccgttcggacccgttcgtacggtacacggtacccacgggtcctacccggtccccccgtcggttaccctaccgttccgtcccggtttcccccaccccgttcctaccggtaggttactacccgcgtacggg

SEQ ID NO: 73078 - DNA, 581 bp, Homo sapiens
  misc_feature: GYAE6OF01CR2RU.16.59.F04.1.454.CMB.1.raw
  modified_base (321)..(321): a, c, t, g, unknown or other
  misc_feature (321)..(321): n is a, c, g, or t
  modified_base (400)..(400): a, c, t, g, unknown or other
  misc_feature (400)..(400): n is a, c, g, or t
  modified_base (528)..(528): a, c, t, g, unknown or other
  misc_feature (528)..(528): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaacgccccaggacactgatttatgataacaaacaacaaacactccnggacccctgcacggttctcgaggctcccgtcggtggggacaaagctcgccctgtacccgtttcggtgcgcacgcctggnggatggacggcgtagagtattacgtgtcttgctctcctatagtggttgttcgggtgtcgggcggaggaccaggtctcgaccgttcgtaggtccacggtacccaacggctccggtcccccgtggtcccnccgttccgttccgttccccgtccccgttcctacggtacgttacgcctaaccgg

SEQ ID NO: 73079 - DNA, 785 bp, Homo sapiens
  misc_feature: GYAE6OF01CSD50.16.59.F04.1.454.CMB.1.raw
  modified_base (757)..(757): a, c, t, g, unknown or other
  misc_feature (757)..(757): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcaccgtgtcgcctcgacgcacgtggacgtctcgtaccaacctaagttcgtactacttacctcctacgtcgtaccaacgaagacgcgtacgaccgaccgacccgagacctacgtagtattagagaactaaacaaaacaaaacctaacctaccgttacccgtaccgtaccccgtaccggtaccccgttactaccggaccggtccccttccggtacggggttacgggaacgtaaacggtccgtacccggtacccgttaccggtttaccccgggttgggtaaccgtcccgacgtaccggtccgtaacgggaacggtacggtacggtacggtacgttaaccgggtagttaaaccgttcgttcgttacgttaccgtccctttaccgtaccgttaaggttacggggttcgggttttccggggtttacgggttccgggttaccggggaacggggtaaccggaacgtaccgtcggttacccggtaccgttacggttacgacgtaccgtaccgaaccggtcctaccccgtcccgtacgtctaccgttccgtccccttacccnccgtccgtacgtattacacgtgtacggg

SEQ ID NO: 73080 - DNA, 565 bp, Homo sapiens
  misc_feature: GYAE6OF01AQRA7.16.59.F04.1.454.CMB.1.raw
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
  modified_base (455)..(455): a, c, t, g, unknown or other
  misc_feature (455)..(455): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaagtggtcattactccctactggttccaacagaacgcctggccaacgccccaggacactgatttatgatacaaacaacaaacactcncgaccctgcccgttntcgagcctccgtcggtcgggcaaacgctcgcctgtcccgttggtcgcgcacgcctggaggtactggagctgagtattactgtctgtctcttctagtgtggttggtcgggtgtccgggnggacggacgagcgtcgaccgttccgtaggtcacgccgagccgtccgcccgtcggtcaccgtcttcccgtcccctaccccgtcgtaccggtacgtacgtccgtagtacggg

SEQ ID NO: 73081 - DNA, 831 bp, Homo sapiens
  misc_feature: GYAE6OF01BJETW.16.59.F04.1.454.CMB.1.raw
tcagtgtactactccacgaccggtgctcgatttagtacacacacttagggattgggggcaccaggggtcccttccaatatcagcaccatggcctggactcctctctttctgttcctcctcacttgctgcccaggtccaattcccaggctgtggtgactcaggacgccctcactgactgtcgtccccaggacggacagtcactctcacctgtcggctccagcactggacgctgtacaccaattggtcctatttactacccgttaacgttcgggtttacccaaacgaacggtaacgtccctacggacccaaaaccggtccccccgaaagggacctaaccgtaggtaattttaacgtacgaaattaaaaccaaaacctaaacaaaaccaccttaccgtaaccggtaccccgttacgtccccgggtttacttaccgaacggtcccgtacccgttcggggttacggggacaaacgtccgtacgcccgttacggtcccgtttcgggctaccgcgtaagtcccgtaggacgtaacgtcgaacggtctaggtaacgttagttaccgttcggcgtttaccggcttacccgttacgttaacgttacgggttcgggttacgggtttccggggttaggttacccggggacggaaccgggtaaacgtccgtacgggttacccggtaaacccggtttcggtaaccggtccggaaaccggtaccgtaaccggtccccgttacccggtcccccccgttacgggttccctaacccggtttcccttcccgtttcccccccgacgtttacccgtacccgggttacgtaaccttccgtaaccggttcgggg

SEQ ID NO: 73082 - DNA, 725 bp, Homo sapiens
  misc_feature: GYAE6OF01C2146.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtcgtccccagggagggacagtcactctcacctgtggctccagcactggagctgtcaccaatggtctattactccctatggttccaacagaacgcctggccaacgcccaggacactgatttatgaataacaaacaacaaacactcctacgacccctacgtcccgttctcgacggtcctcccgtcggttcggggacctaaacggctcgcccgttcgtacccgtttcgggtacgccgacgcggaccgttggacggtagtacggtacgggtcttagggtacgttaacgttacgtgttcgtttccgtcgttaccgttaccgttaaggttacggttcgggtttacgggttttccggggttcggtttaccggggacgggtaacgggtaaccgtaacggtccgttacggtacccgttcgttacggtccgaccgtacccggaacggtcctacccggtccccccgttcggttcctaacccgttcccgttacccgtttaccccccgacccgtttacccgtacccgggtacgttaaccggtccgttaacgtaccgggg

SEQ ID NO: 73083 - DNA, 631 bp, Homo sapiens
  misc_feature: GYAE6OF01AMGGL.16.59.F04.1.454.CMB.1.raw
  modified_base (226)..(226): a, c, t, g, unknown or other
  misc_feature (226)..(226): n is a, c, g, or t
  modified_base (480)..(480): a, c, t, g, unknown or other
  misc_feature (480)..(480): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtcattactccctactcggttccaacagaagcctggccaacgccccaggacactgatttatgatacaaacaacaaacactcctcgaccctgcccggtctcacggcctcccgtcggttcggggcaaacgctcgcccgtcgtaccgtttcggtcgcgcagcctaggacggatcggaggtcgtagtacgttacttacgtgtcgttagtcctctctagtgttggtcggtttcgggtgttccggggnggtaacgggaccgtacggtccgtacggtacccgttccgttaggtaccacggtcccgtaaggtcccgtccggtcccccgttcgggtcctaccgttcccgttccgttcccccgtcccgttcccgtaccggtaaggtacgtccgtagtaccggg

SEQ ID NO: 73084 - DNA, 478 bp, Homo sapiens
  misc_feature: GYAE6OF01AOT5G.16.59.F04.1.454.CMB.1.raw
  modified_base (446)..(478): a, c, t, g, unknown or other
  misc_feature (446)..(478): n is a, c, g, or t
tcagtgtactactccacgaccggtgctcgatttagtacacacacttagggatgggggaggattgatcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtctggggccaagggaccacggtcaccgtctcctcaccctccaccaacgggcccatccggtccttcccccgtggccacccctcctcccaacgacgccacctcgtcgggggcacgacggccggcccgtgggctcgccgtggtcaaggtactaccgttccgagtagtacacgtcggacgcgggctggacgaggcgcagtagnnnnnnnnnnnnnnnnnnnnnnnnnnnnnnnnn

SEQ ID NO: 73085 - DNA, 713 bp, Homo sapiens
  misc_feature: GYAE6OF01BV600.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcacaatggtcattactcctacgtggttaccaacagaacgccgtcggccaacgccccaggaccactcgtatttatagactaacaaacaaaccaaacactcctcggacccctcgtcccgttctcgacggtcctcccgtcggtcgggacaacgctcgccctcgtacccgtttcgggcgcgacgcgtccgtaggaggatcggaggtcgtagagttacttacgtcgtcttcgtccttctaccgttagtacggttggttcggtttcggggttcggttcgggacgggtacggaaccgtacggtccgtaccggtaccgttacgtacgggtaccgacggtaccccggtaacggtcccggttaccccggaccccccggttacggttccccttaccggtttccccgttaccccgggtttcccccccgtacccccgtttccccggtaaccgggttaacccgttaaccggttaacccgtacggttaacccggggg

SEQ ID NO: 73086 - DNA, 750 bp, Homo sapiens
  misc_feature: GYAE6OF01AVMXS.16.59.F04.1.454.CMB.1.raw
  modified_base (306)..(306): a, c, t, g, unknown or other
  misc_feature (306)..(306): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccgaggagggacagtcactctccacctgtggcctccagcacgtggagctgtcaccaagtgtcattactcctactcggttaccaacagaacgcctcgccaacgccccaggacactgtatttacngtataacaaacaaccaaacctactccctaccggtacccctacggtcccgttctacacgtcctacccgtcggtagggaccaacgctcgtccctcggtacccgtttcgggtcgccgtacgacgaccgtaggacgtagttacggacggtaccgtgtaaccgtttagtttaccgttcggacctttccgtaccgtttccttacccggttaagttcgggtttcggtttacgggggtttcccgggtttacgggtccgggggtacgggtaacccggggtactaacccgggtcttcccgggtaaacccggttccgttacggtacccgccggtaacccggtacggcccgttaaccccgggtccccgttaccgggttcttaacccggtttccgtccccggtttacccccgccccgttacggttcccggtaacggttctaaccgttcgtaccgggg

SEQ ID NO: 73087 - DNA, 1008 bp, Homo sapiens
  misc_feature: GYAE6OF01DEDBJ.16.59.F04.1.454.CMB.1.raw
tcagtgtactactccacgaccggtgctcgatttagtacacacacttagggattgggggcaccaggggtccctcaatatcagcaccatggcctggactcctctctttctgttcctcctcacttgctgcccagggtccaattcccaggctgtgtgactcaggagccctcactgactgtcgtccccagggagggacagtcactctcacctgtggctccagcactggacgctgtccaaccaattcggtactaactttaactcccccgttacgtcggtttacccaaacgtaacggaacggcccgtacggacccctaaacggcccccccgtaagggaaccctaacgttacggttaaacttttaacgttacggtaaaacctttaaaacccgaaaaaaccctaaaaacccgtaaaaaccctaacccgtttacccccggtttaccgggtaaacccccccgttcgggtaccccccgggttttaccttaccccggaaccgggttccccgtttacccccggtttacggggtttaccggggggaaccctaaaacgggtcccggttaccggtacccccgtttaccgggtttaacccccggttttcggggtcccggaccgggtaccgacggttaccccgttagggaacgggtacgtacgggtaccgggtaccgttagggtaacgtttacgtttaacgtcggttcctttacggtcccttaccgtttaccgttaagtttacggggtcgggttttacggggttttcggggtccggggtttaccgggaacggggttaaccgggtaacccgttaaacgggtccgtacccgggttaccccggttacggttaaccggggtcccttaccgggaaaccccccggttaagggtcccccgtttacccggtacccccccgggtttaccggtacccgtttaacccgttccccgttttaaccccgggtttccccccgtaccccctttacccggtaacggttaccgttaacccggttaaccgtcgggttaacccgggg

SEQ ID NO: 73088 - DNA, 749 bp, Homo sapiens
  misc_feature: GYAE6OF01CLJO7.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtacattactccctacgtcggttcccaaactagaacgcctgggacccaaacggcccccgaaggaaccacgtcgtaattttacagaactaaccaaaacaaaaccaaaaccacctacccgtaccggacccctcggtccccggtttctaccgacggtccctcccgttccgggttggggaccaaacgtccgtacgtcccgtcggtaccccgtttcggggtcgccggcgaacggtcccgtaggacggtagtcggacggtcgtaggtagttactttacgtgtacgttcggtcttccccccgtagttacgttagttgggtttcggtttcggggttcggttccgggacggggtaccggtaaccggtaacgtcccgggttacggtacccggttcggtaacggtaccgtaccggacccgtaacggcccgttcccggtacccccggttccggtaccctacgttcccgttcccgttcccccgtcccttccgtacggtacgttaccgtacgtcgtaccgggg

SEQ ID NO: 73089 - DNA, 659 bp, Homo sapiens
  misc_feature: GYAE6OF01BM2SK.16.59.F04.1.454.CMB.1.raw
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtctattactcccctacgtcggttaccaacagaacgcctcggaccaacgccccaggacactgatttatgatacaaacaacaaacactccgtcgacccctcgcccggttctcgacgcctcccgtcggttcgggacaacgctcgccctcgtacccgttcgggtcgcgcgacgccgtgacggtacgtggaggtctagtacgtattacgtcgtacttcgtctacctcgttagtaggttcggtttcgggtttcgggttcgggttcgggacgggtacgggtaaccgaacggtccgttacggtacccgttacgttacggaccgtaaccggacccgtaacggtccgtacccgttcccccgtcggtccctaccgtccttccggtaccccctcccgttccgtacgttacggtaccgtccgtcgtaccgggg

SEQ ID NO: 73090 - DNA, 812 bp, Homo sapiens
  misc_feature: GYAE6OF01DCG4B.16.59.F04.1.454.CMB.1.raw
  modified_base (237)..(237): a, c, t, g, unknown or other
  misc_feature (237)..(237): n is a, c, g, or t
tcagtgtactactccacgaccggtgctcgatttagtacacacacttagggattggggggcaccaggggtcccttccaatatcagcaccatggcctggactcctctctttctgttcctcctcacttgctcgcccagggtccaattcccaggctgtggtgactcaggacgccctcactgactgtcgtcccgagggagggacagtcactctccaccgtgtcggctccagccacgtggacnctgtaccaaccaagtgtactattacctaccttacgttcggttaccaaacgacgtaacgccgtacggaccaaccgccccgaggacctacgtagtaactttaacgtacgtaaactaaaaccaaaaccaaaacctaaaaccacccgtaccctaccggtaccccgttcggtccccggttctaccgaccggtcccgttcccggttacgggttacgggaaccaacggtccgtaccgtccccgttacggttaccccggtttggggccgccggtaccggacgtccgtaagggacggtacggtagggtacgtcggttaagtaacgttacttacgttcgtcgtttccgacgttccgttacgttaagggttcggtttcgggtttcggggtttcggggttcggtaccggggtacgggtacgggtaaccgtacgggtccgttaccggtacccgttcgggtaaccgtccgaacccggaccgtaccggtcccgtccccggttaccccgtcgttaccctacccggttcccgttcccccggttcccccgacccgtttaccgacgtaccggttacccgtacgccggtacgggg

SEQ ID NO: 73091 - DNA, 946 bp, Homo sapiens
  misc_feature: GYAE6OF01BOLNW.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcgaggacgccctcactgtactgtcgtccccgagggacggacagtcactctctaccgtgtcggcctccgacgcgacgtggacgctcgtaccaaccgtaagtcggtacctacttaccgtaccccttacgttacggttacccaaacgaacggacggtaccggtacggacccgaaaccggacccccggtaaggaaccgtacgtacgttacgttttaacgtacggtaaactaaaccaaaacctaaacctaaaacctacccgttacccgtacccggtacccccgttacggtacccccgggtttactaccgggtacccggttacccggtcccggtttacgggggttaccggggaacctaaaccgggtcccgtacccggttacccgtccggttaacccgggtttcggtaccggtaccgtaccgtaccggtccgacggggtacggtacggtaacgggtcggttacgttacgtaacgtttacgttacggtcggtaccgttcgtactttaccgtaccggtttagttacggtttacggggtggttttccggggttacgggtaccgggttacgggacgggtaacccgtacggttacggttaacccgggtcccggtttaacggtcggtaaccgtaccccggggtacccggtaaccggtttacccggtcccccgggtacccgtttaccgggtttacccgaaccccgtttttcccgggtaaccccggttttccccccgtaccccggttaccccgtttagggtaaccccggttaacgttcccgggtaccgttacccggggggg

SEQ ID NO: 73092 - DNA, 814 bp, Homo sapiens
  misc_feature: GYAE6OF01BZ6A4.16.59.F04.1.454.CMB.1.raw
  modified_base (322)..(322): a, c, t, g, unknown or other
  misc_feature (322)..(322): n is a, c, g, or t
tcagtgtactactccacgaccggtgctcgatttagtacacacacttagggattggggggcaccaggggtcccttccaatatcagcaccatggcctggactcctctctttctgttccctcctcacttgctgcccgagggtccaattcccaggctgtggtgactcaggagccctcactgactgtcgcccagggaggcagtcactctcacctgtgctccagcagtggagctgacaccagtgtcattactacctagtcggttaccaacgaacgaacgtccgtcggaccgtaaccgaccccgaaggacctacgtacggtaattttanagtaacttaaaccaaaaccaaacctaaaaccgtacctacccgtaccggtaccccgtccgtacccggtttactacgaccgtccgtaccgtccggggttacgggacaacggtcctacggtcccttaccggttaccccgggttttcggcgtaccgggaccgtacggtaccccggttaagggacggtacggtacgggtacgggtaccgttagggttaaccgtttaacgtttaaccgggtttgtcccgtttcggtacccgtttaccgtttacccggtttaggtacgggttttcggggtttaccgggggtttcgggtttccggggttacggggacgggtaaccgggtaaccgtaacggtaccggttccgtaacccggttcgtaccggtaccgtaaccggtaacccggacgttcccgacccggtacccccgtcgtacgtaacccttcccgttaccgccccctacccgtcctaacgggtataccgttaacgcggtaacgg

SEQ ID NO: 73093 - DNA, 553 bp, Homo sapiens
  misc_feature: GYAE6OF01E36IF.16.59.F04.1.454.CMB.1.raw
  modified_base (301)..(301): a, c, t, g, unknown or other
  misc_feature (301)..(301): n is a, c, g, or t
  modified_base (434)..(434): a, c, t, g, unknown or other
  misc_feature (434)..(434): n is a, c, g, or t
  modified_base (461)..(461): a, c, t, g, unknown or other
  misc_feature (461)..(461): n is a, c, g, or t
  modified_base (514)..(514): a, c, t, g, unknown or other
  misc_feature (514)..(514): n is a, c, g, or t
  modified_base (546)..(546): a, c, t, g, unknown or other
  misc_feature (546)..(546): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaacgcctggccaacgccccaggacactgtatttangatacaaaacaacaaacactacctcgacccctcgtcccgttctcgacggcctccgtcggttcgggacaagcctcgcctcggtacccttggtcgccgcacgcctgaggagtgaggctgagtagttactgtcttnctctctatgtggtgtcgggtgtcgggnggacggacagcgtcgtaccgcgttagcgacgccacgtccgccgcccgtcgtcnctcgtccgtccccgtccctcgtcgagtcgtcncgtacgg

SEQ ID NO: 73094 - DNA, 532 bp, Homo sapiens
  misc_feature: GYAE6OF01AJN8X.16.59.F04.1.454.CMB.1.raw
  modified_base (264)..(264): a, c, t, g, unknown or other
  misc_feature (264)..(264): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacngaagcctggccaagccccaggaccactgatttatgatacaacaacaaacactcctgacccctgcccggttctcaggctccctcgttgggggcaaacgctgccctgaccctttcgggtgcgcagcctgaggatgaggctgacgtattactgcttgctctcctatagtgtgttcgggtgttcgggcggagggacagctgaccgtctaggtcagcccaggctgccccctggtccactctcgtccccaccctccctcgagtctacgctacgg

SEQ ID NO: 73095 - DNA, 671 bp, Homo sapiens
  misc_feature: GYAE6OF01C3IPB.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtcgtccccgaggagggacagtcactctcacctgtcggctcagcactggagctgtcaccaagtggtctattactccctacgttcggttaccaacacgaacgccgtcggaccaacgccccgaggaccacctgtatttatagaactaaacaaacaaacaaacacctccgtaccgaccctcgtacccgtctacgacggtcctaccgttcggtacgggacaaacgtcgtcgtaccgtcgtacccgttcgggtcgccgcgacggtccgtacggaggtacgtcggacggtcgtaggtacgtacgttacgtcgttctcggtcttcgttcgtaagttggttggttcggtttcgggtcgggttccgggacggggtacggtaccggacggtaccgtccggtaccgtccggtacgtaccggtaccgaccgacgtccgcccgtccccgtcgtccgtacctccgtcccgttcccgtccccttcgacgtacgtcctcgcgtaccggg

SEQ ID NO: 73096 - DNA, 826 bp, Homo sapiens
  misc_feature: GYAE6OF01COBU4.16.59.F04.1.454.CMB.1.raw
tcagtgtactactccacgaccggtgctcgatttagtacacacacttagggattgggggggcaccaggggtcccttccaatatcagcaccatggcctggactcctctctttctgttcctcctcacttgctgcccagggtccaattcccaggctggtggtgactcaggacgccctcactgactgtcgtcccgagggagggacagtccactctcacctgtggctccagcacgtggagctgcaccaagtggtacattactcctacgtcggttaccaacagaacgccgtcggaccaaccgccccaggacactagatttacagaataacaaacaacaaacactaccgtacggacccctcgtcccggttctcgacggtcctaccgttcggtacggggactaaagccgtaccgtcccgtacgtacccggtttcgggcgtccgacgtaccggtccgtacgggaggtacgtacgggacggtacgtacggtaagtttaacgttaccgttacgggttcctttacggtaccctttacccttaccggtttaagttacggggtttacggggtttcgggtttccgggggtttacggggttaccggggtaaccgggggaaacccggggtaaccgaacgggtccggttaaccgggtaaccccggttacggttaaccggtaccggtaacccgggaacccggtaacgggtcccggttaccccggtacccccggttaccgggttacccttacccggtttcccggttaccccccgggttttcccccgaccccgtttacccgttaaccgggttaacggtttaacccggtaaccgtacgggttaccgggg

SEQ ID NO: 73097 - DNA, 623 bp, Homo sapiens
  misc_feature: GYAE6OF01CWHL5.16.59.F04.1.454.CMB.1.raw
  modified_base (171)..(171): a, c, t, g, unknown or other
  misc_feature (171)..(171): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (229)..(229): a, c, t, g, unknown or other
  misc_feature (229)..(229): n is a, c, g, or t
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (313)..(313): a, c, t, g, unknown or other
  misc_feature (313)..(313): n is a, c, g, or t
  modified_base (465)..(465): a, c, t, g, unknown or other
  misc_feature (465)..(465): n is a, c, g, or t
  modified_base (561)..(561): a, c, t, g, unknown or other
  misc_feature (561)..(561): n is a, c, g, or t
  modified_base (616)..(616): a, c, t, g, unknown or other
  misc_feature (616)..(616): n is a, c, g, or t
tcagtgtactactccacgaccggtgctcgatttagtacacacacttagggatgggggcaccagggtcccttcaatatcagcaccatggcctggactcctctcttttctgttcctcctcacttgctcgcccgagggtccaattcccaggctgtggtagactcaggacgcccncactgactgtccgcccgaggaggacntcactcncaccgtgtgcctcacgcacgtgacncgtanacaacagtgtactattccgtaccttactgtaccaanagacgtccgcgaccaaccgcccgagactacgtagtatttacanaactaaaccaaactaaaacaactaccgtaccgtccggaccctcgtacccgttgtaccgcgtaccgtccggtacggtacggacaacgtcctacgtcctcggtccgttggcgtcgacgtacgcgtagcgtagagacgtagagtacgttatcgtnttactcgtcttacgtatcggttacggttcggtagggttgggtcggtcgggacggacgacgtacgcgtaccgtacgagttacgcgacgcgcgtaccnccggtaccctcgtaccacttccctacccgtaccccgctacctaggtactccgtancgtcggg

SEQ ID NO: 73098 - DNA, 752 bp, Homo sapiens
  misc_feature: GYAE6OF01EYR9B.16.59.F04.1.454.CMB.1.raw
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (267)..(267): a, c, t, g, unknown or other
  misc_feature (267)..(267): n is a, c, g, or t
  modified_base (278)..(278): a, c, t, g, unknown or other
  misc_feature (278)..(278): n is a, c, g, or t
  modified_base (313)..(313): a, c, t, g, unknown or other
  misc_feature (313)..(313): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccagggctgtggtgactcgaggacgccctcactggactgtccgtccccgagggagggacagtcactctctacctggtcggcctccagcctacgtggacnctnccaactatgtctattctcctnttcgtaccaanacgacgcctacggaccaaccgcccgagaccacgtntacgttatagaactaaacaaacaaccaactccgtaccgtaccggacccttccggtacccgttcaccgtaccgccgttaccggtcgggacggggactaacgtccgtccgacccgttccgttccggttccggtgacccgtcgacggtaccgagggtacggacgtacggacggtacgtaggttaacgttacgtttacgtcgttacggtcgtacctttacgttaccgttaggttacgggtttcggttcgggtttcgggttacgggttcgggacggggtaacggaccgacggttaccgtaccggtaccgttaccggtacggtaccggaccgaccgggtaccgtccggtaccccgtcccggtaccggttccctacggtttccccgtacccgtttcccccggtcccctacgggttacccctaggttacccctaggaccggttcggg

SEQ ID NO: 73099 - DNA, 778 bp, Homo sapiens
  misc_feature: GYAE6OF01DAFRP.16.59.F04.1.454.CMB.1.raw
  modified_base (167)..(167): a, c, t, g, unknown or other
  misc_feature (167)..(167): n is a, c, g, or t
  modified_base (328)..(328): a, c, t, g, unknown or other
  misc_feature (328)..(328): n is a, c, g, or t
  modified_base (495)..(495): a, c, t, g, unknown or other
  misc_feature (495)..(495): n is a, c, g, or t
  modified_base (541)..(541): a, c, t, g, unknown or other
  misc_feature (541)..(541): n is a, c, g, or t
tcagtgtactactccacgaccggtgctcgatttagtacacacacttagggattgggggcaccaggggtcccttccaatatcagcaccatggcctggactcctctcttttctgttcctcctcacttgctgcccagggtccaattcccaggctgtggtgactcaggacnccctcactgactgtcgtccccgagggacggacagtcactctcacctgtcggcctaccacgcacgtggacgtctcgtaccaaccaagttggtactacttactcctacgtacgttaccaacagacgcgtacgaccaaccgcccgaggaccacgtagtatttanagtaactaaacaaaacaaacaacctaccgtaccgtaccggtaccccgtccggtccccgttactcgtaccggtccttcccggtcgggtacgggaacctaacgtcgtacccgtcccgttacggtttcccggttcgggtcgccgtacgacggtaccgtacggaggtaggnggtaacggtcgtagttaacggtttactttacggtctcggtttaccnccgttttaccgtacgtttaaggttcgggtttacgggtttcggggtttcgggtacggttaccgggggacggaacgggttaccacggttaccgtccggtaccgttacggtacggtccgaaccgtacccggtagtccccgtcccgtcccggtaccgtcccgttacccggttccccgtacccgggttcccccacccggtttcgtaccggttaacggttaccggtacgttaccgggtcgggg

SEQ ID NO: 73100 - DNA, 764 bp, Homo sapiens
  misc_feature: GYAE6OF01CJ4MJ.16.59.F04.1.454.CMB.1.raw
  modified_base (164)..(164): a, c, t, g, unknown or other
  misc_feature (164)..(164): n is a, c, g, or t
  modified_base (275)..(275): a, c, t, g, unknown or other
  misc_feature (275)..(275): n is a, c, g, or t
  modified_base (502)..(502): a, c, t, g, unknown or other
  misc_feature (502)..(502): n is a, c, g, or t
  modified_base (744)..(744): a, c, t, g, unknown or other
  misc_feature (744)..(744): n is a, c, g, or t
tcagtgtactactccacgaccggtgctcgatttagtacacacacttagggagttgggggcaccaggggtcccttccaatatcagcaccatggcctggactcctctctttctgttcctcctctacttgctcgcccaggtaccaacttcccgaggtctggtaggtnacgtcgacggaccgccctacgacgtacgacgttcggtaccgtcccgaaggggacggtacagtcctacctcctaccgtaccgttggccgtcctaccgacgtaccgacgtggngtacctagtaccgaaaccgtagtccgtattaacttccttaccgtacgttaccgtacaaacgtaacgacgaccgtacggaccgacccaccgaaggactacgtagttattagaacgtaaactaaacaaacaaacctaacgtccgtaccgtaccgcccgtacgtccgtacctacggccgtccgtcggtcggacgaacgacgtcgaccgtaccttccggtacgttggaccncgtacgcgtaccggagtacgacgtcgaagtcgtagttacgtacttcgtcgtaacgttcttaacgtcgtttccggtagttaccgggttcggtttcgggttccgggttacgggtaccggacggggaacgttaccgacggttacccgtgtacccgtagaccggtaccgacgaccgtacggcccgtacccgtcggtacccgtacgttcccgtaccgttcccgtacccctcggtacctaaccggtanaaccgggtcaccggtacggg

SEQ ID NO: 73101 - DNA, 872 bp, Homo sapiens
  misc_feature: GYAE6OF01CU4A0.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgccagggtccaattcccaggctgtggtgactcaggacgccctcactgacttggtcgtacccgagggagggacagtcactctcaccgtggtcggcctccagcacgtggacgcttagtaccaactaagttcggtactacttaactccgttacgtacggttaccaacgaacgacgccgtacggaccaaccgaccccgacggacacgtacgtactttagtacgtaactaaacaaaaccaaacaaaccaccgttaccgtaccggtacccgttccggtacccggttacctacgacggtcccttccggttacgggttacgggtaccgtaaacgtccgtaccgtcccgttaccgttacccggtttacggggtccgtaccggaccgtaccggtaccggtaggacggtacgtcggtacggtcgttacggttaacgttaacgtttacggtcgttcgttaccgttccttacttaccgttagttacgggttgggtttacgggtttcgggtttacgggtaccgggggtacgggtaaccgggtaaccggacggttaccggtaccgggttacccggttaccggttaaccgggtcgtaacccggtaacccgggtaccccgggtacccggttccccggttacccccggttaccggttacccggttaccccggtttcccggtttccccggttaaccccccgtcccggtttaccccggttaccggttaacggtttaacccggtaacggtccggtaacccggggg

SEQ ID NO: 73102 - DNA, 709 bp, Homo sapiens
  misc_feature: GYAE6OF02F82OX.16.59.F04.1.454.CMB.1.raw
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtcgtcccaggagggacagtcactctcacctgtggctccagcactggagctgtcaccaatggtcattactccctactcggttccaacagaagcctggaccaacgcccccaggacactgatttatgatacaaaacaacaaacactcctcgacccctgcccggttctcaggcctcccgtcggttcggggacaaagctcgcccgtcgtacccgttttcgggtcgccgcacgcccgtggaaggtagtgggaacgggtcctagggaagttaactttacgtggtcttcggtccttccgttacccttaagttagggttgggtttcgggtttccgggggttggtttccggggcgggtaaggggaacccaacggtccgttacggtacccggttaccgtacgggtccgaaccggacccgtaacgggtcccgtaccggtcccccccgttcgggttaccctacccgttccgtttcccggtttacccccctaccccgttcccgttacccggtaacggttaaccggttacctaccggttaccgggg

SEQ ID NO: 73103 - DNA, 529 bp, Homo sapiens
  misc_feature: GYAE6OF02GA4F3.16.59.F04.1.454.CMB.1.raw
  modified_base (381)..(381): a, c, t, g, unknown or other
  misc_feature (381)..(381): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagccccccaggacactgatttatgatacaaacaacaaacactcctggacccctgcccggttctcaggctccctcgttggggcaaagctgccctgaccctttcgggngtcgcagcctgaggatgaggctgagtattactgcttgctctcctatagtgtgttcgggtgttcggcgagggaccagctgaccgtctagtcagcccagctcgcccctgtccactctcgttcccgccctcctccgngtacgtacnctcgg

SEQ ID NO: 73104 - DNA, 548 bp, Homo sapiens
  misc_feature: GYAE6OF02HWN4V.16.59.F04.1.454.CMB.1.raw
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaaacaacaaacactcctggacccctgcccggttctcaggctcctcgttgggcaaagctgccctgaccctttcgggtgcgcagcctgaggatgaggctgagtattactgcttgctctcctatagtggtgttcgggtgttcggcggagggaccaagcgtgaccgtccgtaggtcacgcccgaaggctcgcccccgtggtccacgttcctcgttccccgcccttcccgtcgtacgtacgtacactcgg

SEQ ID NO: 73105 - DNA, 545 bp, Homo sapiens
  misc_feature: GYAE6OF02F578N.16.59.F04.1.454.CMB.1.raw
  modified_base (489)..(489): a, c, t, g, unknown or other
  misc_feature (489)..(489): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactacctcggacccctgcccgttctcaggctcctcgttcggggcaaagctgcctcgacccgtttcgggtcgcgcagcctgaggatgaggctgagtatactgcttgctctctatgtgtgttcgggtgttcggcggagggaccaagtcgtcgtaccgtccgtagtcagcccaaggcncgcccccgtggtccactcctcgttccccgcccgtcctccgagtacgtacacgtcgg

SEQ ID NO: 73106 - DNA, 584 bp, Homo sapiens
  misc_feature: GYAE6OF02IZCZV.16.59.F04.1.454.CMB.1.raw
  modified_base (341)..(341): a, c, t, g, unknown or other
  misc_feature (341)..(341): n is a, c, g, or t
  modified_base (462)..(462): a, c, t, g, unknown or other
  misc_feature (462)..(462): n is a, c, g, or t
  modified_base (465)..(465): a, c, t, g, unknown or other
  misc_feature (465)..(465): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgactttatgatacaaacaacaaacactcctaggacccctgacccggttcncgagctacccgtcgttcggggccaaaggctacgcccgtgacccgtttcgggtcgcgcgacgccgtggagagtcgaggctgagtattactgcttgctctctatgtgtgttcgggtgttcggnggnggaccaggcgtcgaccgttcgtaggtcgacgcccgaaggcctcggcccccgtcggtcctaccgtccgttaccgttccctaaccccgtccgttaccgacgtacggttacaccgttacggg

SEQ ID NO: 73107 - DNA, 524 bp, Homo sapiens
  misc_feature: GYAE6OF02I2ZKL.16.59.F04.1.454.CMB.1.raw
  modified_base (327)..(327): a, c, t, g, unknown or other
  misc_feature (327)..(327): n is a, c, g, or t
  modified_base (480)..(480): a, c, t, g, unknown or other
  misc_feature (480)..(480): n is a, c, g, or t
  modified_base (490)..(490): a, c, t, g, unknown or other
  misc_feature (490)..(490): n is a, c, g, or t
tcagtgtactactccacgaccggtgctcgattttagtacacacacttagggattgggggggcaccaggggtcccttccaatatcgagcaccatggccttggactcctctctttctgttccgtcctcacttgctgcccagggtccaattcccaggctgtggtgactcaggagccctcactgactgtgtccccaggagggacagtcactctacaccgtgtggctccagcactggagctgtcaccaatggtcattatccctatgttccaacagaagcctggccaagcccccaggacacgtgatttatggatacaaacaacaaacactccngacccctgcccgttctcagctcctcgtcgggcaagctgccctgaccctttcggtcgcgcagcctgacgatgaaggctgacgtattactgtcttgctctctatagtggtgttcggtgtcggcggagacagcgtgccgtctaggtcagccaggcngccccgtgcnctctcgtcccacctctccgagtacgtcacgtcgg

SEQ ID NO: 73108 - DNA, 570 bp, Homo sapiens
  misc_feature: GYAE6OF02GYXP3.16.59.F04.1.454.CMB.1.raw
  modified_base (297)..(297): a, c, t, g, unknown or other
  misc_feature (297)..(297): n is a, c, g, or t
  modified_base (387)..(387): a, c, t, g, unknown or other
  misc_feature (387)..(387): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctgacccctgcccggttctcagctcctcgtgggcaaagctgcctgaccctttcggtgcgcagcctgaggntgaggctggagtatactgcttgctctcctatagttgtgttcggtgttcggcggaggaccgaagcgtgaccgttctacggtcacgcccgtaaggcctacggccccccgtcgggtccctaccgttccgttaccggttcccccgtacccttcccgtaccggtacggtacgttaccacgttaccggg

SEQ ID NO: 73109 - DNA, 570 bp, Homo sapiens
  misc_feature: GYAE6OF02HYBPP.16.59.F04.1.454.CMB.1.raw
  modified_base (247)..(247): a, c, t, g, unknown or other
  misc_feature (247)..(247): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattanccctatggttccaacagaagcctggccaagcccccaggacactgatttatgatacaaacaacaaacactcctggacccctgcccgttctcagctcctcgttcgggcaagctgccctgtaccctttcgggtcgcgcacgcctggaggatggaggctgagtattactgcttgctctccttagtagtggttgttcgggtgttcgggcgggagggaccaagcgtggtacccgttccgtaggtcgacgcccgaaggcctacggtcccccgtcggtcctaccttcgtccgttccccgtcccgtccgtccgtacgtacgtacacgtacgg

SEQ ID NO: 73110 - DNA, 570 bp, Homo sapiens
  misc_feature: GYAE6OF02F293K.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctcctcgtggggcaaagctcgccctgtaccctttcgggtcgcgcagcctgaggatgaggctgagtattactgcttgctctccttatagttggtgttcgggtgttcgggcggtagggaccgaaggcgtggacccgttcctagggtccacgtcccgaaggcctacgcccccgtgggtcctacgtccttcgttccccacccttcccgtcgtacgtacgttaccacgtacgg

SEQ ID NO: 73111 - DNA, 559 bp, Homo sapiens
  misc_feature: GYAE6OF02IJ9K8.16.59.F04.1.454.CMB.1.raw
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (461)..(461): a, c, t, g, unknown or other
  misc_feature (461)..(461): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctatggttccaacagaagcctggccaacgcccccaggacactgatttangatacaaacaacaacactccncgaccctgccgtctcacgctccgtcggtcgggacaaagcgtcgccctcgtacccgtttcgggtcgccgcacgtccctggaggatggaggtctggtagtattcgtgcttgctcttactagttgtggttgttcgggtgtcgggnggacggactagcgtgaccgtctaggtcacgccgaaggctcgccccgtggtccacgtccgtccgttcccgccctcgtcgtacgtacgtaccgacgtcgg

SEQ ID NO: 73112 - DNA, 540 bp, Homo sapiens
  misc_feature: GYAE6OF02GSM5I.16.59.F04.1.454.CMB.1.raw
  modified_base (297)..(297): a, c, t, g, unknown or other
  misc_feature (297)..(297): n is a, c, g, or t
  modified_base (535)..(535): a, c, t, g, unknown or other
  misc_feature (535)..(535): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctggacccctgccccggttctcaggctcccgtcgttggggcaaagctgccctgaccctttcgggcgcgcagccgtgaggatgaggctggagtattactgcttgctctctatagtggtgttcgggtgtcggcggaggacagctgaccgtcgtaggtcagccaggctcgcccccgtggtccactcgtcgttccccgccctccgtccgtacgtacgtaccngtcgg

SEQ ID NO: 73113 - DNA, 537 bp, Homo sapiens
  misc_feature: GYAE6OF02HZ1JS.16.59.F04.1.454.CMB.1.raw
  modified_base (191)..(191): a, c, t, g, unknown or other
  misc_feature (191)..(191): n is a, c, g, or t
  modified_base (268)..(268): a, c, t, g, unknown or other
  misc_feature (268)..(268): n is a, c, g, or t
  modified_base (386)..(386): a, c, t, g, unknown or other
  misc_feature (386)..(386): n is a, c, g, or t
tcagtgtactactccacgaccggtgctcgatttagtacacacacttagggattgggggcgaccaggggtcccttccaatatcagcaccatggcctggactcctctctttctgttcctcctcacttgctgcccagggtccaattcccaggctgtggtgactcaggagccctcactgactgtcgtccccaggngggacagtcacgtctcacctgtggcctccagcacgtggagctgtcaccaatggtcattatccctactggttccaacngaaagcctggccaagccccccaggacactgattatgtatacaaacaacaaacactacctgacccctgcccggttctcaggctcccgtgttgggcaagctgccctgaccctttcgggtncgtcacgcctgaggatgaggctgagtattactgtcttgctctctattgtgtgttcggtgtcggcggaggacagctggaccgtcgtagtcacgtccaggtctcgcccctaggtccactcgtcgttcccgcctccgtcgagtactactatcgg

SEQ ID NO: 73114 - DNA, 452 bp, Homo sapiens
  misc_feature: GYAE6OF02HMXWY.16.59.F04.1.454.CMB.1.raw
  modified_base (338)..(338): a, c, t, g, unknown or other
  misc_feature (338)..(338): n is a, c, g, or t
  modified_base (415)..(415): a, c, t, g, unknown or other
  misc_feature (415)..(415): n is a, c, g, or t
  modified_base (432)..(452): a, c, t, g, unknown or other
  misc_feature (432)..(452): n is a, c, g, or t
tcagtgtactactccacgaccggtgctcgatttagtacacacacttagggatgggggaggattgatcccagtgactctcacatcaactacagccccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtcgtggggccaaagggaccacggtcaccgtctcctcaccctccaccgaaggcccatccggtccttccccctggccaccctcctccaaganccactcgtggggcacgacgcggcccgtggctcgcctggtcaaaggactacgttccgagtacgtacacgtgagcgggntggcgaaggcacagtgnnnnnnnnnnnnnnnnnnnnn

SEQ ID NO: 73115 - DNA, 595 bp, Homo sapiens
  misc_feature: GYAE6OF02HFOFP.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggtttcaacagaagcctggccaacgcccccaggaccactgatttatgataacaaacaacaaacactacctcgaccctcgcccgttctcagcctccgtcggtgggacaagctcgccctcgtacccgtttcgggtgccgcacgccgtggacggtagtggagggtctggaagtattactgtcttgctctccttatagtggttgttgggtcgtcgggcggacgggacctagctacggtaccgtccgtaggtccacggaccgtaacggcctccggtcccccgtcggtccaccgttccgtccgttccccgcccttacccgtcgtacggtacgtacgtaccgtacgg

SEQ ID NO: 73116 - DNA, 607 bp, Homo sapiens
  misc_feature: GYAE6OF02JFQ1F.16.59.F04.1.454.CMB.1.raw
  modified_base (227)..(227): a, c, t, g, unknown or other
  misc_feature (227)..(227): n is a, c, g, or t
  modified_base (340)..(340): a, c, t, g, unknown or other
  misc_feature (340)..(340): n is a, c, g, or t
  modified_base (406)..(406): a, c, t, g, unknown or other
  misc_feature (406)..(406): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactgganctgtcaccaatggtccattactcctactggttccaacagaagcctggccaacgcccccaggacactgatttatgatacaaacaacaaacactccgtcgaccctcgcccgttcncagctcctcggtgggcaacgtcacgcctcgaccctttcggcgtcgcacgccgtcggaggtatcggnggcgtgaacgtattacgtgcgttcgcctctcctagtaggttcggttggttcgggttgttcgggcggacgggaccaacggtctcggtacccgtccgttacggtcagcccgaacggtccgtaccgccccgttcggtacctaccgttaccgtcggttccccgcccctttccgtaccggtacttaccgtacgtaccgttacgggg

SEQ ID NO: 73117 - DNA, 693 bp, Homo sapiens
  misc_feature: GYAE6OF02HDOJC.16.59.F04.1.454.CMB.1.raw
  modified_base (250)..(250): a, c, t, g, unknown or other
  misc_feature (250)..(250): n is a, c, g, or t
  modified_base (338)..(338): a, c, t, g, unknown or other
  misc_feature (338)..(338): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagtctgtcaccaatggtctattacncccttacgtcggttaccaaacagtaacgccgtggaccaacgccccccgaggaccacgtcgatttatgatacaaacaacaaacactccncggaccctgcccgttctcgagctcctcggtcgggacaagctcgcctacgtaccgttcgggtcgtcgtcgacgccgtaggacggtattacgggacggtacctagggtaacggttacttaaaccgttcggtccttggtcccttaccgttaccttaagttagggttcgggtttggttcggggttggttccgggacggggtaacgggaaccgtaacggccgttacggtacccgttccggaacggttacccgaaggtcccgaacgggtacctccgggtcccccgttaagggtccctaccgttccgttcccgttccccgacccgttcccgtaccggtaacggttaccgtaccacggttcgg

SEQ ID NO: 73118 - DNA, 724 bp, Homo sapiens
  misc_feature: GYAE6OF02ITW2P.16.59.F04.1.454.CMB.1.raw
  modified_base (300)..(300): a, c, t, g, unknown or other
  misc_feature (300)..(300): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcactgtgctccagcactgagctgtcacatggtcattactcctactggttccaacagaagctaggaccaacgcccccaaggacactcgaatttacgngaatacaaaacaacaaaacactacctacgggacccctacgtacccggttctaccgtacggtacctccccgttacggttacgggggacctaaaacgccgtacgtacccgtacggtaaccccgtttcgggttacggaccgaccgtaaccggccctagggtacggaacgttcggaaggtccgtaggtaacgttacgtttacgttacgtcgttacggccttacttaccgtagttacggttggtcggtttacgggtgttccggggtagggtaaccgggtaactaacgggcttaacggaccggtttacccgttaagggtaccaacggtacccgaaacggtccgtccgtacccccgttggtaacctccgttaccgtccgtttaccccgtaccctaccgtacggtaaccgttacggttaactacgtaccggg

SEQ ID NO: 73119 - DNA, 654 bp, Homo sapiens
  misc_feature: GYAE6OF02HIDBZ.16.59.F04.1.454.CMB.1.raw
  modified_base (301)..(301): a, c, t, g, unknown or other
  misc_feature (301)..(301): n is a, c, g, or t
  modified_base (338)..(338): a, c, t, g, unknown or other
  misc_feature (338)..(338): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcacaatggtcattactccctactcggttaccaacagaagcctggccaacgcccccaggacactgatttangatacaaacaacaacactcctggaccctgcccgttcncacgctcctcggtcgggacaagcgtcgccgtcgtacccgttcgggtcgccgcacgcccgtggacggagtggacggtctagggtaagttacgtttaacgtgtacgttggtccttccgttaccttaagtttacggtgggtttcggttcggggttcggtttccggggacgggtacgggaaccgtaggtccgtggtacccgtacgtcgggtacccgagacccgtagggccttcgggccccccgttggtcccgtaacttcccgttccgttcccccgtaccccgttccgtaccggtaacggtaccgtacctacgtaccgggg

SEQ ID NO: 73120 - DNA, 641 bp, Homo sapiens
  misc_feature: GYAE6OF02ICH1X.16.59.F04.1.454.CMB.1.raw
  modified_base (302)..(302): a, c, t, g, unknown or other
  misc_feature (302)..(302): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctcagcactggagctgtcaccaatggtcattactccctactggttccaaacagaacgcctggccaacgcccccaggaccactgatttangataacaaaacaacaaacactcctacggacccctgcccgttactcgacgtcctcccgtcggttcgggacaagctcgccctgtacccgtttcgggtcgccgcgacgcctagacggatggacgtcgtagaagtttacgttacgtgtcgttgccttctaccttaagtggttcgggttggttcggggttgttccgggacgggacgggtaacctacggtcgttcggacccgtttcgtacggtcaaccggtaccgaagtcccgtaccgtccccgttcggtcctaccttccgttacccgttccccgtcccttaccgtaccggtagttaccggtaccaggttacggg

SEQ ID NO: 73121 - DNA, 543 bp, Homo sapiens
  misc_feature: GYAE6OF02H60VR.16.59.F04.1.454.CMB.1.raw
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
  modified_base (499)..(499): a, c, t, g, unknown or other
  misc_feature (499)..(499): n is a, c, g, or t
  modified_base (506)..(507): a, c, t, g, unknown or other
  misc_feature (506)..(507): n is a, c, g, or t
  modified_base (509)..(512): a, c, t, g, unknown or other
  misc_feature (509)..(512): n is a, c, g, or t
  modified_base (514)..(543): a, c, t, g, unknown or other
  misc_feature (514)..(543): n is a, c, g, or t
tcagtgtactactccacgaccggtgctcgatttagtacacacacttagggatggggaggattgatcccagtgactctcacatcaactacagccccgtccttccaaggccacgtcaccatctcagctgacaagtccatcagtactgccttcctgcaggtggcgcagcctggagcctcggacaccgcatatattacngtgcgagttccggttancgccgcagatcactactactacgtacggtntggacgtcgtggggccaagggaccacggtcaccgtctcctcaccctccaccaacgggcccactccggtcctttcccccgtggacctacccctcctccaacgacgccaacctcggtcgggggcacgacggccggccccgtggggcctcggcccgttcgggtaccgaaacgggtccctttaccgtttacccggaacggttacgttaccaccgttggacggtccggggtcgtcgggacgaaacgggcgacgtaacgtagncgatcgnngnnnngnnnnnnnnnnnnnnnnnnnnnnnnnnnnnn

SEQ ID NO: 73122 - DNA, 541 bp, Homo sapiens
  misc_feature: GYAE6OF02JIUFU.16.59.F04.1.454.CMB.1.raw
  modified_base (486)..(486): a, c, t, g, unknown or other
  misc_feature (486)..(486): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgattatgatacaaacaacaaacactcctacgacccctgacccggttctcaggcctcctcgttgggcaaagctcgcctcgacctttcgggtacgcgcacgctgacgatgagctgagtattactgcttgctctctatagtgtgttcggtgttcggcggaggaccgagtcgtgaccgtctacggtcacgccgaaggcncgccccgtcgtcacgtcctcgttcccacccttcctcgacgtacgtacctatacgg

SEQ ID NO: 73123 - DNA, 584 bp, Homo sapiens
  misc_feature: GYAE6OF02IK8PA.16.59.F04.1.454.CMB.1.raw
  modified_base (383)..(383): a, c, t, g, unknown or other
  misc_feature (383)..(383): n is a, c, g, or t
tcagtgtactactccacgaccggtgctcgatttagtacacacacttagggattgggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctcggcaagcccccaggacactgatttatgatacaaacaacaaacactcctgacccctgcccgttctcacgctcctcggttcgggcaaacgctacgccctgaccctttcgggngcgcacgcctgacgatgaggctagagtattacgtgtcttgctctcttatagtgtgttcggtgtcggcgagggaccagctcggaccgttccgtacggtcgacgccgaacgccgtaccggcccccgttggtaccctaccttccgttccgttcccccgtccccgttcccgttaccggtacgttaacgtacccgtacgtaccggg

SEQ ID NO: 73124 - DNA, 633 bp, Homo sapiens
  misc_feature: GYAE6OF02GQYPJ.16.59.F04.1.454.CMB.1.raw
  modified_base (302)..(302): a, c, t, g, unknown or other
  misc_feature (302)..(302): n is a, c, g, or t
  modified_base (400)..(400): a, c, t, g, unknown or other
  misc_feature (400)..(400): n is a, c, g, or t
tcagtgtactactccacgaccggtgctcgatttagtacacacacttagggattgggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaaccaatggtcattactccctactcggttaccaacagaagcctggccaacgccccaggacactgattangataacaaacaacaaacactcctacgaccctcgcccggttctcgacgcctccgtcggttcgggacaaagctcgccctgtacccgtttcgggtcgcgcncgcctggacggtatgaggcgtaggtagttattacgtgtcgttgccttcctcttagtaggttggttggttcgggttggttccggggacgggtacgggaccgaaggtcgtacggtaccgttccgtacgggtccaacgggacccgaacggtccgtccgtcccccggttcggtaccctaccgttccttccggttacccctcccgttccgtaccgtacgttacgtaccgtacgtacgg

SEQ ID NO: 73125 - DNA, 547 bp, Homo sapiens
  misc_feature: GYAE6OF02HQPOR.16.59.F04.1.454.CMB.1.raw
  modified_base (297)..(297): a, c, t, g, unknown or other
  misc_feature (297)..(297): n is a, c, g, or t
  modified_base (389)..(389): a, c, t, g, unknown or other
  misc_feature (389)..(389): n is a, c, g, or t
  modified_base (541)..(541): a, c, t, g, unknown or other
  misc_feature (541)..(541): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttangatacaaacaacaaacactcctacggacccctgccccggttctccaggcctccctcggttcggggcaaagctcgccctgacccgtttcgggngccgcacgcctggaggatgacggctgagtattactgcttgctctcctatgtgttgttcgggtgttcggcggaggaccagctgaccgtcgtaggtcacgccgagctcgcccctggccactctcgttccccaccctcctacgacgtacgtaccngtacgg

SEQ ID NO: 73126 - DNA, 771 bp, Homo sapiens
  misc_feature: GYAE6OF02I7RQX.16.59.F04.1.454.CMB.1.raw
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
tcagtgtactactccacgaccggtgctcgatttagtacacacacttagggattgggggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactcctacgtcggttaccaacagaanccgtggccaacgcccccaggacacngtacttatgataacaaacaacaacactcctcggtaccctcggtacccggttctacgacggtcctcccgtcgggttacggggacaaacggtctcgtacccgtagtaccccgtttgggtcgccgtcgacgtcccgtggaggtacgtaggtagccgtaggtagttacttacgtcgtcttcggtccttaccgttccttaaggttacggttcggttcgggtttccggggttacgggttaccggggaccgggtaaacggggacccgtaaccggttcggtacccgggttaaccccggttaccggttaacgggtacccgtaaccggtaccccgggtaaacgggttcccgttacccgggtaccccccggttaacggggttccctaacccggttttacccggttccccggtttccccccggtcccccgggtttacccttacccgggtacgggtttaacccgtacccggtacccggttaccggggg

SEQ ID NO: 73127 - DNA, 663 bp, Homo sapiens
  misc_feature: GYAE6OF02GBJ5B.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactaccgtcggacccctcgcccggttctcacggcctcccgtcggttcggggacaaacggctacgccctcggtaccccgttttcgggacgcgcacggcctgggacggatggaggctaggagttagttaccgtgtcgttgctctccttagtaggttcgggttggtttcggggttacgtttcggggcgggtaacggggtaccgaacggtccgtacggtacccggttaccgtacggtacccgtacggacccgtaacgggccgttaccggccccccgttcgggtaccctaccgttcccgttccgtttcccccaccccgttcccgtaccggtacgtacgttaccgacgtaccggg

SEQ ID NO: 73128 - DNA, 651 bp, Homo sapiens
  misc_feature: GYAE6OF02JB8L9.16.59.F04.1.454.CMB.1.raw
  modified_base (172)..(172): a, c, t, g, unknown or other
  misc_feature (172)..(172): n is a, c, g, or t
  modified_base (375)..(375): a, c, t, g, unknown or other
  misc_feature (375)..(375): n is a, c, g, or t
tcagtgtactactccacgaccggtgctcgatttagtacacacacttagggattgggggggcaccaggggtcccttccaatatcagcaccatggcctggactcctctctttctgttcctcctcacttgctgcccagggtccaattcccaggctgtggtgactcaggagccctnactgactgtgtcccaggagggacagtcactctcacctgtggctccagtcactgagtctgtcaccaatggtcattactccctagtcggttaccaacaggaacgcctacggccaaacgcccccgtaaggactaacctcgtaatttacgtgaacttaacaaaactaaacaaaccacctccgtacgggaacccctcggtcccggttntccgaacggtccttcccgtcggttcgggacaaacgtctcgaccctcggtaccgttcgggcgcgtcgacgccgtgcggatggagtctgtacgtagttctacgtcttcgtctacttacgttactagggttggttcggtgggttcggtttacgggcgggtacggtaccgtaagtccttacgggtccgtacgtacggtccgacgtaccgaaggtccgtacgtccccgtgtaccgtactccgtccgtacccgtacctccgtcggacgtacgtaccagtcgg

SEQ ID NO: 73129 - DNA, 752 bp, Homo sapiens
  misc_feature: GYAE6OF02JEFNK.16.59.F04.1.454.CMB.1.raw
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcacgtggagctgtccaccaatggtcattactcctacgtggttaccaacacgaagcctcggccaacgccccctaggacactgatttagtagactaacaaacaaacaaaccgtacctccgtacgaaccccctggtaccccggtttctaccgacgggtcctcccgttccggttcggggaactaaggctcgcccttcgtacccgttttggggcgcggtccacgccgttaggaacgtacgtggacggtctggtaaggttaactaccgttgtccttagccttaccttaccgtagtttacggttagggttcggtttacgggttcggtaccggggtcggtaacggggacccttaaggccgttccggtacccggttaccgttaacggggtaccctaaccggacccggtaagggcccgtttaacccggtccccccggttaacgggttacccctaaccgtttcccggttccccgtttcccccggtaccccccgtttacggttaccccggaagggtttacccgttacccgtacggttaaccgggg

SEQ ID NO: 73130 - DNA, 835 bp, Homo sapiens
  misc_feature: GYAE6OF02JVI43.16.59.F04.1.454.CMB.1.raw
  modified_base (229)..(229): a, c, t, g, unknown or other
  misc_feature (229)..(229): n is a, c, g, or t
  modified_base (380)..(380): a, c, t, g, unknown or other
  misc_feature (380)..(380): n is a, c, g, or t
tcagtgtactactccacgaccggtgctcgatttagtacacacacttagggattggggggcgaccgagggtcccttccgaatatcagcaccatggcctggactcctctctttctgttcctcctcacttgctgcccagggtccaattcccaggctgtggtgactcaggagccctcactgactgtgtccccaggagggacagtcactctcacctgtgctccagcactggacnctgtcaccaatggtcattactcctactcggttcaactagaagccgtaggacctaacgcccccgtaagggaccaacctggtaactttactacgataaccaaaactaaaccaaaacgtcctaccgtcggtacccccgtcgtaccccggttacnccgtaacggtccctcccggttacggggttacggggaccgtaaaacggccttacccggtaccccgtttacggtaaccccggttttcggggtacgcccggtaccgaccggttccccgtaggggtaacgttaacgtcgggaacgtccggttaggtaaacgggttactttaacggtcgttaccggttccggttacttacccggttaccgttacggttaacgggtttgggttcccgggttttcgggggtaccggtttaccggggtaccggggttaacgggtaacccgtacggtaccggtacgggttaccccggttaacggttccggtacgtaaaccggtcccgtaaccgggtccgtacccgggtcccccgttaccgggtacccttaaccgttccggtttccccgtaccccggtcccttaaccggtccggtaacgttaccgttaccggtaacgttcccggg

SEQ ID NO: 73131 - DNA, 647 bp, Homo sapiens
  misc_feature: GYAE6OF02HDLB3.16.59.F04.1.454.CMB.1.raw
  modified_base (307)..(307): a, c, t, g, unknown or other
  misc_feature (307)..(307): n is a, c, g, or t
  modified_base (399)..(399): a, c, t, g, unknown or other
  misc_feature (399)..(399): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactcccttagtcggttaccaacacgaagcctggaccaacgcccccaaggacactgactttangatacaaacaacaaacactctacgaccctagcccgttctacgaggtcctccgtcgtcgggactaaacgctcgcccgtgtacccgttcgggtncgtcagtcctgacgactggaacgtctacggtaatacgttactcgtcttcggtctctaccgttagtaggttgttcggttcggttggttccgggacgggttaagggaccctaaggtccgttaggtacccgttacgtacggggtactaaccggtcccgaaggtcctccgggtaccccgttcggtacctaccttccggttacggtccccgtcccgttcctacggtaaccggttacgtacgtacggtaccggg

SEQ ID NO: 73132 - DNA, 707 bp, Homo sapiens
  misc_feature: GYAE6OF02IFG19.16.59.F04.1.454.CMB.1.raw
  modified_base (306)..(306): a, c, t, g, unknown or other
  misc_feature (306)..(306): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaaccaagtggtctattactccctactcggtttccaacagaacgctcggccaacgcccccaggacactgatttangaataacaaactaaacaacactccgtcggaccctcgtcccggttctccgacggcctcccgtcgggttacggggaccgaaagtcgtacgtccctacggttacccgtttacggggtcgacgccgacggtcccgtaggacgggtagtcgggaggtcgtaggtaacgttatttaaccgttggtacgttcgctttccgtaccttaagttggttagggtttcggtttcggggttcgggttacgggcggggtacggggaaccgtacggtcgtaccggtaccgttaccggtaggtaccgaccggacccgtaaggcccgtcccggtccccggtcggtccctaaccgttccttcccggttaccccctacccgttccggtaaccgttacggttaacttaccgacgttacggg

SEQ ID NO: 73133 - DNA, 724 bp, Homo sapiens
  misc_feature: GYAE6OF02GI8RF.16.59.F04.1.454.CMB.1.raw
  modified_base (622)..(622): a, c, t, g, unknown or other
  misc_feature (622)..(622): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactggactgtcgtccccaggagggacagtcactctcacctgtcgctccagcactggagctgtcaaccaagtggtacatttactccctactcgttaccaacgagaacgtcctcggaccaaccgccccccgaaggaccacgtcgtatttacgtagaacttaaccaaaacaaaccaaacctacctaccgtaccggaacccccttggtaccccggttctccgtacggtccctccccgttcgggtcgggacaaacggtcctacgtcccgttcgtacccgtttcgggcgccgacgcgtccgtaggacggtagtcggtacggtcttggaacgttagtttacgtcgttcgtcgtccgttcttaccgttacgttaggttcgggtttcggttcgggtttcggttccgggcgggtaacggtaccgtacgtccgttacgtacccggttcgtaccgggttaccnccgtaacccgacgggtcccgtcccggtccccgttccggtacctccgttcccgttcccgttccctacccgttccgtaccgttacgtacgttaccgcgtacggg

SEQ ID NO: 73134 - DNA, 628 bp, Homo sapiens
  misc_feature: GYAE6OF02IG1DA.16.59.F04.1.454.CMB.1.raw
  modified_base (249)..(249): a, c, t, g, unknown or other
  misc_feature (249)..(249): n is a, c, g, or t
  modified_base (321)..(321): a, c, t, g, unknown or other
  misc_feature (321)..(321): n is a, c, g, or t
  modified_base (326)..(326): a, c, t, g, unknown or other
  misc_feature (326)..(326): n is a, c, g, or t
  modified_base (492)..(492): a, c, t, g, unknown or other
  misc_feature (492)..(492): n is a, c, g, or t
tcagtgtactactccacgaccggtgctcgatttagtacacacacttagggattgggggggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattanccctatggttccaacagaagcctgaccaagcccccaggactaactgtactttatgaatacaaacaaacaaanctccnggaccctgacccgttctcacggctccgtacgttcgggacaagctacgccctacggtacccgtttcgggtcgacgcacgtcgtcgaggagtgagggtctagtagtacgtatacggtctagtctactaccgttagttacgtaggttggtttcggggtggttaccgggngggttacgggacctaacggtcgtacggtacccgtacgttaccggcgacggacccgtaaggcccgtaccggtcccccgtcgttccgacgttcctccgttccccgtaccctccgttacgccgttaagtcccaagtcgg

SEQ ID NO: 73135 - DNA, 752 bp, Homo sapiens
  misc_feature: GYAE6OF02FNAS2.16.59.F04.1.454.CMB.1.raw
  modified_base (162)..(162): a, c, t, g, unknown or other
  misc_feature (162)..(162): n is a, c, g, or t
  modified_base (430)..(430): a, c, t, g, unknown or other
  misc_feature (430)..(430): n is a, c, g, or t
  modified_base (474)..(474): a, c, t, g, unknown or other
  misc_feature (474)..(474): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
tcagtgtactactccacgaccggtgctcgatttagtacacacacttagggattggggggcaccaggggtcccttccaatatcagcaccatggcctggactcctctctttctgttcctcctcacttgctgcccagggtccaattcccaggctggtggtgactnaggacgcctcactgactgtcgtcccagggagggacagtcactctcacctgtggctccagccacgtgagcttcgtcctaaccaagtggttaccattactcccttagtcggttacccaacacgaaacgtccgtcgaccaaccgcccccgaaggcaactgtattatagaactaaaccgaaacaaaccaaaccgtaccttaccgccggtaacccctccggtcccggtttactaccgcgtacctacccggttcggttcggggaactaacgtcncgtccgtacgtcccgttacggtcgacgcgacgcgtaggcgtacnggacgttcgtgacgttaacttgngtacgtnttaccgtacgttccgttaattgggttacggtttcggtttccgggggttaacggttccgggacggggtaccgggaaccggtaagttcccgacgggttacccgttaagggtccggtaaaccacggtttcccgaacgggttcccgtaaccccggttccccgttttaaccgccccggtttaattccggtttacccctcccgttaacccttaccgggtttccgacgttttaacgacccggttacggtacccgg

SEQ ID NO: 73136 - DNA, 898 bp, Homo sapiens
  misc_feature: GYAE6OF02GYB3O.16.59.F04.1.454.CMB.1.raw
  modified_base (406)..(406): a, c, t, g, unknown or other
  misc_feature (406)..(406): n is a, c, g, or t
  modified_base (818)..(818): a, c, t, g, unknown or other
  misc_feature (818)..(818): n is a, c, g, or t
tcagtgtactactccacgaccggtgctcgatttagtacacacacttagggattgggggggcaccaggggtcccttccaatatcagcacatggcctggactcctctctttctgttcctcctcacttgctgcccagggtccaattcccaggctgtggtcgactcaggacgccctcacgtgacttgtccgtaccccgagggaagggactagtccactcctacgaccctggtcggaccttccacgactacgtgggagtacttcgtacaaccgtaagtacgggtacttaacttacgtaccccttaacgttccggttaaccaaacgtaacggaactaccggtacgggaacccaacccgtcccccggaaggaaccaacggttcgtaatttacgtaacggaataaaccaaaaanaaaaccgtaaacctaccttaccggtccggtacccccgtaggttaccccggtatccggtaaccggtccttacccgtcggggttaaccgggactaaaccgtcgaccggttccgtacccggtcccgttttaccggggactccggtacaccgacgtacggaaaggtccggttaggaccgggtacgttagggtaatttacccggtttaataccggggttcctccggttttacgtaccccgtttaaccgtagttacgggttacggttccgggtttaggggtttacggacccggggtaaggggttaaccgggaacccgttaagggttcccggtacggtaaccccggttacggtaccggttaaacggcccggaacccggttacgtacccggttccccggtaaacccccctcggtttaacncccccgtttacgttaccccggttaccccctacccgttacgttacccggtaacccgttacgacttagggttaaccccgggg

SEQ ID NO: 73137 - DNA, 472 bp, Homo sapiens
  misc_feature: GYAE6OF01A300V.36.39.D06.1.454.CMB.1.raw
tcagtacgctgtctcacgaccggtgctcgatttagtgacatctcgcagttctttggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttccaatttgaaacaggggtcccatcaaggttcagtgcaagtcgatctgggacagatttactttcagcatcaccagcctgcagtctgaagatattgcaacatatttctgtcaacagtttgctgatctccctcgacgttcgccaaggaccaaggtgaaatcaaagatag

SEQ ID NO: 73138 - DNA, 553 bp, Homo sapiens
  misc_feature: GYAE6OF01CJSLH.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttcaattgaaacagggtccatcaaggttcagtgcaagtcgatcgtagggactagtattttacttcagcatcacagcctgcagtctagaagtatattgactaactattatttctgttacaacgtagtttgcttagtattcccgtccccgttacccggtaaccggttttccggggaaccccgtaaacgggggaaccctaaaacggggttaacggtaaaacgttaacccgtaaaacggtaaccgttacggg

SEQ ID NO: 73139 - DNA, 623 bp, Homo sapiens
  misc_feature: GYAE6OF01DJVMX.36.39.D06.1.454.CMB.1.raw
  modified_base (361)..(361): a, c, t, g, unknown or other
  misc_feature (361)..(361): n is a, c, g, or t
tcagtacgctgtctcacgaccggtgctcgatttagtgacatctcgacagttctttagggggccaaacggagtccacgttcccgaaccaggaccacagcatggacactgacgggtccctggcgtccaggctcctggggccttcctggctgctctggctactcgaggtcgcccacgagttgtcgacgatcccaggatggaacccagttctccattcctccctggtactcgcgacttcctggttaggcgacgagtacgtcaccagttcacctttgcccgtaaggcgtacgttccacggtactattgaactaacgttattaaattggtatccgagcgagtaagccgagggatggccctaagctcngactcgaacgatgcttacaagtttagaaaacgtacggggttacccaagtcaaggttcagtgcaagtcgatcgtaggacagtactttacgttcagcactcacagcctgcagtcctagaatatattgactaactagttactttacttagttacaacgtaggtttacgacgtagtacttccgttcccgtaccggtaccggtttccgggacccgtaaggggtaccctaagggttaacgaaacgttacgtaaaacggtcgttacggg

SEQ ID NO: 73140 - DNA, 511 bp, Homo sapiens
  misc_feature: GYAE6OF01CGJGN.36.39.D06.1.454.CMB.1.raw
  modified_base (368)..(368): a, c, t, g, unknown or other
  misc_feature (368)..(368): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtagcgacagagtcaccatcacttgccaggcgagtcaggacattgacaactattaaattggtatcagcagaagccagggatggcccctaagctcctgatctacgatgcttccaatttgaaaacagggtccatcaaggttcagtgcaagtcgatctgggacagtattttacttnagtcatcaccagcctgcagtctagaagatattgactaacattatttctgtacaatagtttgacttgacttcctcccgtccgacgttccgggaccctaaaggggaccctaagggtacggaaattaccgaaacgtaacgttacgg

SEQ ID NO: 73141 - DNA, 531 bp, Homo sapiens
  misc_feature: GYAE6OF01CC17T.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttcaatttgaaaacagggtcccatcaaggttcagtgcaagtcgatctgggacagtattttactttcagtatcaccagcctgcagtctgaagatattgcaactattatttctagttacaactagtttgcttgtacttccttcccctcccggtacgtttccggacccgtaaaggggtaaccccaaaggggttacggaaaacttaccgaaaacggtaacgtggtacggg

SEQ ID NO: 73142 - DNA, 505 bp, Homo sapiens
  misc_feature: GYAE6OF01CAZGN.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactattaaattggtatcagcagaagccaggatggccctaagctcctgatctacgatgcttccaatttacgaaaacagggtacccatcaaggttcaagtgacaagtcgatctagggactagtattttactttcagtcatcacagcctgcagtctagaagattattgactaactattatttctagtacaactgtttgctgtacttcctccctcgaccgttcggaccaaagggaccaaggtaggaaatccaaaggtactacggg

SEQ ID NO: 73143 - DNA, 565 bp, Homo sapiens
  misc_feature: GYAE6OF01DAUXC.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactattaaattggtatcagcagaagccagggatggccctaagctcctgatctacgatgcttccaatttgaaaacaggggtcccatcaaggttcagtgacaagtcgatctagggacagtattttacttcagcatcaccagcctgcagtctagaagatatttgactaaactattatttctagttaccaacgtagttttcgacgttgtacttcccttccccgttaccggtaacccggttttcccggaaacccgtaaacgggggaaccctaaaacgggggttaacggtaaaaacttaaccgaaaaccggtaaaccgttaacgggg

SEQ ID NO: 73144 - DNA, 509 bp, Homo sapiens
  misc_feature: GYAE6OF01AW585.36.39.D06.1.454.CMB.1.raw
  modified_base (396)..(396): a, c, t, g, unknown or other
  misc_feature (396)..(396): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttcaatttgaaaacagggtcccatcaaggttcagtgcaagtcgatctgggactagtattttacttcagcatcaccagcctgcagtctgaanatattgacaactattatttctgtactaactgtttgctgattcctcccgtccgtacgttccggaccctaaagggaccctaaaggttacggaaattaccgaaaacgtactacggg

SEQ ID NO: 73145 - DNA, 546 bp, Homo sapiens
  misc_feature: GYAE6OF01CGL0F.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatccctccctgtctgcatctgtaggcgacagagtcaccatcacttgccaggcgagtcaggacattgacaactattaaattggtatcagcagaagccagggatcggccctaagctcctgactctacgatgtccttaccaatttagaaaacacggggtacccaatccgaaggttcagtgacaagtcgatctagggtacaggtacttttactttcagtcataccaccacgtcctcgcagttctagaagtatattgactaactattatttctagttactaactgtttgcttagtacttcccgttccctaccggtaccggttccggaccgaagggtaacccgaaagggttacggaaatacgaaacggattacggg

SEQ ID NO: 73146 - DNA, 626 bp, Homo sapiens
  misc_feature: GYAE6OF01BQQIF.36.39.D06.1.454.CMB.1.raw
tcagtacgctgtctcacgaccggtgctcgatttagtgacatctcgcagttcgtttgggggcaggagtcagtcccaaccaggacacagcatggacatgagggtccctgctcagctcctgggctcctgctgctctggctctcaggtgccagatgtgacatccagatgacccagtctccatcctccctgtctgcatctgtaggcgacagagtcaccatcacttgccaggcgagtcaggacattgactaactatttaaattggtatcagcagaagccgagggatcggaccctaagctcctgatctacgatcgtcctttaccaaagtttacgaaaaccgtacggggttacccctaagtaccgtaaagggtttccaagttcggacctaaagtccggtattccggtaggggtaaccctaaggttaactttttaaccttacgtaagtcctaacttaccaacccgaggtccctagacctacggttacctaggtaaagtactttaacgttagaacctaaacgtagttttactttccgtagttactaacgtagttttcggactttagaccttcctccccgttacgacggttccgaccgtaaacgggacctaagggtacgaaatccgaaagtctacgg

SEQ ID NO: 73147 - DNA, 555 bp, Homo sapiens
  misc_feature: GYAE6OF01DUET9.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttccaatttagaaaacacggggtcccaatcaaggttcagtgacaagtcgatcgtggactagtattttacttcagcatacaccagcctgcagtctagaagtattattgactaacgtattactttctagtactaacgtagttttcgcttagtaacttccgttccccgttaccggtaccggtttccgggacccgtaaaggggaacccgtaaagggttaacggaaaaccgttacgaaaaccgtaacgttacggg

SEQ ID NO: 73148 - DNA, 550 bp, Homo sapiens
  misc_feature: GYAE6OF01DLSM9.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtagcgacagagtcaccatcacttgccaggcgagtcaggacattgacaactatttaaattggtatcagcagaagccagggatcggccctaagctcctgatctacgatgcttaccaatttacgaaaacgtacggggtacccaagtcgaaggttcagtgacaagtcgatcgtgggactagtattttacttcagtcatcacagtcctgactagtctagaagtattattcgactaactattactttctagttactaactagtttgtacttcgtacttccgtccccttccgtaccggtttcccggaccgtaaacgggtaacccgtaaggtacggtaaactacgtaaaacgtacgttacgg

SEQ ID NO: 73149 - DNA, 566 bp, Homo sapiens
  misc_feature: GYAE6OF01DDUOA.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactaatttaaattggtatcagcagaagccagggatcggcccctaagctcctgatctacgatgcttacctaatttagaaaacgagggtacccatcaaggttcagtgcaagtcgatcgtagggacagtattttacttcagtcatcaccagcctgcagtctagaagtatattgactaaactattactttactagttactaacttagtttacgcttagtacttcccgttaccccgttacccggttaacccggtttaccgggacccgaaacggggtaacccgtaaagggttacggaaaacgttaaccgaaaaccggtacgttacggg

SEQ ID NO: 73150 - DNA, 499 bp, Homo sapiens
  misc_feature: GYAE6OF01CAD3H.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactattaaattggtatcagcagaagccaggatggcccctaagctcctgatctacgatgcttccaatttgaaaacagggtccatcaaggttcagtgcaagtcgatcgtagggactagtattttactttcagcatcacagcctgcagtctgaagatattgctaaacattatttctagtactaactagtttgcttgactcctcctccgacgttcggacctaagggacctaagggtaggaaatcgaaaagtacgtacgg

SEQ ID NO: 73151 - DNA, 713 bp, Homo sapiens
  misc_feature: GYAE6OF01D5QCG.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcacagagtcaccatcacttgccaggcgagtcgaggacattgaactaacttaatttaaattggtatcagacagaagccgagggatcggaccctaagcctcctgtatcgtacgatcgtactttacgtaaagtttacggaaaacgtacggggtaccccaagttacgtaaacgggttcaaggttcggactaaacggttcgtaacgttacgtaggggtaacttaaggtttactttttacctttacgtagtaccgtaactacctaacccgtagtaccctgtacctaggttccgtaaggtaaagtagttaagtttcgtaacctaaacgttattttaccgttttacttacggttaaccttaaacggtttaaggttttcgtacgttacgtaacctttccccgtacccccgtttaccgggtacccggtttacccggggaacccggtaaaaccggggtaaccccgttaaaaggggttacggtaaaaaccgttacccgtaaaaaccggtaccggtttaacggggg

SEQ ID NO: 73152 - DNA, 685 bp, Homo sapiens
  misc_feature: GYAE6OF01BW7TV.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtcctccactccctcctgtctgctatcgtaggtaggcgacagtacgtaccacctatctacgttcgaccgaggcgtagtacgaaggtactagttacgaaactaactttaattttaaagttggtactacgagacaaggaacgaccgagggactaccggacccctaaggtcctacgtagtacttaccgtacgtacgttcgtacctttaacgtaaagtttaacggaaaacggtccgggtaccctaagtacgtaaggttcagtacgacgtaagtcgagttacggtaggtaacttagtttacttttacgtacgagtacctacgtaccctaaccgacgtcctagtactacggtactaaggaactatttaacgtacgtaaacctaacgttatttaccgtttcgtacgttaacttaacgttagttactacgttacgtacccttcccgtcccgtacgttaccggtccggaaccgtaaagggtaccgtaaggtaaccgtaaagtaaccgtaaggtcgttaacggg

SEQ ID NO: 73153 - DNA, 519 bp, Homo sapiens
  misc_feature: GYAE6OF01B34UV.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaaattggtatcagcagaagccaggatggccctaagctcctgatctacgatgcttccaatttgaaaacagggtcccatcaaggttcagtgacaagtcgatcgtagggactagtattttactttcagtcatccactagcccttgccagtctgaagtatattgacaactattactttctagtctaactagtttgacttgaacttcctcccctaccgacgtttccggacccgaaagggaccaagggtagaaaatccaaaaggacttacggg

SEQ ID NO: 73154 - DNA, 525 bp, Homo sapiens
  misc_feature: GYAE6OF01BWXBK.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagcagggatggccctaagctcctgatctacgatgcttccaatttgaaaacaggggtcccatcaaggttcagtgacaagtcgatcgtgggacagtattttacttcagtcatcaccagcctgcagtctagaagatattgactaactattatttctagttacaacgtgtttagcttgacttcccgtccctaccggtaccgttccgggaccctaaaggggaccctaaagggtacggaaaacttccgaaaacgtacgttcgg

SEQ ID NO: 73155 - DNA, 677 bp, Homo sapiens
  misc_feature: GYAE6OF01CMK6M.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtcctgcatctgtaggcgacagagtcaccatcaacttgccaggcgagtcaggacattgaacaactatttaaatggtatcagcagaagccgaggactcggaccccttaagcctacctgacttcgtacgatcgtccttacctaaatttacgaaaaacgtacggggtaccctaaagttacaaacggtttacaggtttagacgtaaaggtccgaagttcgtagggaactaaggtactttttacgtttcaagtctaacgttaccaaccgtacgccgttacgaccgtagttaccgtagtaaacgtagtttaactttacggaacctaaacgttaactttaacgttttaccgttacgttacctaacgttacggttttacgtacgtacggttacttacccgttaccccgttaccggtaaccggttttaccgggacccgtaaaacggggtaccctaaaagggggttacgtaaaagtaacccgtaaaacggtacgttaacggg

SEQ ID NO: 73156 - DNA, 562 bp, Homo sapiens
  misc_feature: GYAE6OF01CKXOF.36.39.D06.1.454.CMB.1.raw
  modified_base (323)..(323): a, c, t, g, unknown or other
  misc_feature (323)..(323): n is a, c, g, or t
  modified_base (379)..(379): a, c, t, g, unknown or other
  misc_feature (379)..(379): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcacagagtcaccatcacttgccagcgagtcaggacattgacaactattaaattggtatcagcagaagccgagggatcggccctaagctcctagatctacgatgtcttaccaatttagaaaacncgggtaccatcaaggttcagtgctaaagtcgatcgtagggactagtattttacttnagtcatacaccagcctgctagtcctagaatatattagactaacgtattatttcttagtactaactagtttcgactgtaactcccgttaccccgttaccggtaccggtttcccggaaccgtaaaccggggtaaccgtaaacggggtaacggtaaattaacccgaaaaccgggtacttaacgggg

SEQ ID NO: 73157 - DNA, 537 bp, Homo sapiens
  misc_feature: GYAE6OF01DQHFH.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactattaaattggtatcagcagaagccagggatggccctaagctcctgatctacgatgcttccaatttagaaaacagggtccatacaagttcagtgcaagtcgatctagggactagtaattttactttacagtcatacaccacgcctgctagtctagaagtatattgactaactattactttctgttacacttagtttcgctagtacttccttccccgtaccgtacggttccggacccgtaaacgggaacccgtaacgggtaaggtaactaaccgaaaacgtacgttaacggg

SEQ ID NO: 73158 - DNA, 672 bp, Homo sapiens
  misc_feature: GYAE6OF01DCTKM.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtcctccacttccctccctgtctgccatcgtagtacggcgaacagacgtcaccatcactgccaggcgagtcaggactagtagaactaacttatttaaagtggtatcagacagaacgaccgaggactccggaccctaagcctacctagactacgtacgatcgtacctttacaaagtttacgaaacgcggtaccattacgaagttcagtcgacgaagtcgagtcgtaggtactaagttacttttacttacgtacgtactaacgtacctaaccgtacgtcccgtagtacgtacgttaccgtagtaacgtaagttaacgttacgtaactaacttaacgtttaacttttccgtaagttaacctaaacgttacggtttcgtacgttacgttaccgttaccccgttcccgttaaccccgggttacggtttacccgggaacccggtaaaccggggtaaccgtaaacgggttaacggtaaacgtaaccgtaaaacggtaccgttaacggg

SEQ ID NO: 73159 - DNA, 522 bp, Homo sapiens
  misc_feature: GYAE6OF01C3T3T.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagatcaccatcacttgccaggcgagtcaggacattgacaactattaaattggtatcagcagaagccagggatcggccctaagctcctgatctacgatgcttcaatttgaaaacagggtccatcaaggttcagtgcaagtcgatcgtagggacagtattttacttcagtcatcaccagcctgcagtctagaagtatatgacaactattatttctagttaccatagtttgacttgtaacttccgtccctaccgtacggtttccggacccgtaaagggaccctaaagggttacggaaattaccgaaaacggtacttacggg

SEQ ID NO: 73160 - DNA, 533 bp, Homo sapiens
  misc_feature: GYAE6OF01CJSZZ.36.39.D06.1.454.CMB.1.raw
  modified_base (322)..(322): a, c, t, g, unknown or other
  misc_feature (322)..(322): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactattaaattggtatcagcagaagccagggatcggacccctaagctcctgatctacgatgcttccaatttgaaaacngggtccatcgaagtcagtgacaagtcgatcgtggacagtatttacttacagcatcaccagcctgcagtctagaagtatatgactaactattatttctagttactactagttcgcttagtacttcccgttccccgtacgggtaccgtttccgggacccaaacggggtacctaaacggggtacgtaaacgtaccgaaaacggtacgttacggg

SEQ ID NO: 73161 - DNA, 581 bp, Homo sapiens
  misc_feature: GYAE6OF01AFFVJ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccgaggatcggccctaagctcctgactctacgatcgtccttacctaatttacgaaaacgtacgggggtaccctaagtacgtaaggttacagtgacgaagtcgatcgtagggactagtacttttactttcagtctactccaccagtcctgccagtctagaagtatattgactaactattatttactgttacctaacgttagtttcgcgttacgtacttcccgttccccgttacccggtaccggtttccgggacccgtaaacggggacccgtaaaggggtacggtaaactacgaaaaccggtaacgttacggg

SEQ ID NO: 73162 - DNA, 639 bp, Homo sapiens
  misc_feature: GYAE6OF01ASRCG.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccaggactcggaccctaagctcctgatctagatgacttacctaagtttacgaaaacgtacgggtacccatacgtaaggtttcaaggtgacaaggtcgagtcgtagggaacctagtattttacttcagtcaactacgaaccaggtcctgacctagttacgtagtaaagtacttaagttcgaactaaactaatttacgtttacgttagttaaccgtaaaaccttgggttttcaccgttgtaaccgtttacccgttcccccgttaaccggttacccgggttaccgggaaaccccgggtaaacgggtaaacccgggtaaagggttaacgggaaaaacccgttaggtaaaaacccggttaacggttaacggggg

SEQ ID NO: 73163 - DNA, 756 bp, Homo sapiens
  misc_feature: GYAE6OF01EIVOG.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgaactaactaatttaaattggtatcagacagaagacgaggatcggaccctaagctctgactcgtacgatacgtcttacctaagtttagaaaacgtacggggtaccctaagttacgtaaaggttaccaggttacgaacgtaaacggttaccgtaagttaccgttacggggtaaccttaacggttaacgtttttttaaccgttttacgtaaacgtaccgtaacgttacccgtaaaccccgtacggtaccccgttacggtacccgttaacggtttacccgttaaagggttaaacgttaagtttaaacgtttacgtaaacccttaaaacttaacgttttaactttttaccctttacggtttaacccttaaacgtttaacggtttacgttaccgttacggttaacccttcccgttacccccgttacccgggttacccggtttacccggggaacccgtaaacggggtaacccggtaaacgggtaacggtaaagttaacccggtaaaacggtacgttaacggg

SEQ ID NO: 73164 - DNA, 638 bp, Homo sapiens
  misc_feature: GYAE6OF01C3AE4.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctcctgtctgcatctgtagcgacagagtcaccatcacttgccaggcgagtcaggacattgactaactatttaaattggtatcagacagaacgccgagggactcggcccctaagctcctgatctagatgcttactaatttacgaaaacgacgggtacccaatacgaaggttcagtgacgaagtcgatcgtagggacaggttacttttactttacagtctataccaccgtagtccctggtactagtactagaaacgtattaagttcgaactaaactagtttactttacgttagttacctaacgttaggttttcggtaccttacggtacctttacccgtacccccgtttacccggttaacccgggtttacccgtaaaccccggaaaagggggttaaccccctaaagggggttaaacggtaaaaccgtttaaaccgaaaacccgggttaaccgtttaacgggg

SEQ ID NO: 73165 - DNA, 654 bp, Homo sapiens
  misc_feature: GYAE6OF01E2TIZ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatcgtgtaggcacagacgtcaccatcacttgccaggcgagtcaggactagttagaactaacttaatttaaattggtatacagcaaggaacgccgagggactcggacccctaagcctcctagactactacgagtcgtaccttaccgtaaagtttacgaaaacggtaccgggtaccctaagtacgtaaggttcgaggttacgacgtaagtcgagtcggtaggactaagtttacttttacttacagtactagtaccaccgtacgtccctgactacgttactagtaagtattagtacgaactaacgtagttacttttcgattacgtaacgttagtttcgacttacgtaccttcccgtaccccggttaccggttaaccggttaccgggaacccggttaaaacgggtaaaccccggtaaaggggttaacccgtaaaacgttaacccgtaaaaaccgggtcgttacgggg

SEQ ID NO: 73166 - DNA, 563 bp, Homo sapiens
  misc_feature: GYAE6OF01E4W6Z.36.39.D06.1.454.CMB.1.raw
  modified_base (303)..(303): a, c, t, g, unknown or other
  misc_feature (303)..(303): n is a, c, g, or t
  modified_base (409)..(409): a, c, t, g, unknown or other
  misc_feature (409)..(409): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcgaggacattgactaactaatttaaattggtatcagcagacgcgaggatcggaccctagctctgatctacgntcgtcttacctaaatttacgaaaacgacggggtacccaagtacgaaggttcagtcgacgaagtcgagtcgtagggactagtacttttacttcagtcactccaaccngcctgacctagtactagaagtatagttgacctaacgtattatttctagtacagttgttgtacttgtacttcccgttccccgtaccggttaccggttccggaccgtaacgggtaaccgtaagggttaacgaaactacgtaaaacgtacgttacgg

SEQ ID NO: 73167 - DNA, 560 bp, Homo sapiens
  misc_feature: GYAE6OF01A8805.36.39.D06.1.454.CMB.1.raw
  modified_base (384)..(384): a, c, t, g, unknown or other
  misc_feature (384)..(384): n is a, c, g, or t
  modified_base (458)..(458): a, c, t, g, unknown or other
  misc_feature (458)..(458): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggcgacagagtcaccatcacttgccaggcgagtcaggacattgactaactattaaattggtatcagcagaacgcgaggatcggccctaagctctgactctacgatcgcttacctaatttagaaaacgtagggtacccagtacgtaaggtcagtgacaaggtctatcgtaggactagttatttacttnacgtcataccacacgctgctagtctagtaatattatgactaatagttactttagtacgtactaacgtgtttacncttacgtacttccgtccccgttacgtaccggttaccggacccgtaaacggggtaaccgtaaacgggttaacggaaactaaccggtaaaacgtacgttacggg

SEQ ID NO: 73168 - DNA, 724 bp, Homo sapiens
  misc_feature: GYAE6OF01CK59D.36.39.D06.1.454.CMB.1.raw
  modified_base (219)..(219): a, c, t, g, unknown or other
  misc_feature (219)..(219): n is a, c, g, or t
tcagtacgctgtctcacgaccggtgctcgatttagtgacatctcgcagtttctttgggggcaggagtcagtcccaaccaggacacagcatggacatgagggtccctgctcagctccgtggggctcctgctgctctggctctcaggtgccagatgtgacatccagatcgacccagtcctccactccctcctgtctgcatcgtgtaggcacagatacaccntcactcgccgaggcgagtacaggactaagttacgaaactaaacgtttaatttaaaagtttggtaattacgaacgacgaagaacggaccgaaggggtactcccgggtaaccctaagcccttaccgtagaacttaccgtaacggtatacggtaccttttaactaaagttttaacggaaaaccggttcggggtaaccctaagtacggtaaggttcagtacgacgtaaagtcagtacggtaggaacttatttacttttacttagactactactaccacgtacgtccgtgactacgttacgtagtaacgtattacgtacgtaacctaactttaatttacgttttactacgttaaccttaagtttaccggtttaggtacctttacggttaaccctttccccgtttaccccggttacccgggttaacccggtttcccgggaaccgggtaaaaccgggtaacggtaacgggttaaacgtaaaccggtaaccggaaaaccggtcggttaacggg

SEQ ID NO: 73169 - DNA, 838 bp, Homo sapiens
  misc_feature: GYAE6OF01DEFH4.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagactcgacccagttcctcccacttcccgtccctggtctagcctatccgtggtacggccgaacaggactaccaacctacttccacgttcgccgagggacgagtacgaggtactaagttacgaaacttaaactttaagtttaaacgttggtaactacgaacgacgtaaacggaacggacccggtaaggggtaccgtacccgggtaacccctaaacggttcccttaccggtaggtaaccttaccgtaaaccgggtacttaccggttaccctttaaaccggttaaaacgtttaaaccggaaaaaccccgggttaccggggttaaccctaaggttaaaccggtaacgggtttaaccgacggtttacggaaaccgtaacggtttaccggtaacggtttacgggtaacgggtaacttaagttttaaccgttttacgttacgacgtaacctactaccgacctcgtaccgtacgacgtagttacgtaagaattacttaggtacaactaacgtttatttactttaccgttacgttaacccgttagttaggtttacctaccgttaccgttacccgttaccccgttaccccgttaccgggttacccggttaacccgggaaaccggtaaacggggtaacccgtaaacgggttaaacgaaaccgttaaccggaaaaccgtttggtaccggg

SEQ ID NO: 73170 - DNA, 525 bp, Homo sapiens
  misc_feature: GYAE6OF01DDJAM.36.39.D06.1.454.CMB.1.raw
  modified_base (321)..(321): a, c, t, g, unknown or other
  misc_feature (321)..(321): n is a, c, g, or t
  modified_base (375)..(375): a, c, t, g, unknown or other
  misc_feature (375)..(375): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcacatcacttgccaggcgagtcaggacattgacaactatttaaaattggtatcagcagaagccagggatggccctaagctcctgatctacgatgcttaccaatttgaaaacngggtccaatcaaaggttcagtgcaagtcgatctgggacagtatttactttcgancatcacagctgcagtctgaagataattgacaacattaatttctagtactaactagttttgacttgaattccctcccgtacccgtacgtttccgggcctaaaggggaaccctaaaggggttacgaaaacgttcaaaaaccggaacgttagg

SEQ ID NO: 73171 - DNA, 497 bp, Homo sapiens
  misc_feature: GYAE6OF01A2F9W.36.39.D06.1.454.CMB.1.raw
  modified_base (325)..(325): a, c, t, g, unknown or other
  misc_feature (325)..(325): n is a, c, g, or t
  modified_base (404)..(404): a, c, t, g, unknown or other
  misc_feature (404)..(404): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtcctgcatctgtaggcgacagagtcaccatcacttgccaggcgagtcaggacattgacaactatttaaattggtatcagcagaagccagggatggcccctaagctcctgatctacgatgctttaccaatttagaaaacnggggtaccatcaagttcagtgcaagtcgatcgtgggactagtattttacttcagtcatcaccagcctgcagtctagaanatattcgacaactattactttctagtactaactgtttgctgactcgtccctcgacgttcggaccaagggaccaggtagaaatcaaagtactgg

SEQ ID NO: 73172 - DNA, 887 bp, Homo sapiens
  misc_feature: GYAE6OF01C3BS6.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagttcctccatccctccctgtcctgcattccgtggtacggccgaacagacgtccaacctattccaaccgttcggacccgagggccgtaaggttcgaacgggtactaagtttaggaacctaaactttaattttaaaagttggtaattacgaacggacaaggaacgacccgtaaggggacgttccgggacccccgttaaaggtcccgttaccgtaggtacttaccgttaacggacttcgtaccttttaccgtaaaagttttaacggaaaaaccgtaccgggggttaacccctaagttaaccgtaacgggtttaccaagggttcgtaacgtaaaggtccgtaacgttacgggttacgggtaaaccttaacggttttaactttttttaaccgttaccgtaaacggttcctaaacttacccgaacccgtaccggtaccgttcggacccgttaggttaccgttaaacggtaaagtaagtttaacgttacggaaccttaaacgttaagtttttacttttaccgttacggttaaccttaacgtttacggttttacgaccgtttacgtaacccctttccccgtttacccccggttacccgggtttaacccgggtttaccccggggtaaaccccgaaaaccgggggtttaaaccccgggtaaaacggggtttaaaccggaaaacccgttaaaacccgggtaaaacccggtaacggtttaacccggggg

SEQ ID NO: 73173 - DNA, 739 bp, Homo sapiens
  misc_feature: GYAE6OF01CHUAE.36.39.D06.1.454.CMB.1.raw
  modified_base (209)..(209): a, c, t, g, unknown or other
  misc_feature (209)..(209): n is a, c, g, or t
  modified_base (457)..(457): a, c, t, g, unknown or other
  misc_feature (457)..(457): n is a, c, g, or t
tcagtacgctgtctcacgaccggtgctcgatttagtgacatctcgcagttctttgggggcaggagtcagtcccaaccaggacacagcatggacatgaggtccctgctcagctcctggggctcctgctgctctggctctcaggtgccagatgtgacatccagatcgacccagtcctccactccctccctgtctgccatctgtaggacganagagtcaccatcacttgccaggcgagtcgaggactattagaactaaacttaatttaaagtggtaatacgaagacaagaacgccgagggactcggaccccttaagcctacgttagacttccgtaagtacttcgttacctttaacgtaaagtttaacggaaaaccggtccgggttacccaaagtacgtaaggttccgagttacgacgtaacgtacgacttcgtaaggaacttagtttaacttttacgttnacgtactaactccgaaccgtcgtcccgttagaccttaacggttacgtaaagaagttatttaacgttagaaaccctaaacttaactttattttacccgaggttaacccttaagtttacgggtttcctaccgtttacggtaacctttccccccggttttacccgtaccccgggtttacggtttaaccccgggaaacccccgggttaaaacgggggtaaaccctaaaaggggggtttaccaaaaaaccggttaaccccgtaaaaacgggttcggtttaaccgggg

SEQ ID NO: 73174 - DNA, 640 bp, Homo sapiens
  misc_feature: GYAE6OF01B7YUQ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactaatttaaattggtatcagcagaagccagggatcggcccctaagctcctgatctacgatcgcttactaatttaggaaaacgtacggggtaccctaagtaccgtaaaggttctaagtcgtacgtaagtccggtattacggtagggaactaagttactttttacttttacgaagtcctaactccgaaccctacggtccctgacctagttctacggtaagtacttattgacctaacgtatttagtttactaggttaccaacgttagtttacgtcttacgtacctttacccgttccccgttaccccggttaacggtttaccccgggtacccggtaaacgggtaacccgtaaagttacgggttaaaggtaaaacgttaaccgaaaaccggttaaccggg

SEQ ID NO: 73175 - DNA, 850 bp, Homo sapiens
  misc_feature: GYAE6OF01B8XXG.36.39.D06.1.454.CMB.1.raw
tcagtacgctgtctcacgaccggtgctcgatttagtgacatctcgcagttctttgggggctctgggagaggagccccagccctgagattcccaggtgtttccattcagtgatcagcactgaacacagaggactcaccatggagttgggactgaactggtattttcctttggcttaattttaaaaggtgtccagtgtgaagcgcagcgtggtggagtcgtgggggaggtcgttggtacacggccgggcacggtccctggagtaccttctcctgtcgctagttcctcgtggtactttcctaccgttttagaaagttactttttcggaccctaagtcggtccgtaacggttcggggtcccggacgtaacggtttccggaagggggtacggtcccgttgggaacggttgggtacctaacgtaacttaagtttacgacgttagggtaaagttaggttagggttaagttaaggttggggtttaagtcggtaccgggtacttcggttaggttacgggtaaaccggggttcccgtaacgtttacccgaacccgttaacgttacccgttaaccccggaaagggtaaaccgaaacccgtaaacccggtaaccccgtaaaaccggtaaacccctttcccccggttaagtttaaccgttaccgtaacggtaaacctaaaacggttacgaaacccgtaacggttccgttaaggaaacgtacggtaccggttacgggaaccggaacgttacccgggttctttaaacggtttaaacgtttacgggttaggtaacggtaaacggtaaaacgggttacttaacgtaaaaccttacgttaaaccggtaacgttaggtaccgtttaacg

SEQ ID NO: 73176 - DNA, 528 bp, Homo sapiens
  misc_feature: GYAE6OF01CZ7TD.36.39.D06.1.454.CMB.1.raw
  modified_base (386)..(386): a, c, t, g, unknown or other
  misc_feature (386)..(386): n is a, c, g, or t
  modified_base (409)..(409): a, c, t, g, unknown or other
  misc_feature (409)..(409): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtagcgacagagtcaccatcacttgccaggcgagtcaggacattagactaacttatttaaattgtatcagcagaagccgaggactcggaccctaagcctactgactctacgatgcttcaattagaaacgcggtccatcgaagtcagtgactagtcgatcgtaggactgtattttacttcagtctatcacgngcctgcagtctagaactatagtnactaatattattctagtactacgtagtttcgacttcgtacttccctacccgtacgtaccggttccgaccgtaaacgggaccgtaaacgggtaacgtaaataacgtaaacgtacgtacgg

SEQ ID NO: 73177 - DNA, 726 bp, Homo sapiens
  misc_feature: GYAE6OF01ALXYE.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaattggtatcagcagaacgccgaggactcggccctaagcctcctgactctacgtatcgtctttacctaagtttacgaaaacgtacggggtacccaagtaccgtaaacggtttcgaaggtacgacgtaaggtccggtaagttccggttacggggaactaacgggtttaacttttttaaccgttttaccaacggtacctaacgttacccgaacccgtaacgtcccgttagaccctacggttacgttaacggaaagtaatttaacgttcgtaacctaaaccgtattttaacttttaccgttacgttaaccctaacgttacgttttacggactttacggtaacctttaccccgtttcccccgttaacccggtacccgggttttacccgggaaccccgttaaaacgggggtaaccccttaaaagggggttacccggtaaaaacgttaacccggtaaaaccggtttaaccggttaacgggg

SEQ ID NO: 73178 - DNA, 566 bp, Homo sapiens
  misc_feature: GYAE6OF01CO9RT.36.39.D06.1.454.CMB.1.raw
  modified_base (380)..(380): a, c, t, g, unknown or other
  misc_feature (380)..(380): n is a, c, g, or t
tcagtacgctgtctcacgaccggtgctcgatttagtgacatctcgcagttctttgggggatctgggagaggagccccagccctgagattcccaggtgtttccattcagtgatcagcactgaacacagaggactcaccatggagttgggactgaactggattttcctttggctatttaaaaggtgtccagtgtgaagcgcagctggtggagtcgtgggggaggcttggtacaggccggggcaggtccctgagactctcctgtgcagtctctggattcacctttgaagtattttgccatgcacgtgggtccgcaagttccgagggaaggccttggagtgggtctcaactagttagctaggaataggtggtagtatgggttanggcggactgtggtgagggcctattcacctatctcgaagacgaacaacgaccaaagacctcccgtagtactctagaccaaatcgaacagtctgagagcgtgaacggacacggtccttgtaacgttacgtggtacgaacgaaaagggtacttaacgaaattactaccgaaacgttgggtaccttacgg

SEQ ID NO: 73179 - DNA, 717 bp, Homo sapiens
  misc_feature: GYAE6OF01B5GZP.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtcgccagatgtgacatccagatcgacccagtcctccactccctccctgtctgctatctagtacggcgacagacgtcaccatcacgttgaccgaggcgagtacaggacattagactaacttaattaattggtatcagcaagaacgcgaggctacggaccctaagcctctagtatactacgtagtcgtacttacctaaagtttacggaaaacgtcggggtacctaacgttcgtaaggttcgacgtacgacgtaagttacgtacgttcggtaggtacgtaagtttaacgtttttacgttacgtacgtaactactaaccaccgtaccgtcctcgtactacggttcctaaggtaaatacgtttaacgttagacctaaacgtattttaccttacgttattaaccctaagttaccggttttacgtacgttaccggttaaacttccccggtttaaccccccttcgggtttaacccggtttaccccgggaacccgggttaaaaccggggttaacccggtaaaacgggggttaaacgtaaaaccgttaacccgggtaaaaaccgggtccgtttaaacccggggg

SEQ ID NO: 73180 - DNA, 709 bp, Homo sapiens
  misc_feature: GYAE6OF01E1CPM.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtctccatccctcctgtctgcatctggtacggcgacagagtcaccatcacttgccgaggcgagtcaggacattagaactaacttatttaaattggtatcagcagacgcgagggactcggaccctaagcctctgtactctacgatcgtacttacctaagtttaacgaaacgtacgggtaccctaagtacgtaacggttcagtcgacgaagttcgacgttcgtagggaaccttaaggtttactttttaccgtttacgacgtacctacgttaccaaccccgtaggtaccccttacggacccgtaacgtttaccgtaagtaaacgttactttaacgtttacgaaccttaaacgttaacttttaacgttttaccgtacgtttaacctacgtttagttttaccgtacgtttacggtaacccttttccccgttacccccggttacccgggttacccgggttacccgggaaacccgggtaaacggggtaaacccgtaaacggggttaacgaaaacggttaacccgtaaaacggttaccgttacggg

SEQ ID NO: 73181 - DNA, 689 bp, Homo sapiens
  misc_feature: GYAE6OF01AOAAN.36.39.D06.1.454.CMB.1.raw
  modified_base (499)..(499): a, c, t, g, unknown or other
  misc_feature (499)..(499): n is a, c, g, or t
  modified_base (546)..(546): a, c, t, g, unknown or other
  misc_feature (546)..(546): n is a, c, g, or t
tcagtacgctgtctcacgaccggtgctcgatttagtgacatctcgcagtttctttgggggcaggagtcagtcccaaccaggacacagcatggacatgaggtccctgctcagctcctgggctcctgctgctctggctctcaggtgccagatgtgacatccagtatcgacccagtcctcctactccctccctgtctgctatcgtgtacggcacagagtaccacctatccaccgttcgaccgaggcgtaacgtcgaggtactagttacgaacctaaatttaattttaaagttggtaactccgaagacaaacggtacgaccggaagggtactaccgggtacccctaagtcctaccgtagtacttaccgacgtatcgtacctttaactaagtttacggaaaacgtcgggtccctaagtacgtaaggttcgagtacgtacgtaacggtcgtagttcggtaggaacttacgttttactttacgttacgagtacacgtccaaccgtnccgttgacgttagtacgtagtaatacgttagtacgtaaccaaacttnttttaaccttcgtactaacgtaacgtttagttcaccgtttactccttcccccggtacgttcccggttaaccgtaccgggaacccggtaaacgggaacccgttaagggtaacgtaaaaccctacccgggaaagttcggtaacgg

SEQ ID NO: 73182 - DNA, 668 bp, Homo sapiens
  misc_feature: GYAE6OF01CV4ZZ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctccgtggggctcctgctgctctggctctcaggtgccagatgtgacatccagatcgacccagtcctccactcctccctgtctgcatctgtaggcgacagacgtcacatcacttgaccaggcgagtcaggacattagaactaacttaatttaaagttggtatacaagacaagaacgccgagggactcggaccctaagcctcctagactctaacgtatcgtaccttaacgtaagtttaacgaaaacgtacgggtacccaagtacgtaaggttcagtcgaacgtaagtcgaacgtcgtagggaacctaggtttacttttacgtttacaagtactaacgtccaacgtacgcccttagacgtagtaccgtaaggtaagtacgttaagttcgaaccttaacgttatttacctttacgtagttaacctaagtttagttcgtacttacgtaccttccccgttacccccgttaccgggttaaccggtttacccgggaacccggtaaacgggtaaacccgtaagggttaaacggaaaaccttaccgtaaaaaccggtacgttacggg

SEQ ID NO: 73183 - DNA, 630 bp, Homo sapiens
  misc_feature: GYAE6OF01EQQOY.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctcctgtctgcatctgtagcgacagagtcaccatcacttgccaggcgagtcaggacattgactaactaatttaaattggtatactagcagaacgcgagggatcgggacccctaaggctacctcgatactacgatcgccttactaatttacgaaaacgtacggggtacccaagtaccgaaggttcagtgaactaaggtacgaagtcgtagggactaagttacttttactttacgtagtacgtactaccgaacctacgccgtgacgtacgttcgtaagtaagtatagttacgactaactattacttttactacgtacctaacgttagttacgacttacggtacttcccgttacccgttacccggttacggttcccggaacccggtaaacggggtaaacccgttaaacggggtacggtaaaaacccgtacgtaaaacccggtaacgttaccggg

SEQ ID NO: 73184 - DNA, 752 bp, Homo sapiens
  misc_feature: GYAE6OF01BSQ79.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatcgacccagtcctccatccctccctgtctgctatcgtgtacggcgacagagtccaccatccacgttcgccgtaggccgagtccgaaggactagttgaactaacttaattttaaattggtatacagcgaagaacgccgaaggggtactaccgggaccccttaaggcctcccgtagacttactacgtactcgtaccttactaaagtttaacggaaaaccggtacggggttaccctaaggttaccgtaacggttctaaggtcgtaccgtaaaggtccgtatacgggttaacggtaacgttaacgtttaactttttaccgttacgacgtacctaacgtaccgaaccgtaccgtaccgttacgtaccggtaagtttcccgtaaagtaaacgttacgttaagtttccgaaccgtaaacgttacgttttacgttttaccgtacgttttaaccgaaacgtttcggtttacgttaccttaccgttaaccttccccgtttaccccggtacccggttaccgggtttaacccgggaacccggtaaaccgggtaacgtaaacgggtaacggtaaaccgtaaccgtaaaacggtcgttaccggg

SEQ ID NO: 73185 - DNA, 544 bp, Homo sapiens
  misc_feature: GYAE6OF01BIK5G.36.39.D06.1.454.CMB.1.raw
  modified_base (390)..(390): a, c, t, g, unknown or other
  misc_feature (390)..(390): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttaccaatttagaaaacgaggggtacccatacgaaggttcagtgcaagtcgatcgtgggactagtattttacttcagcatcaccngcctgctagtctagaagtattatgactaactattactttctagttaccaacgttagtttgtacttcgtacttcctccccgttaccgtaccggtttccgggacccgtaaacgggaaccgtaagggtacggaaaataccgaaacggtacgtacggg

SEQ ID NO: 73186 - DNA, 583 bp, Homo sapiens
  misc_feature: GYAE6OF01AHLNX.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctcctgtctgcatctgtacggcgacagagtcaccatcacttgccaggcgagtcaggacattagacaactattttaaattggtatcagcagaagccaggatcggaccctaagctcctagatactacgatgtcttacctaatttagaaacgtacgggtacccaagtacgtaaggtacagtacgactaagtcgtactagtggactagtattttaactttcaagctataccaacctcgcctcgctacgtcagtaagtatagttagactaatattatttctacttaactacttaagtttgcttaacgacttcccgtcccgttacccggtacggtttcccggaaccggtaaacggtaaccccgaaagggtttaacggaaaagttacccgtaaaagggtaaccgttacggg

SEQ ID NO: 73187 - DNA, 716 bp, Homo sapiens
  misc_feature: GYAE6OF01AZID5.36.39.D06.1.454.CMB.1.raw
  modified_base (207)..(207): a, c, t, g, unknown or other
  misc_feature (207)..(207): n is a, c, g, or t
tcagtacgctgtctcacgaccggtgctcgatttagtgacatctcgcagttctttgggggcaggagtcagtcccaaccaggacacagcatggacatgagggtccctgctcagctccgtgggctcctgctgctctggctctcgaggtcgccagatgtgacatccagatcgacccatcctcactcctcctgtctgcattcgtgtaggcanagactcacctatctacgtcgaccgacggcgtacgtcgaaggactattacgaacttaaacgtttaatttaaagttggtaatcgaacgacgtaaggaccgcggtaacgggtacgtacccgtaacccgttaagcccttacgtaagtactaccgttaacggtctacgttaacccgttaactaaaggttaaacgggaaaaccggtccgggtaacctaaggtacgttaaacggttacgaaggtacgtaacgtaacggtcgtaaccgttagggttacgggtaactttaacgttactttttactacgacgtactaacgtcctaaccgcgtcgtacgacttagtactagaacgtattagtactaactaacgttattttacttccgttaggtacctaagttttccgtacgtactttaccggtacctttaccccggttcccgtaccgggtaccggttacccggtaacgggtaacggtaacggtaacggtaacgtaaacgtacccgtaaagtcggtaacgg

SEQ ID NO: 73188 - DNA, 765 bp, Homo sapiens
  misc_feature: GYAE6OF01DENY4.36.39.D06.1.454.CMB.1.raw
  modified_base (672)..(672): a, c, t, g, unknown or other
  misc_feature (672)..(672): n is a, c, g, or t
tcagtacgctgtctcacgaccggtgctcgatttagtgacatctcgcagttcgtttgggggcaggagtcagtcccaaccaggacacagcatggacatggagggtccctgctcagctccgtggggctcctgctgctctggctctcgaggtgccagtatgtgacatccagatcgacccagtcctccacttcccgtcctggtctgactattcgtggtacggacgtaacagtacgtccaacctactcgtacgttcggccgagggcgtaagcgaacggactagttacgaacttaaactttaagtttaaagttggtactacgaacgacgaaggaacggccggtaagggtaccgtacccggtaaccccgttaaggcccttacgtacgtaacttaccgtaaacgtacggttctaacccgtttaaacgtaaaacggtttaacgggaaaaacccgggtccggggttaaccctaagttaaccggtaaacggttacgtaacggtacgtaacggtaaacgttaccggtacggttacggtacgggttaaacttacgttttaacttttaccgttacaacgtacttaaccgtaccaccgtacgtccgtacgagttacgtagtaactaaggtacttagtacgaactaacttactttacgttagtacgttaacttaacgttggtttaaccncttacggttccctacccgttcccgttacggtacccgttacgggaaccgtaacggtaacggtaacggtaacgaaattaccggaaagtggtacgg

SEQ ID NO: 73189 - DNA, 686 bp, Homo sapiens
  misc_feature: GYAE6OF01BYXOI.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtcctccatccctccctgtctgctatcgtgtacggcgacagacgtccaccatcacttgccgaggcgagtcgaggacctattgacaacttaatttaatgtatcagcagaacgcgaggatcggaccctaagctccgtgatcgtacgatcgtaccttacctaaagtttacgaaaacggtcggggtacccaagtacgtaaggttcaaggtcgacctaacggtctagttcgtacgggaactagtttacttttacgttcagtctacgtaccaccgacgtccgttacgaccgtaggttcctaggtaacgtaagttacgttacgtaacctaacgtatttaacgttttacgtacgtttaacctaaccgtttaggttttaccgtcttaccggtaccctttaccccggttacccccgttacccgggtacccgggtttaaccccgggaacccgtaaacggggtaaaccccgtaaacggggttaaccggtaaaaccgtaacccgtaaaacggttaccggttaccgggg

SEQ ID NO: 73190 - DNA, 638 bp, Homo sapiens
  misc_feature: GYAE6OF01BR47L.36.39.D06.1.454.CMB.1.raw
tcagtacgctgtctcacgaccggtgctcgatttagtgacatctcgcagttctttggggggcaggagtcagtcccaaccaggacacagcatggacatgagggtccctgctcagctcctggggctcctgctgctctggctctcaggtgccagatgtgacatccagatgacccagtcctccactccctcctgtctgcatctgtaggcgacagacgtccaccatcacttgccgaggcgagtcgaaggacctattacgaactaaacttaattttaaaattggtaatcgagacaaggaacgccgagggacgtccggaccctaagcctacctgtactacctacgatcgtacctttactaagtttaacgaaaacgtacgggtacccaagtacgtaacggttacagtacgacgtaagtcgtagtacggtagggtaactaagtttactttttaccttacgaagtcctaacttaccaacccgtacgtccctagacctaaggttctaaggaacttaatattacgaactaagtattactttctagtactaacgttgttcgacttgtaacccttccgttaccccgtacggtaccggttccgaaccggaacgggtaacctaagggtaacgaaataccgaaacggtcgtacggg

SEQ ID NO: 73191 - DNA, 761 bp, Homo sapiens
  misc_feature: GYAE6OF01DMCCL.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatcgacccagtctccatcctccctgtctgcatctgtaggcgacagactcaccatcacttgccgaggcgagtcgaggactattagaactaaacttaatttaattgtatacgagacgacggaacgcgaagggtacgtcggacccctaagccttacctagtaactctacgtacgtcgtacctttaaccgtaaagtttaacggaaaacgtaccggggtaccctaagttacgtaaggttacaggtacgaacgtaacgtacgtacgtacggtagggtaacttaggtttaacttttacttacgacgtacactaccaccgtacgtccttggacctacgttacgtaacggtaatacgtttaacgttacgaaccttaaatttacgttttaaccttttcgttaaccgttaaccttaaccggtttaagggtttttacccgccttttaaaccggttcccgtttacccccgtttacccccccgggtttaaccggggtttaaccccgggtttaaccccggggaaaccccgggtaaaacccggggttaacgggttaaaacggggttaaacccggtaaaaccgttaaacccggaaaacgggttaaccggttacgggg

SEQ ID NO: 73192 - DNA, 712 bp, Homo sapiens
  misc_feature: GYAE6OF01EUNSM.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctccgtgggctcctgctgctctggctctcgaggtgccagatgtgacatccagatacgacccagtcctccactcctccctgtctgctatcgtgtaggcgacgagacgtaccaacctatctacttcggaccgaggacgacgtacgaaggactaattagaactaaacttaattttaaagttaggtactacgacgtacgaacggaacgaccgaagggtacgtccggtaccctaaggtcctccgtagtactacgtacgtatcgtaccttaacgtaaagttaaacggaaacggtaccgggtaccaacgttaacggtaacggttcgaacggtacgacgtaaggtcgtaagtacggtaacgggaacttaggttttaacttttacgtacgataccaactaccacccgtacgtcctggactacgtagtaaagtaattaacttagtacgaaaccttaagttacttttagttaccggtaattaacctaacggtttagtttgaccgtttactacccgtttccccgtaccccggtaacggttacccggacccggtaaaccgggtaccggtaaaccggtaaggttaaccgaaaacttaccggaaaagttcggtcgg

SEQ ID NO: 73193 - DNA, 593 bp, Homo sapiens
  misc_feature: GYAE6OF01CNY5R.36.39.D06.1.454.CMB.1.raw
  modified_base (158)..(158): a, c, t, g, unknown or other
  misc_feature (158)..(158): n is a, c, g, or t
  modified_base (177)..(177): a, c, t, g, unknown or other
  misc_feature (177)..(177): n is a, c, g, or t
  modified_base (244)..(244): a, c, t, g, unknown or other
  misc_feature (244)..(244): n is a, c, g, or t
  modified_base (276)..(276): a, c, t, g, unknown or other
  misc_feature (276)..(276): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
  modified_base (467)..(467): a, c, t, g, unknown or other
  misc_feature (467)..(467): n is a, c, g, or t
tcagtacgctgtctcacgaccggtgctcgatttagtgacatctcgcagttcgtttgggggcaggagtcagtcccaaccaggacacagcatggacatgagggtccctgctcagctccgtggggctcctgctgctctggctctcgaggtgccagatggtnacatcagatgacccagtcnccatcctcccgtgtctgcatcgtgtacgggcaacagacgtcaccatcatgccgaggcgagtcagganattagaactaataatttaatggatcgagcaanaagccgagggtactcggaccctaagcctacgtagactcgtaacgatcgtacttacgtaaattaacgaaacgacgggtaccaagtgaacggttanagtagaaccgtaagtgaacgttcgngggtaacctagttacgttttacttcagtaccaattacccactagcccgtgactgtactagaagtatacttanaactaatattattcgtataacgtagtagttcgctacgttacctcccgttacccgtaccggtaacggttaccgggaacctaaacggggtaacctaagggaaacgtaaataacggaaacgtaacgtcg

SEQ ID NO: 73194 - DNA, 723 bp, Homo sapiens
  misc_feature: GYAE6OF01EY05N.36.39.D06.1.454.CMB.1.raw
  modified_base (590)..(590): a, c, t, g, unknown or other
  misc_feature (590)..(590): n is a, c, g, or t
tcagtacgctgtctcacgaccggtgctcgatttagtgacatctcgcagttctttggggggcaggagtcagtcccaaccaggacacagcatggacatgagggtccctgctcagctcctgggctcctgctgctctggctctcaggtgccagatgtgacatccagatcgacccagtctccactccctcctgtctgcatcgtagtaggcgacagtagtccacctatccacgttcgaccgacggtcgagtacgacggtactaattacgaactaaacttaatttaaagttggtatacagtacaacggtaacgaccggtaagggactaccgggacccctaaggtccttaccgtagtacttacctacgtactacgtaccttacctaaagtttaacgaaaccgtaccggggtacccaagttaccggaaggtttacgaacgtgtaaccgtaacggttacgagtacggtacgggtaactaacgtttacgtttttaactcggaagtccaagtccgacgtcgtacctggtacctagtacctagtaacgtagttactcgaacttaacctatttactttacgtacgtaacttaacggttacgttntaaccgttacggtactttccccggttcccccgttaaccgggttacggttaacccgggaaccgggtaaacggggttaacccgaaaggggttaacgtaaaaacttaaccccgggtaaaagttccggttaaacggg

SEQ ID NO: 73195 - DNA, 642 bp, Homo sapiens
  misc_feature: GYAE6OF01BCO63.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctgactctcaggtgccagatgtgacatccagatcgacccagtcctccactccctccctgtctgctatcgtgtaggcgacagacgtccaccatctacttgaccgaggcgagtacgaggacagttacgaactaaacttaattttaaagttggtatcagacaaggaacgccgagggacgtacggacccctaagcctcctgactacgtacgtatcgtaccttacctaagtttaacgaaacgtacgggtaccaagtacgtaacggtcgagtgactaacgtcgtactcggtaggaacttagttaagtttttacctacagtacctataccaccgtacgccgtagcgtagtcgtaagaatatacttagaacttaacttattactttacgacgttactaacgttgtttcgacttacgtaccttcccgttaccccgtacggttaccggttacccgggaacccgtaaacgggtaaccgttaaacgggtacgtaaaaaccgtacgaaaacggtacgttacggg

SEQ ID NO: 73196 - DNA, 697 bp, Homo sapiens
  misc_feature: GYAE6OF01CR54X.36.39.D06.1.454.CMB.1.raw
  modified_base (307)..(307): a, c, t, g, unknown or other
  misc_feature (307)..(307): n is a, c, g, or t
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatcgacccagtcctccatccctcctgtcctgcattctggtaggcgaacagtacgtaccacctatccacgttcggccgagggccgagtcgaggtactattagaactaaacttatttaaattggtatacagcagaacgccgagggacncggaccctagctcgtgactcgtacgatcgtccttacgtaaagtttaacggaaaacggtacgggtaccctaagtacgtaacggtttcacgttagaaccgtaagtacgaacgttcggtaacgggtacttaagtttactttttacctagaacgttcaacttacccgacgtacgtccgtacgtaccgtaggttaacgtaaggtaagtactttaacgttacgtaacctaactttagtttaacgtttcgtaacgttaaactaccgttagtttccaacgtcgttacccttacccgttcccggttacccggtaaccggttcccgggaaacccggtaaacgggtaaacccgtaaagggggtaaccgttaaacgtaaaccgtaaacgggtacgttacggg

SEQ ID NO: 73197 - DNA, 717 bp, Homo sapiens
  misc_feature: GYAE6OF01CSNOX.36.39.D06.1.454.CMB.1.raw
  modified_base (221)..(221): a, c, t, g, unknown or other
  misc_feature (221)..(221): n is a, c, g, or t
tcagtacgctgtctcacgaccggtgctcgatttagtgacatctcgcagttctttgggggcaggagtcagtcccaaaccaggacacagcatggacatgagggtccctgctcagctccgtgggctcctgctgctctggctcgtcaggtgccagatgtagacatccgagatcgacccagttcctccacttccctcccttgtctgctatcgtgtacggccgtaanaggtactccaacctataccgacgttcgaccgaggacgtacgtacgaggactagttacgaaacttaaacgtttaatttaaaagttggtactacgaacgacgaaacggaacgccggtaagggtaccggtcccggtaaccccttaggccttcccgtaagttaacttccgaacgtcgttatcccgtttaacctaaagtttaacgggaaaacccgtaggtacccaagttaaccgtaaggttctagcgtaaacgacggttacagttcgtaaggtactagtttaacttttactctagtacctacacctacgccgtacgtcacgtatacggtaataacggttaatacgtacgtactaaacgttacgtttctttacgtacgttaactacgttacgttccgactttaggtaaccccttcccggttacccgtacggttacccggttaccgaaccggtaaccggtaacgtaaacggtaacggtaataaccgaaaccggttggtaccgg

SEQ ID NO: 73198 - DNA, 789 bp, Homo sapiens
  misc_feature: GYAE6OF01D5KMU.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatcgaccctagtcctccatccctcctgtctgctatcgtgtacggcgacagacgtccaacctatccacgttcgaccgaggtcgagtaccaggtactattacgaactaacttaagtttaaagttggtaactcgagtacgaagaacgaccgagggacgtaccggaccctaaggtcctcgtagacgtacgtacgatcgtaccttacgtaagttaacgaaacgtaccgggtaccaagtacgtaagttcgagtacgacgtaacggttcgagttacgtagggtaactaacgttttacttttaccgtttacgaaacgttaccgtaacttacccgaaccgaccgttacccgttacgacccgttacggttacgttaacggtaaacggtttaacgttaacgttaaccggtaacttaaaccgttacttttaacgttttaaccggttacttaacccgtaaaccgtttcggtttacggtaccgtttaccgttaccggttaccccctttaccccgggtaacccggttaacccgggtttacccgggaaacccgggtaaaaccgggggttaaacccggtaaaacggggttttaaaccggaaaaacccggtttaacccggtaaaaccggttacggttacccggggg

SEQ ID NO: 73199 - DNA, 833 bp, Homo sapiens
  misc_feature: GYAE6OF01A9AID.36.39.D06.1.454.CMB.1.raw
  modified_base (246)..(246): a, c, t, g, unknown or other
  misc_feature (246)..(246): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgaccctagtcctccactccctccctgtctgctattcgtaggtaggagacaggactaccacctattcgtcgttggtccgggngagtgacgtatagttgtacttaaagtttacgtttacgccgttaggtactacgacgtacgaacgggaacgaaccggtaaggggtaacgttaccggtttacccgttaaacggtccgttaccgttacggtaactttacgttaacggttcggtacccgttaccggtacccctttacccggtttacgtttttaccggaccggttacggtttacccgggtacccggggttacccttaacgtttcccgggtttccggttacggttacgggttacggtaacccgttaaggggttcggtaacggttccgggttaacggggtaaccttacggtttacctttacccgtacttacccgtacctacccgtagtaccgacgtacgtaccgtacttacgaccgtcgtaaccgtaaggttacgtacgttacgttaccgtaaactttaacgtttacgtttaagtaacggtttaaaacctaaaagttaaccgttaacgtacggttacccgtacccggttaccgtttcccttaaccgggttaacccgggtttacggggaacccgggttaacgggtaaacccgggtttaagggtaaggtaaacccgg

SEQ ID NO: 73200 - DNA, 909 bp, Homo sapiens
  misc_feature: GYAE6OF01DW1SJ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctccgtgggctcctgctgctctggctctcaggtgccagatgtgacatccagatcgacccagtcctcctactccctccctgtcctgcctatcgtgtacggcgaacagacgtaccacctatcacgttcgccgaggccgagtcgaggactagttacgaactaaacttaagttttaaacgttggtatacgaagtacgaaggaacgaccggaagggtacgtacccggacccttaaggccttacctacggtactaccgtaacggtactcgtacctttaaccgtaaagtttaacgggaaaaccggtacggggttaccctaagttaacggtaaggttaccgaaggtacgtaacgtaaacgttacggtaacgttacggtaacggggtaaccttaacggttttaaccgttttttacgttaaccgtaacgtaacctaaccttaacccgaaccccgtaacggttcccgttacggacccgttaacggtttacccgttaaacggtaaaagttaactttaacggttaccgtaaaacctttaaaccgtttaactttttaaaccgtttttacccggttaaacgtttaacccggttaaaccgttttaaccgggttttacggttacccgtttaaacgggtttaccccgtttaccccccggttttaacccccggtttaccccggggttaacccggggtttaaccccggggtaaaaccccgggtaaaacggggggttaaaacccccggtaaaggggggttaaaacccggtaaaaacctttacccggggaaaaaaccggtttaacccggggtttaccggg

SEQ ID NO: 73201 - DNA, 969 bp, Homo sapiens
  misc_feature: GYAE6OF01APJUM.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccaagatcgacccagtctccatccctcctgtctgctatcgtagtacggcgactagagtaccaccgtatcctacgttacgcccgagggaccggaacggtacgaacgggtaactaacgtttacggaaaaccttaaaacctttaaagtttttaaaaacgtttcggggttaaacttaccgtaacgggaaccgaaacggggtaaaaacggcccggtaaaagggggtacccgtaccggggtaaccccccttaaacgggtccccttacccggttacggtaaaccttaccgtttaaaccgggtaacttcggttaacccgtttaaacccgttaaaaggtttttaaaccgggtaaaaaacccgggtacgggggttaaaccccctaacgttaaccggtaaacgggtttaccgtaagtttaccggaaccgttaacgggttacgtaccgttcgggtaacgggtaaccgttaagttttaaccgtttttacgtttaccgtaacggtacctaacttacccggtaaacctaccgggtacccgttaggtaaccgtaacggtttaccgttaacgggtaaacgttaacggtttaaacgtttaacgaaaccccggttttaaattaaccttttaaacgtttttaaccggttaactttaacccgggtttaaattacggggttttaccgtacccgtttagaacccgtttccccggtttacccccgttaaccccggggttaccggttaaccccgggtaacccgggaaaaccgggttaaccggtaaacgggtaacggtaaaaaccgttaaccggtaaaaaccggttcgttaaccgggg

SEQ ID NO: 73202 - DNA, 882 bp, Homo sapiens
  misc_feature: GYAE6OF01DOGLQ.36.39.D06.1.454.CMB.1.raw
  modified_base (227)..(227): a, c, t, g, unknown or other
  misc_feature (227)..(227): n is a, c, g, or t
tcagtacgctgtctcacgaccggtgctcgatttagtgacatctcgcagttctttgggggcaggagtcagtcccaaccaggacacagcatggacatgagggtccctgctcagcctcctggggctcctgctgctctggctctcaggtgaccagtatgtgacatccagatcgaccctagtcctccacttccctcctgtcctgctatcgtagtacggcacagactccaccntctacttcgccgaggcgtacgtacgacggactattacgaacttaaactttaatttaaacgttgtactacgaacgacgaacggaacggaccggtaggggtaccgttcccggaaccccgttaacggtccctaccgtaggtaaccttccgtaaacgtacgttaccgttacctttaaccgttaaaaggtttaaacggtaaaacccgggtacccggggtttaccctaacgttaaccggttaaaggtttccgtaacggtaccggtaaacggtaacggtttcggtaaacgttcgggtaacgggtaacttacggtttttaacctttttaaccgtacgtaacgttacctaacgttaccccaacccgttcggtacccgtacggtacccgttaggttaacccttaagggtaaactttaacgtttaacgtaaccgttaaccttaaacgtttaacttttaaccgttttcgttaaccgttaaaccgttacgttttacggtttacccgttacgttaaccggtttaccctttacccccgtttaaccccgggttaccgttaacccgggggtttaccccgggtaaaacccgggtaaacggggttaacccggttaaaacggggtttaaaaccggaaaccggttaaaccggttaaaccggtacgggtttaccggg

SEQ ID NO: 73203 - DNA, 667 bp, Homo sapiens
  misc_feature: GYAE6OF01BSTMF.36.39.D06.1.454.CMB.1.raw
tcagtacgctgtctcacgaccggtgctcgatttagtgacatctcgcagtttctttgggggcaggagtcagtcccaaccaggacacagcatggacatgagggtccctgctcagctccgtggggctcctgctgctctggctctcaggtgccagatgtgacatccagatcgacccagtcctccactccctcctgtctgcatctggtaggcgacagagtcacctatcatcgacaggacgagtcgaggactagttagaactaactttaatttaaagttggtaatcgaagtaccaaggaacgcgagggactccggacccctaagcctaccgtagtactacgtaacgattcgtaccttaactaagtttacgaaaccggtcgggtaccagtacgtaaggtcaagtcgactagtcgtatcgtacggtatagtttacttttacgtactacgtactactaccgaaccgtagtcccgtgacgttacgtacgtaggtaattacgttatcgaaccttaaccgtagttttactttaccgttacgttaacctacgtttacgttgtaccgttacttaccgttcccgttacccggtacccgggttaccggtttacccgggaacccgttaaacggggaaccgttaacgggtaacgtaaaactaccggaaaccgttcggttaacggg

SEQ ID NO: 73204 - DNA, 664 bp, Homo sapiens
  misc_feature: GYAE6OF01D56AT.36.39.D06.1.454.CMB.1.raw
  modified_base (199)..(199): a, c, t, g, unknown or other
  misc_feature (199)..(199): n is a, c, g, or t
  modified_base (357)..(357): a, c, t, g, unknown or other
  misc_feature (357)..(357): n is a, c, g, or t
tcagtacgctgtctcacgaccggtgctcgatttagtgacatctcgcagttctttgggggcaggagtcagtcccaaccaggacacagcatggacatgagggtccctgctcagctccgtggggctcctgctgctctggctctcaggtgccagatgtagacatccagatcgacccagtcctcctactccctcctgtctgctntcgtgtaggcacgagacgtccacctatctacttcggaccgaggccgacgtacgacggtacctagttacgaaacttaactttaagtttaaagttcggtactacagacgtaaggacgaccggagggtacgtccggaccctagcctcgtagtactcgtagntcgtaccttactaagttaacgaaacgtcggtaccagtacgtagtcgagtcgacgtagtcgagttacgtagacttagtttactttactcgatacgactaccgaccgtagtcctacgacgtacttacgtaagtaatacgttaatcgtaacttagttatttactttacgtaacgttacgttaagttcgtttcgaccgttagtaccctttccccgtccccggttacggtacccggtaccgggtaaaccccggtaagggttaaacccggtaaaggttaacccgaaaattaacccggtaaatgggttacccgg

SEQ ID NO: 73205 - DNA, 759 bp, Homo sapiens
  misc_feature: GYAE6OF01B4T6K.36.39.D06.1.454.CMB.1.raw
  modified_base (339)..(339): a, c, t, g, unknown or other
  misc_feature (339)..(339): n is a, c, g, or t
tcagtacgctgtctcacgaccggtgctcgatttagtgacatctcgcagttctttgggggctctgggagaggagccccagccctgagattcccaggtgtttccattcagtgatcagcactgaacacagaggactcaccagtggaggttgggactagtaactgggttatttttccgttttggactttaagttttaaaaggtgttacctaggttgtgaagcgcagtcgtggtggagtcggtgggggagtcgttggtacgaggccggggctacggtcccagacgtaccgttctccgtggtcgctacggttctacgtggtacttccgttacgtttggtaagttnttttcggacctagtcgtaccgtacggttccggggtccggtacgtaacggttacccgggaagggggtaaccgggtccgttagggtaacgggttcgggtaccttaacgtaacgttagttaccgagttaaggtaaagttaggttaggtaaggttagttacgggttagtcggacggtacttggtaggtacgggacgggtcgtattaccgtacctacgtacctacgaagtacgaaccgaaaccgacctaaacgtacccgtaccgtacgttacgtactacggaactaaggtaacgaaccgttgtaaccgtgaaagtcggtactaggaaccgggtacgttaaccggtcttaacggttacgtttacgaggttaaccggaagttaacggtaattaactaacgtacgttaacgacgttaggtacttaacg

SEQ ID NO: 73206 - DNA, 649 bp, Homo sapiens
  misc_feature: GYAE6OF01EY87G.36.39.D06.1.454.CMB.1.raw
  modified_base (321)..(321): a, c, t, g, unknown or other
  misc_feature (321)..(321): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatccctcctgtctgcatcgtgtacggcgacagacgtcacatcacttcgaccgaggcgagtacaggactattgaactaattactttaaattcggtatcgagctagacgacgagggtatccggtaccctaagctctgtactcgactntcgtcttaacgaatttagaaacgtcggtaccctataccgtaaggttcagtgacgtaagtcgtacttcggtacggaacttaaggttacttttacgttactagtacctaacgtcctaaccgtacgtcccgtgtaccctagtacgtaacggtaattaacgttgtacgaacctaactttaacgttcgtttttaatacgttaacctaacgggtttattaccggttcttccggtaaacctttcccgttaaccccgtcggttaacccggtcccggtaaccgggtaaaccgggtacgtaaacgggtaagtaaaccaccgtaaaggtacgttacggg

SEQ ID NO: 73207 - DNA, 606 bp, Homo sapiens
  misc_feature: GYAE6OF01CY3BU.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgaccctagtcctccactcctccctgtctgcatctgtaggcgacagagtcaccatcacttcgccgaggcgagtcgaaggactagttacgaactaaactttaattttaaagttggtatcagtacgaagtaacgccgagggacgtccggaccctaaggcctaccgtagtactcgtaacgactacgtacctttacgtaaagtttaacggaaaacggtacggggtaccctaagtacgtaacggttcgacgtacgactaaggtcgagttcggtagggaacttagtttaactttttactacgacgtacctataccaccgcgtcccttgactacggttactaggaactattagtacgactaacttattacttctagtactagtgttcgctacgtactccgtccgtacgtcggtcgacgaacggacgtacggtaagaatacgaagtgtcg

SEQ ID NO: 73208 - DNA, 655 bp, Homo sapiens
  misc_feature: GYAE6OF01B06LM.36.39.D06.1.454.CMB.1.raw
  modified_base (247)..(247): a, c, t, g, unknown or other
  misc_feature (247)..(247): n is a, c, g, or t
  modified_base (454)..(454): a, c, t, g, unknown or other
  misc_feature (454)..(454): n is a, c, g, or t
tcagtacgctgtctcacgaccggtgctcgatttagtgacatctcgcagttctttgggggcaggagtcagtcccaaccaggacacagcatggacatgagggtccctgctcagctccgtggggctcctgctgctcgtggctctcgaggtcgccagatgtgacatccagtatacgacccagtcctacctacttccctccctgtctgacctattcgtagtacgcgacgagactacaccatctactgaccgngacgagcagactattacgaactaacttatttaaagttggtactacgacgagaaggaacgccggaggagccggaccctagcctaccgtagacgtacgacgtacgtacgtacttactaaagtttaacgaaaaccgtcggtaccctagtacgtaaggtactagtacgacgtaagtcgagttcgaggtaactaacggtttatttacgttanacgtacacgtaccgacctagtccgtgtacgtacgtacgtagtaactaattcgtacgaacttaacgtatttacgttacgtagttaaccgtacgttgttacgttacgtctaccttaccccgtaccggttacccgtacggttacccggaacggtaacggtaacccgttaaagggaccgtaaaacgtaactaaacggtggtacgg

SEQ ID NO: 73209 - DNA, 659 bp, Homo sapiens
  misc_feature: GYAE6OF01BFB1F.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtcctccatccctccctgtctgcatctgtaggcgacagagtccaccatcacttcgccgaggcgagtcaggactattagaactaaacttattttaaagttggtatacagacaagaacgccgagggacgtcggacccctaagcctacctgtactctacgatcgtacttacctaagtttaacgaaacgtacgggtacccagttacgtaacggttcgagtcgacgtaaggtcgtagttacgtagggtacttaacgtttaatttttaccgttacgtacgtacgtacttaccactacgtcctgactacgtacgtagtaattattagtacgtaactaacttacgtttactttacttacgttaacctaacgttcgttacgtacgttactaccgttccgtacccccggttaccggtacccgggttaccggaacccggtaaaccggggtaaccgtaacgggtaacgtaaaacgtaaccggtaaaaccgtacggtacggg

SEQ ID NO: 73210 - DNA, 787 bp, Homo sapiens
  misc_feature: GYAE6OF01C7RIZ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtcctccactccctccctgtcctgcctatcgtaggtaggccgacaggtacgtccacctatccacgttcgccgaggcgagtacgaggactattacgaactaacttaatttaaattggtatcagacgaagaacgccggaagggactaccggacccctaagtccttaccgtagtactacctaacggtactcgtaccgtttacctaaagttttaaccggaaaaccggtaccggggtaccctaaacgttacggtaacggttacgaggtacgaaccgtaaggttcgtaagttaccggtagggtaaccttaaggttttaacgtttttaccgttacgtaacgtacttaacgtaccgtaaccctacggtaccctacggtaaccgtacgttaccgtaaggtaacttaagtttaacgttaacgtaaccttaaacgtttattttaactttccggttaattaaccgtaacgtttacggtttacgtaccgttacgttacccgttccccgttacccgggtaaccccggttacccgggttaacccgggaaacccgggtaaaccggggtaaaccggtaaacggggtaaacggttaaaacccgtaaaccgaaaaccggggttacgttaccgggg

SEQ ID NO: 73211 - DNA, 790 bp, Homo sapiens
  misc_feature: GYAE6OF01D9JZ3.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatgacccagtctccatccctcctgtctgcatctgtaggcgactagagtcaccatcacttgcctaaggcgagtcaggacattgactaactattaaatggatcagcagaagccaggatcggacccctaagctaccgtagtactactacccggtattacgtactttaacccgaaagtttacggtaaaaacccgtaacgggggttaccccaaatttaccgaaacgggtttacccgtaaaggttacgtaccgttaaacggttaccggtaagttaccctttgggggtaaacccttaacggttaactttttaaccgtttttaccgaaacggttaccgtaaacctaccgttaaccccgacgggtaccccgttagtaccggtaaacggttaccttaacggtaaaggtaaccgttaagtttacgtaacccgttacctaaacgttaaacggttttacctaacggtttaaccgtaaacccggtttgttttacggttaccggtttacccgtaaacttcccgggttaccccgttaacccgggttaacggtttaccccgggtaaacccggtaaaggggtaaccccgtaaacgggttaaacgggtaaaaaccttcgttaaaaacccgggaacttttaaaccgggg

SEQ ID NO: 73212 - DNA, 737 bp, Homo sapiens
  misc_feature: GYAE6OF01CJGA8.36.39.D06.1.454.CMB.1.raw
  modified_base (155)..(155): a, c, t, g, unknown or other
  misc_feature (155)..(155): n is a, c, g, or t
  modified_base (217)..(217): a, c, t, g, unknown or other
  misc_feature (217)..(217): n is a, c, g, or t
tcagtacgctgtctcacgaccggtgctcgatttagtgacatctcgcagttctttgggggcaggagtcagtcccaaccaggacacagcatggacatgagggtccctgctcagctccgtggggctcctgctgctctggctctcaggtcgccagatgngacatccagatcgacccagtcctccactccctccctgtctcgctattcgtaggtacggcganaggacgtccaaccatccacgttcgaccgagggcgtacgtacgaacggtactagttacgaacctaaactttaagttttaaattggtatcgagacgaaggaacgccgaaggggacctccgggtacccctagtcctacgtagtacgtccgtagattcgtacctttacgtaaagttaacggaaaaccggtccgggtacctaacgttaacggtaaggttacagggtaacgtactaacgggtacgtacgttacgggtaaggtaaacttaggttttaacctttttacgttacgtaacgtacctaacgttaccgaacccgtcgtacccgttacgacgtacgttacgtaagtaacgttagttaacgtacgaaccttaatacgtttacgttttaacgacttaacgtacttaccgttgtaccgtacgttacccttcccgtaccccggttagggtacccgtttacccggggaacggttaaccggtaaccgggtaaaggtaaccgaaagtaaaccggtacgtaacgggttcgg

SEQ ID NO: 73213 - DNA, 770 bp, Homo sapiens
  misc_feature: GYAE6OF01C43YW.36.39.D06.1.454.CMB.1.raw
tcagtacgctgtctcacgaccggtgctcgatttagtgacatctcgcagttcgtttggggggcaggagtcacgtccccaaccaggacacagcatggacatggacgggtccctgctcagcctccgtgggcctctgctgctcgtggtctcgtacgaggtcgccgtagtatggtacaacctactacccgaaggactccggaaaccccgtacgttccctaccctaccttccccggtccctttggacttcgaccttaagttccggttagggtaacggaccgaacgaacggtacctaccaaacctctaccggtacgtacggaccgaggacgtacgacgagtactagtagtaactaactttaattaagtgtacagacgagaagaccggcgaaggtacgtcccggaccctagtccgtacgagtacacgtagctacgtacctaacgtaaagttaacggaacccggtcgaactaactaggtacgttgacggtacaagtacgtactacggtagtacgtacgtttaacgtttacgttttacctataacgaccttaaccctaaccgaccgtaacgtcccgtaaggtagtaaccggtttaacgaagttaaacgttactaacgttaacgtaacttaacgttaatttccgtacttaaggtaccgtttaattcggttaccatttcccggaacctttccccggtacccgttacgggtaacccggtacccggaaacggtaacggtaacgtaaggttaaacccgggaactttaacgggaacgttggtaccg

SEQ ID NO: 73214 - DNA, 804 bp, Homo sapiens
  misc_feature: GYAE6OF01CQYHN.36.39.D06.1.454.CMB.1.raw
  modified_base (159)..(159): a, c, t, g, unknown or other
  misc_feature (159)..(159): n is a, c, g, or t
  modified_base (184)..(184): a, c, t, g, unknown or other
  misc_feature (184)..(184): n is a, c, g, or t
  modified_base (594)..(594): a, c, t, g, unknown or other
  misc_feature (594)..(594): n is a, c, g, or t
tcagtacgctgtctcacgaccggtgctcgatttagtgacatctcgcagttcgtttgggggcaggagtcagtcccaaccaggacacagcatggacatgacgggtccctgctcagctccgtgggctcctgctgctcgtgctctcaggtcgccgagatgtanactacaccgagactcgaccagtccncctactccctccgtgtctcgactactgtaggtacggaccgaagaggtacgtaccaacctacttaccgtacgttcggaccgacggtacgtaacgtaccgtaacggtacttaagttaacgaaaccttaaaacgtttaaatttttaaaaggttcggtaaactacggaacgaacgaaacgtaacggacccggtaaggtaccgtacccggaaccctaaccgtctacccgtaagtacgttaccgtaagtacgttaccttaccgttaacggttaaagttaaacgggaaaccggtacggtacctaagtacggttaacgtacgtagtacgtaacgtacgtaggtacgtacggtacggtaacttacgtttacgtttaccgagacgttaacctacgtaacccgtacgtaccgtccgttaanccgttagtaaccggttaagtaacgttacgttaacgtaactaaaccttacgtttaaatttcttacgtaacttaacgttacgtttcgttactaccgtacgttacccttacccgtccccgggttaaggtttccgaaacccgggaccgggtaaaaacgttccgggtaaaacggtttaacaaaacccgtaaacggttaaggtaacccggttaggg

SEQ ID NO: 73215 - DNA, 761 bp, Homo sapiens
  misc_feature: GYAE6OF01C42D3.36.39.D06.1.454.CMB.1.raw
  modified_base (318)..(318): a, c, t, g, unknown or other
  misc_feature (318)..(318): n is a, c, g, or t
tcagtacgctgtctcacgaccggtgctcgatttagtgacatctcgcagttctttgggggcaggagtcagtcccaaccaggacacagcatggacatgagggtccctgctcagcctcctggggctcctgctgctctggctctcaggtgccagatgtgacatccagatcgaccagttcctaccacttcctccctgtcctgactatcgtgtaggccgtacaggacgtaccaccatccgacttcggccgaggcgtacgtacaggactagttacgaactaaactttatttaaagttggtatgagacaacggaagccgaagggcnccggaccctaaggcctcgtgactactacgtagtcgtacctttaacgtaaagttaacgaaaaacggtcgggtaccctaagttaacgtaacggttacgacggtagaaccgtaggttaccgtaacgttcggtaaggggtacctaaggtttaactttttaaccttcgaaccgtacgtaactacccgtaccgtaccgttccgtacgtaaccggtactttaaccggtaagtaaacgttaactttaacgttaccgtaacttaaatttaacgtttactttcgttaccggtttaactaagtttacgtttacacggttacccgttacgttacccccgtttaccccggtaccggtttaacccgggttaaccgggtaaacccgggtaaaccggggtaacccgtaaaagggggttaaccgtaaactaaacccggtaaacggttacggttaaccggg

SEQ ID NO: 73216 - DNA, 773 bp, Homo sapiens
  misc_feature: GYAE6OF01EM7FZ.36.39.D06.1.454.CMB.1.raw
  modified_base (657)..(657): a, c, t, g, unknown or other
  misc_feature (657)..(657): n is a, c, g, or t
tcagtacgctgtctcacgaccggtgctcgatttagtgacatctcgcagttctttgggggcaggagtcagtcccaaccaggacacagcatggacatggagggtccctgctcagctccgtgggctcctgctgctctggctctcgaggtgccagatgtgacactccagatcgacctagtcctccactcccttcctgtctgactattcgtggtacggcacgtaggacgtacccaaccgtattccgacgttccgaccggtagggacgtacggtacgaaggtaactaacgttacgaaacttaaaacttttaagttttaaaaggtcggtactacgaacggaacgaaagggaaccgccgggtaagggtaccgtaccccgggtaaccccttaaggtcctttaccgtaggtaccttaccggtaacgtacttccgttacctttaaaccgttaaagtttaaccgggaaaacgtccgggtacctaaggttacgttaaacggtctaggcggtaacgtagtacgtacggtcggtagtaaacttacgtttaacgtttactacgactactacgtaccgaccgtacgtcgttacgaccgtagtccgtaagtaacgttgtaacttcgaaacttaacttagttttacttactacgtttaactaacgtttggtttacncgttaaccgttcttaccccccggttacccgttccgtaacgggttacccggaaccgggtaaaccggtaaacggttaacggaaaccgttaaaacgaaccgttaacggtaggtaccggg

SEQ ID NO: 73217 - DNA, 688 bp, Homo sapiens
  misc_feature: GYAE6OF01C6ND8.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtcctccactccctccctgtctgcatcgtagtacggcgacagacgtccaccatcacttcgccgaggcgagtcaggactagttacgaactaaactttaagtttaaattggtactccgaagacgaacggaacgcccgaaggggacgtaccggacccccttaaggccttaccgtagtactccgtaacgtatcgtacctttacgtaaagtttacgaaaacgtccgggtaccaagttaccgaaggtttcaggttagaccgtaagtacgtattcggtacgggtaactacgtttaactttttacttaccgagtacaacttaccgaccgtacgccgtagaccgtagttaccgtaagacgttaattacttacgaactaaacgttatttacgtttctacgtaaccttagttagtttcgacttaccggtaccttccccgtacccgttccgggttaaccggttacccgggaaccgtaaacgggtaaccgtaaaggggttaactaaacggtaaccgtaaaggttgttacgg

SEQ ID NO: 73218 - DNA, 895 bp, Homo sapiens
  misc_feature: GYAE6OF01COWK5.36.39.D06.1.454.CMB.1.raw
  modified_base (184)..(184): a, c, t, g, unknown or other
  misc_feature (184)..(184): n is a, c, g, or t
tcagtacgctgtctcacgaccggtgctcgatttagtgacatctcgcagttctttgggggctctgggagaggagccccagccctgagattcccaggtgtttccattcagtgatcagcactgaacacagaggactcacatggagttgggactgaactggtattttcctttgcttaatttaaaggtntccagtgtagagcgacagctggtggtagtcggtgggggagtcgttggtacaggccgggctacggtccctgacgtacctctccgtgtcgactagtctcgtggtacttacctactttagaagttagtttcgacctagtcgccgtacgtcgggtccggactaacgttccggaagggtacggtccttaggtaggtcgggtactacgtaacgttagttacgtcgtagtaaacgttaggttaggttaaggttaggttaggggtttacgtacggtaccgggttaaccgtttggttacgggtacgggtaaccggggtacccgttaacgtttaccccgaaccttacggttacccccgtaacggtaaacggaacccggtaaaacccgaccccggtaaacccgtaaaaccggttaccccgttaaccccggttaacgtttaaccgttacccgtaacggttaaaaccctaaaaggttacccgtaaaaccgttacgggttaaacgtccggggtaaacgtaccggttacccgggtaaggggtaaaacccggttaccccgggttaaaccgggttttccccgtttaacgggttttaaaccgtttaccggttaacggggttaaacccggttaaaaaccggtaaaaccgggtttaaactaaaacccgtttaaaccgtttaaaccggtaaccggttaaccgggttttccgggtaaaccttttaaacccggg

SEQ ID NO: 73219 - DNA, 776 bp, Homo sapiens
  misc_feature: GYAE6OF01DBHLG.36.39.D06.1.454.CMB.1.raw
tcagtacgctgtctcacgaccggtgctcgatttagtgacatctcgcagttctttgggggcaggagtcagtcccaaccaggacacagcatggacatgaggtccctgctcagctctgggctcctgctgctctggctctcaggtgccagatgtcgacatccagatcgaccctagtcctcctatccctccgtgtctgactacttcgtggtacggcgactagacgtaccactactccacgttcgccgaggacgtacgtacgacggtactagttacggtaactaaacgtttaagttttaaacgtttcggtaactaccgaacggtacgaaacggtaaccggacccggtaaggggtactacccgggtacccttaaggtccttacccgtagtacctacgtacgtattacgtacctttaacgtaaacgttaacggaaaacggtccgggtacctaacggttacgtaacggttacgaggttacgacggtaacgttcggtaacgttcgtacgggtaacttacgttttaacgttttactaccgtaagaccgttaactacctaccggtacgtacctaccgtacgtagttaccgtaagtaagttactacgttacgtaacctaacttacgtttaactttacgtacgttaactacgtttacgttacgttaccgttacgttcccgttacccgttaccccggtttaccgggtaccggttaaccgggtaacccggtaaacgggtaacggttaaacgggtaaccgtaaacccgttaacggaaccgttacggttaccgg

SEQ ID NO: 73220 - DNA, 674 bp, Homo sapiens
  misc_feature: GYAE6OF01AP757.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtctccactccctcctgtctgctatcgtggtaggcgacgagtacgtccaccatcctacttcgccgaggcgagtacgaggtactagttacgactaaacttatttaagtcgtatgacgtacgaggaacgtcggtaaggacgtccggtacccctaagccttacgtgtactaccgtacgtagtactccttaaccgtaaattaacggaaaccggtcggtaccctaagtaccgtaagtcgagtcgacgtagtcgagtcggtacggtactagttatttacgtcgtactctactacgaccgtcgtaccgtgtactacgtcgtaagtacgtattaacggtctaacgtaacttacgttaccttacgtataacccgttagttacgttacgtccggtactacccgttcccgtacccggttacccgggtaacggttacccggtaaccgggtaaacgggtaaccggttaaagggtaacccggtaaaaccgtccggtaaaacgttgggttaacccggg

SEQ ID NO: 73221 - DNA, 642 bp, Homo sapiens
  misc_feature: GYAE6OF01C8KU9.36.39.D06.1.454.CMB.1.raw
  modified_base (176)..(176): a, c, t, g, unknown or other
  misc_feature (176)..(176): n is a, c, g, or t
  modified_base (411)..(411): a, c, t, g, unknown or other
  misc_feature (411)..(411): n is a, c, g, or t
tcagtacgctgtctcacgaccggtgctcgatttagtgacatctcgcagttctttgggggcaggagtcagtcccaaccaggacacagcatggacatgagggtccctgctcagctccgtggggctcctgctgctctggctctcaggtgccagatgtgacatccagatgacccagtccnccatcctcctgtctgcatctgtaggcacagacgtcacatcacttgaccgaggcagtcaggactatcgaacaaactttaatttaaagttggtatacgaagacaacgaagccgagggtactccgggacccctaagcctctacgactctacgtatgtaccttactaagttacgaaaacgcgggtaccagtcgaaggtcagtgactagtacagtcgtaggtactagtttaatttactanacgtctaactaccactacgcttagacctacgtagtaacgaagttaatttacgtaacgtacctaaactttacgtttaacttttcgtacgttaaccgtacgttagttttacgacgtacgttacccttacccgttcccgttaccggttaacccgggtttcccggaaaccggttaaaccggggtaaccgttaaacgggttaccgaaaagtaacccggtaaaacgtacggtacggg

SEQ ID NO: 73222 - DNA, 701 bp, Homo sapiens
  misc_feature: GYAE6OF01DMZG8.36.39.D06.1.454.CMB.1.raw
  modified_base (197)..(197): a, c, t, g, unknown or other
  misc_feature (197)..(197): n is a, c, g, or t
tcagtacgctgtctcacgaccggtgctcgatttagtgacatctcgcagttctttgggggcaggagtcagtcccaaccaggacacagcatgacatgagggtccctgctcagctccgtgggctcctgcctgctctgctctcaggtgccagatgtgacatccagatcgaaccctagttcctccacttccctccctgtccngctatcgtaggtaggaccacgagactccacctatcctacgttcgaccgaggacgagtcaggactagttacgaactaaactttaattttaaagtaggttactacgtaagaccgtaagaacggaccggtaagggtaccgtacccggtaccccttaacgtcccttaccgtacgtactaccgtaacgtacttacgtcctttaaacgttaaagtttaacggaaaaccggtccgggtacctaagtaacgtaacgttacagtacgacgtagtactagtcgtaggtaacttagttactttacgtacagcctactaccaccatcctgtacgtagttagagtaagtattacgtacgtaactaattatttacttacgttactaacgttagttcgttacgtcttacgtaccgtttaccccgtacccggttacccggttacggttacccgaaccgggtaaaccgggtaaaccgtaacgggttaaaacgaacttaaaccggtaaacgtccggttaagg

SEQ ID NO: 73223 - DNA, 720 bp, Homo sapiens
  misc_feature: GYAE6OF01A2EAB.36.39.D06.1.454.CMB.1.raw
  modified_base (170)..(170): a, c, t, g, unknown or other
  misc_feature (170)..(170): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcagtcgccagatgtgacatccagatcgaccngtctccatccctcctgtctgcatctggtagcgacgagactccacatccacgttgacccgtaggacgtagtacgacggtactattacggaacctaagtttaattttaaagttcggttaattaccgaagcgtaaaggaaccgtccggtaacgggtacgtaccggacccctaaaggtccctaccgtagtacgtaaccgttaccgtattaccggttaaccttacgtaaacgtttaacgaaaaccggtccggggtaacctacggttaacgtaacggttacgtacggtacgtacgtaaacgtcgtacgtacgtacgggtaactaacgtttaattttaccgttacgtaagtcctaagtaccgtaacgtacccgtaccgtagtacccgtaggttacgtaacgtaagttaagttacgtactaaccgttataacgtttacttacgttacgtaactagttaaccgtcgtactaccggttacctaccgtcccgttaccgtaccggttacgacccgtaaacgggactaacggtaacgtaaacctaacaaccggttacgtacgg

SEQ ID NO: 73224 - DNA, 673 bp, Homo sapiens
  misc_feature: GYAE6OF01EFHCI.36.39.D06.1.454.CMB.1.raw
  modified_base (206)..(206): a, c, t, g, unknown or other
  misc_feature (206)..(206): n is a, c, g, or t
tcagtacgctgtctcacgaccggtgctcgatttagtgacatctcgcagttctttgggggcaggagtcagtcccaaccaggacacagcatggacatgaggtccctgctcagctcctgggctcctgctgctctggctctcgaggtgccagatgtgacatccagatcgacccagtcctccactccctccctgtctgctatctgtagcanagactccactatcacttcgaccgaggcgagtcgaaggactattacgaactaacttaatttaaattggtaactcagtacagaacgccgaaggacgtaccggaccctaagcctacctgtactctagatcgtaccttaactaagtttaacggaaacgtcgggtaccacgttacgtaacggttacgagtcgaacgtacggtacgtacgttacggtaacggtacgttacgttttaccttttacttacgtaacgtacctactaccgaacctacgtcccgtgacgtacgttacgtaagtaagttatacgttacaacttaaacgttatttacgtttacgtacttaacgttaacgttcgtttcgtacgttactacccgttccccgtaccccggttacggtaacccggttaccggaaccggtaaccgggtaaaccgtaacggttaacgtaaacctaacgtaaaacgtcggttaccgg

SEQ ID NO: 73225 - DNA, 599 bp, Homo sapiens
  misc_feature: GYAE6OF01BZ48V.36.39.D06.1.454.CMB.1.raw
  modified_base (458)..(458): a, c, t, g, unknown or other
  misc_feature (458)..(458): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggcgacagacgtcaccatcacttgccaggcgagtcaggacatgaactaattaatttaaattggtatcagcagaagccgagggatcggaccctaagctcctgatctagtatgaccttacaaatttacgaaacgtacggggtacccagtacgtaacggttcaggtacgacgtaagttcgagtcgtacgggaactaggttattttacttactagtactactcaaccgtagtcctagtccgtagtctaagaacgtaattcgtaanacctaatatttactttacgtacgttactaacgttgttacgtcgttactaccgtttaccctcccggtaccgtacccggttaccggacccggtaacgggaaaccgtaacggggttaacgaaacgtacaaaacggtcgtacggg

SEQ ID NO: 73226 - DNA, 780 bp, Homo sapiens
  misc_feature: GYAE6OF01B2HUH.36.39.D06.1.454.CMB.1.raw
  modified_base (762)..(762): a, c, t, g, unknown or other
  misc_feature (762)..(762): n is a, c, g, or t
tcagtacgctgtctcacgaccggtgctcgatttagtgacatctcgcagttctttgggggcaggagtcagtcccaaccaggacacagcatggacatgagggtccctgctcagcctccgtggggctcctgctgcttcgtggctctcgaggtcgccagactgtcgaacatccgagactcgaccctagttccctctaccttccctccgttgtcctcgctacttcgtacggtacggaccgaagacggtaacctacccaacctactccgtacgttcggaccgagggtacgtagtacgaaggaccttagttaactaacgttaaactttaagttttaagtcggtaactacgacggacgaaggaaccggtcggtaacgggtaccgtacccggtaaccccttaaggtcccttacgtacgtaacttccgtaacggtcttaccgtaaccctttaagttaaacgttaaacgggaaacccggtccggttaaccaggtttaacggtaacggtttaccgacgggttaccgaagtaaccggtcgttaaccggacggtttaacgggtactttaaacgttttactttaaccgtacacgtaacctacgtaccgtacgtaccgtcgtagaacgtaccgttaggaattaagtactttacgaataacgttacttagtttacttactacgtacgttacgttagtccgtagttaccctaccttccccgggttaccgtacggtcccggttaaccggaaccgggtaataaccgggttaagaccgtaaanaaccggtacgttggtacg

SEQ ID NO: 73227 - DNA, 937 bp, Homo sapiens
  misc_feature: GYAE6OF01DKFO6.36.39.D06.1.454.CMB.1.raw
  modified_base (241)..(241): a, c, t, g, unknown or other
  misc_feature (241)..(241): n is a, c, g, or t
tcagtacgctgtctcacgaccggtgctcgatttagtgacatctcgcagttcgtttgggggcaggagtcagtcccaaccaggacacagcatggacatgaggtccctgctcagctcgtgggctcctgctgctctgctctcgaggtcgaccagagtgtgacctactaccgagataccgacccctagttcctaccctaccttcccgtcccgttagtcctgactattcgtaggtacggaccgtaanacggtactacccaaccgtactaccgtaccttcggacccgagggtacgtagtacgtaacggtaactagttaacgtaaaccttaagtttaaagttttaaacgttggtaacctaccgtaacgaccggaaagtaaaccggccggtaaacggggaccgttaccccggtaaccccgtaagttcccttaccgtagtaacccgttacgtaaacgtcgttaccggttaaccttttaaccgtaaacggtttaaaccggaaaccgggttcccggttaaaccctaaggttacccggttaacggtactacgggtttagaaccggttaacgtcggtaacgtggtaacgttaattacgttttaacgttttaccgacgtaacgtactaaccgtaacccgtaccgtccgtaccgtacgtacgtacgttacgtaacgtaacgtaacgtttacgtaaccgtaacttaaaccggttttaacttttacgtttaaccgttacgttaaacccgtttacggttttacggtaaccggttacccgttaaaccggtttacccgttacccccggtttaacccccgggtacccggggtttaaccccgggttaaacccccgggtaaaaccggggttaaaccccgggttaaacccggttaaaacggggttaacccgggttaaaacccgttaaaccgggtaaaacccgggttcggtttaaacccgggg

SEQ ID NO: 73228 - DNA, 787 bp, Homo sapiens
  misc_feature: GYAE6OF01CZV0U.36.39.D06.1.454.CMB.1.raw
tcagtacgctgtctcacgaccggtgctcgatttagtgacatctcgcagttctttgggggctctgggagaggagcccagccctgagattcccaggttgtttccattcagtgatcagcactgaacacagagactcaccatggtagtgggactgaacttggtatttttcctttaggtctttaagttttaaaaggtcgtacctaggtagtagaagcgacaggtcgttgggtagggagttcgggtagggggacggtcgtttggaccgtaggcccgggacgtacggttcccgaggacgtaccttccgttccgtgtacgctacgttccgtgtacggtactttaccgttaaccgtttagaaacgtttacgtttccggacctagttacggtccgtaacggttcgggtaccggacgtaacggttaccgggaaggggtacggttccgtttgggtacggttggtacctacgtaatttagtacgacggtaaggttaacgtgttagggtttaagttaggtggttagtcggtacggttacttcggtagggaacggtacgggtacccttaagtcctaccgtaacgtccgtaacgaaaggaaccgtaaaccacccggaactaaacccgtaaccgttcccttaagtaaccgtttacgaccgttaaaataagttaccgaaacgttacggttacgtaaggacgtacggtacggacgaaaccggtacgtacccgttagttagtaacgtttacgaggttaaacgaaggtaattaacctataacgtacttagaacgttcggactttaaag

SEQ ID NO: 73229 - DNA, 709 bp, Homo sapiens
  misc_feature: GYAE6OF01AVGE5.36.39.D06.1.454.CMB.1.raw
  modified_base (154)..(154): a, c, t, g, unknown or other
  misc_feature (154)..(154): n is a, c, g, or t
  modified_base (161)..(161): a, c, t, g, unknown or other
  misc_feature (161)..(161): n is a, c, g, or t
  modified_base (204)..(204): a, c, t, g, unknown or other
  misc_feature (204)..(204): n is a, c, g, or t
  modified_base (515)..(515): a, c, t, g, unknown or other
  misc_feature (515)..(515): n is a, c, g, or t
  modified_base (610)..(610): a, c, t, g, unknown or other
  misc_feature (610)..(610): n is a, c, g, or t
  modified_base (689)..(689): a, c, t, g, unknown or other
  misc_feature (689)..(689): n is a, c, g, or t
tcagtacgctgtctcacgaccggtgctcgatttagtgacatctcgcagttcgtttgggggcaggagtcagtcccaaccaggacacagcatggacatggagggtccctgctcagctccgtgggctcctgctgctctggctctcgaggtcgccagntgtgacntccagatcgacccagttcctccactccccgttccgtgtacgtnctatccgtaggtacggcgtacaaggtaccgtaccacctaattccaaccgttcgaccgagggcgtacgtacgacggtactagttacgtaactaactttaattttaagttaggtactacgacgtacgaaggaacgcggaggtacgtaccggtacccagtcctccgtagtactaccgtaggtactcggtaccttacgttaaacgtaacgtaaacggtccgggtaacccaagtacggtagttacgagtacgtaacgacgtggtactacgtacgggaacttaacggttttcttttaccgtacgtactacgtaaccnccgttaaccgacgttccgtaacgcggttaattccgggtaataacgtacgtttactacggtaactacttaagtttcttaccgtaatacgtaacgtntttcggcttacctcgttaccccgtccgttaggtaaccctcgggaaaccgacccgggaagttaacggtacggttaaaacncgggtaaaaccgtggtccgg

SEQ ID NO: 73230 - DNA, 876 bp, Homo sapiens
  misc_feature: GYAE6OF01DY5H5.36.39.D06.1.454.CMB.1.raw
  modified_base (861)..(861): a, c, t, g, unknown or other
  misc_feature (861)..(861): n is a, c, g, or t
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgaacactaccagatcgaccctagtcctccactccctcctgtctgctatcgtagtacggccgaacaggtactaccacctatcctacgttcgaccgaggcgtaacgtcgaacggtaactaagttacgaaaccttaaagtttaaattttaaagttaggtaatacgaacgacaacggtaacggaccggaaacggggtacgtacccggtacccgtaacgtcccttaccgtagtaaccttaccgtaagtacgtacgttaacctttaaccgttaaacgtttaaacggaaaaacggtaccggggttccctaaacgttaaccggttaaggttaactaaggtaccgtaaacgtaaccgtacgggtaacttacccgggttaaggggaacctttaagtttaactttttaaccgttacgaatacccttaacttacccgaaccgtaccggtacccttagggacccttaacggtttacgtaaacggaaatttaacgttaacttagaacctaaacgtttacgtttaacctttccgtaagttaaacccggttaatttacggtttacgcccgtttaacgttaaacccgtttaccccccggtttaccccgggtaaaccggttttacccgggttaacccggggaaaacccccggttaaaagggttaaaaaccccgggttaaggggtaaaaacccttaaaacccggttaaaaaccgttaaaaccccgggngggtttaaacccggg

SEQ ID NO: 73231 - DNA, 729 bp, Homo sapiens
  misc_feature: GYAE6OF01BJGD7.36.39.D06.1.454.CMB.1.raw
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
  modified_base (543)..(543): a, c, t, g, unknown or other
  misc_feature (543)..(543): n is a, c, g, or t
  modified_base (562)..(562): a, c, t, g, unknown or other
  misc_feature (562)..(562): n is a, c, g, or t
tcagtacgctgtctcacgaccggtgctcgatttagtgacatctcgcgaggttcgtttgggggcaggagtcacgtcccaaccaggacacagcatggacatgaggtcctgctcagctccgtgggctcctgctgctcgtggctctcgaggttcgaccagtatcgtacgactactccgagtactcggaccctagttcctccgactccctcccgtgttcctgcctagtccgtggtacggcaacagcgtaccacctatcctacgttcgccgaaggctaaggtcaaggactagttacgaaacctaatttaactttaacgttggtactacgtaacgacgtaaacggacggaccggagggtacgtccggacccgttaanccgtacctanacttcaacgtntcgtacttaaccgtaagtttaaccgaaaaggtccggttaccaaggtacgtacggttacgtaggtacgaactaaggttcgacgttacggtacggtaacttaacggtttacttttaacgtcgtaagtacctacgtacccgactcgtacgttacnccgttagtacgtataactnttaacgtcgaactacgtaatttcgtttactcgtaacgtaactttcggttctacgtttacgtccgtttcccgtcccgttaaccggtaccgggtttccggaaacccgggtacgggttaaaccgtagggttaaacccgtaaacggaacgttaaaaccggtcgttaccggg

SEQ ID NO: 73232 - DNA, 833 bp, Homo sapiens
  misc_feature: GYAE6OF01E3OS7.36.39.D06.1.454.CMB.1.raw
tcagtacgctgtctcacgaccggtgctcgatttagtgacatctcgctagttcgtttggggggcaggagtcagtcccaaccaggacacagcatggacatgagggtccctgctcagctccgtgggctcctgctgctctggctctcgaggtcgccagatgtacgacagtccagactcgacctagtcctacctacttccctcctgtctcgactgtaccgtaggtacggacgaacaggtacgtaccaccgtatcctacgtcggaccgacgggtacgaacggtacgaacggtactagttacgaaacttaaacgtttaattttaaggtcggtaatacgaacgacgtaacggaaccggacggtaacggggtaccgtacccgggtaaccccttaaggacccttacggtaacgttaacttaccggtactaacgtttccgtaaccgtttaaacgttaaacgggtttaaacggaaaacccggggttcggtaaccctaagggttaacggttaacggttcgaaagggtacccgtaagtaacggtacggtacggttcgggtaaggtaactttaaccgttttaacttttacgtacccaggttacctaacgtcccgtaacggtcctacggttacggacgttaaacggttaccgtaaagtaacgtttacgtataaccgtaaaccttagtttacgtttaacgtttacgttacttaacgttaagtttcgttcgtacgttccttacccgtttcccgacccggttaccggttaacccgggtaccggtaaacggggaaaccgttaaccgggtaaggttaaacccgaaactttaacccgggaaggttcccggtaagg

SEQ ID NO: 73233 - DNA, 783 bp, Homo sapiens
  misc_feature: GYAE6OF01CO01M.36.39.D06.1.454.CMB.1.raw
  modified_base (92)..(92): a, c, t, g, unknown or other
  misc_feature (92)..(92): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (409)..(409): a, c, t, g, unknown or other
  misc_feature (409)..(409): n is a, c, g, or t
  modified_base (578)..(578): a, c, t, g, unknown or other
  misc_feature (578)..(578): n is a, c, g, or t
  modified_base (585)..(585): a, c, t, g, unknown or other
  misc_feature (585)..(585): n is a, c, g, or t
tcagtacgctgtctcacgaccggtgctcgatttagtgacatctcgcagttcgtttgggggcaggagtcacgtcccaaaccaggacacagcanggacatggacggtccctgctcagctccgtgggcctcctgctcgctcgtggtcctcgtcgaggtcgccgaagtcgtaggtcgaactactccgaagacgtaccgacccgtactcctccctaccgttcccctcctntccgtnacctattccgtaggacgacgaacgtcgaacgacacctacgtccgtaactcggcggacggtcgtaacgacgaggtacaagttacgaaacttaattttaagtttaagtcgatacagaacgacgtaacgtcgaaggttaccgacccgtacctagtcctagtagaccttacgtataaccgtnttacctaaacgttaaaggtaaacccggaacgggttcccggtaactagtaaccggtaagttcgagttacccggaagtacgtaccggtaaggtgttaacggtaccgttaagtttactttaactgtaaccgtacacctacgacctaacggctacgtacgtattaacggtaanaacgttntaacgttaacggtaaaccttactttaacggtttacctttacgttacgttaaccttaggttaccttaagttcccggtacttcccccggtaaccccgtacccggggttacccttaccgggggaaacccgtaccccggggtaaagttaacccgggtaaacgttaaacggaaacctttaaccggaaagggtccgttaacggg

SEQ ID NO: 73234 - DNA, 799 bp, Homo sapiens
  misc_feature: GYAE6OF01D0LAD.36.39.D06.1.454.CMB.1.raw
  modified_base (164)..(164): a, c, t, g, unknown or other
  misc_feature (164)..(164): n is a, c, g, or t
  modified_base (418)..(418): a, c, t, g, unknown or other
  misc_feature (418)..(418): n is a, c, g, or t
  modified_base (476)..(476): a, c, t, g, unknown or other
  misc_feature (476)..(476): n is a, c, g, or t
tcagtacgctgtctcacgaccggtgctcgatttagtgacatctcgcagttctttggggggcaggagtcagtcccaaccaggacacagcatggacatgacgggtccctgctcagctccgtggggctcctgctgctctggcctctcgaggtcgaccagtatggtanactactaccaaggtatcccggaaccctagttccctaccctacttccccttcccgtagtctcggctacttcgtagggtacggacgtacgaagtaccgtaccaaccattccgtagttccgacggtaagggcgttacgacgaacggtatacgttaacgaaccttaaatttaagtttaagttagtactacgtaacgagaaacggacggtacggacggtacgtacccgggaaccctagcccttatataaccgtcgtaancttccgtaacttacgtaagttaaccgaaccggtacggtccaagttaacggtagtacgngtacgtataacggtcgagtcggtagtacgttatttacgttactacgtcctactacgtacctactccgtaccgtcgtacgtacggtaacgtaagttacgttagtttaacctacgttaactaaacgtttctttaaaccgttttcgacgttttaacctacggtttacggtaacctttacgggttaaacctccccgttttacccggtacccccgggttaaacgggttaccccccgggtttaaacgggaaacccggggttaaaccggttaaacgggtaagggttaaaaaccttaacggttaaaccgggtaaccgtaggtttacccggg

SEQ ID NO: 73235 - DNA, 699 bp, Homo sapiens
  misc_feature: GYAE6OF01D91XR.36.39.D06.1.454.CMB.1.raw
  modified_base (673)..(673): a, c, t, g, unknown or other
  misc_feature (673)..(673): n is a, c, g, or t
tcagtacgctgtctcacgaccggtgctcgatttagtgacatctcgcagttctttggggggcaggagtcagtcccaaccaggacacagcatggacatgagggtccctgctcagctcctggggctcctgctgctctggctctcgaggtgccagatgtgacatccagatcgaccctagtcctcctacttccctccgtgtcctgctattcgtggtacggcgaacgagtacgtaccacctattacctacgtcgaccgaggcgagtacgaggtactagttacgaactaaattaattttaagttgtatcgagactaaggacgcggtaggtacgtaccggtaccctacgcctcgtagactactacgtatcgtaccttactaacgtttaacgaaacggtaccgggtacctacgtaacgtaggttacaggtactacgtagtacgtagtacgtacggtaacttacgtttactttacttacgtagtacctactactacccgtaccgtccgtacgacgtacgttacgtaacggtaatactttaacgtacgtaactaattactttacgtttacttacggtaacttacggttagttcgtacgtttacgtacccttaccgtaccccggttacggtacccggttaccgggaaaccgtaacgggtaaaccggttaacggaaacggttaaanacccggttaaaacggtcgtaccgggg

SEQ ID NO: 73236 - DNA, 823 bp, Homo sapiens
  misc_feature: GYAE6OF01EYDQW.36.39.D06.1.454.CMB.1.raw
  modified_base (132)..(132): a, c, t, g, unknown or other
  misc_feature (132)..(132): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctntggctctcaggtgccagatgtgacatccaagatcgacccagtcctccactccctccgtgtctgactagttccgtaggtacggacgaactagtagtaccacctactcaacgttcgaccgagggcgaacggtcaagggtactaagttacgaaacctaaacttttaagttttaaagttcggttaatacggaagacgtaaaggaacggacccggtaaggggtacctcccggtaacccctaacggtcccttaccgtagttacttaccgttaacgtcttaccggttacctttaaccgtttaaaggtttaaaccgggaaaaccgggttacccggggtaaccctaggttaaaccgttaacggttcgtaaacggttacgaacgtaacggtttacggacggttacggtaacgggtaaccttaagttttaaacgtttttacgtaacgtactaacttacctaccgaacctacgtcccgtaggtcttaacggtattaacggtaactagttacttaccgtaattaaccttagtttatttaccgttacgtacttaaacgtttgttacgtacgttaccgtacccgttacccgtccccggttacgttacccgggtaacccggtaaaccgggtaaaccgggtaaacccggtaaaacgggttaacggaaaaacccgtttaaccgggtaaaaccggtccggtttaaccggg

SEQ ID NO: 73237 - DNA, 817 bp, Homo sapiens
  misc_feature: GYAE6OF01AQR44.36.39.D06.1.454.CMB.1.raw
tcagtacgctgtctcacgaccggtgctcgatttagtgacatctcgcagttctttgggggcaggagtcagtcccaaccaggacacagcatggacatggagggtccctgctcagctccgtggggctcctgctgctcgtggctcgtcgaggtgccagattgtcgacactaccgagactccgacccagttcctaccaccttccctcccttgtctgccagtcgtggtacggcgacagacgtcacctactccacttcggaccgaggcgtacggtcaacggtactagttacgaactaaactttaatttaaacgttcggtatacgacgtacgaacggacggaccgaagggtacgtacccgggtacccctaagtcccgttaccgtgtacttaccgtaacgtactccgtaaccgtttaacgttaaacgttaacggaaacggggtacccgggtaaccctaggttacggtaacggtcgtacgtacggaacgtaagtacgtacgtacggtacggtactaaggtttttaaccttttacgtagtacccgtaactcccgtaacccgtacgtacccgtacccggtttagacccggtttaagtcccgttaaaggaaagtttacggttaaccttaacgtaaccgttaactttacgttttaacctttaaccggtccgttaaacgttaacggtttcttaccggttccttaccggtacccctttcccccgggttacccgttaccccggggtacgggttaacccccggggaaggtaaacccggggtaacggttaaacgggtaacccgtaaaaccgtaaccggtaacggttccggttacgg

SEQ ID NO: 73238 - DNA, 750 bp, Homo sapiens
  misc_feature: GYAE6OF01BAVLI.36.39.D06.1.454.CMB.1.raw
  modified_base (628)..(628): a, c, t, g, unknown or other
  misc_feature (628)..(628): n is a, c, g, or t
tcagtacgctgtctcacgaccggtgctcgatttagtgacatctcgcagttctttgggggcaggagtcagtcccaaccaggacacagcatggacatgaggtccctgctcagctccgtggggctcctgctgctcgtggctctcgaggtcgccagtatgtgacatccgagctacgaccagtctcctactccctcctgtctgctactcgtggtaggcgacagacgtcacctatctacgtcgacgtaggcgagtacgaacggtactagttcggaacttaaacttagtttaaagtcggttatacgaggtaacacggtaacgaccggtaagggcgttacccggaccctaggtcctcgtaagaccgtacttacggattaccgttactttacgtaaagtttacggaaacggtaccgggtacctaagtacgtaaggttctggtaacgtcgtaagtccgttaagtccggtaggttaacgttaacgtttaccttttacgtacgtacgaccgtactacccgacgttaacggcctaacggtaccgttacggttataacggtaagttaacgtttacttaaccgtaacctaactttaacggttacttttaccgtaacgttctttaaacgggttcttaccgggtnttaaccgtcccgtttacccggttcccgggtacccggttacccggttaaccgggaaccggttaaccgggaaacggttcgggttaaactaaacgtaacccgttaaacggggagtttaacccggg

SEQ ID NO: 73239 - DNA, 786 bp, Homo sapiens
  misc_feature: GYAE6OF01BO35G.36.39.D06.1.454.CMB.1.raw
  modified_base (538)..(538): a, c, t, g, unknown or other
  misc_feature (538)..(538): n is a, c, g, or t
tcagtacgctgtctcacgaccggtgctcgatttagtgacatctcgctagttcgtttgggggcaggagtcagtcccaaccaggacacagcatggacatgacgggtccctgctcagctccgtgggctcctgctgctcgtggctctcgaggacgtccgagtatgtacgaccacgtaccgagtactaccggaaccctagttccctaccgtaccgttcccttccccgtggtcctcgccgtacgttcggtacggtacgggacgtaacgacggtacgtaccaacctacgtccgtacgtacggaccggaggacgtacgacgaaggtaactagttaacaacttaaacttaagtttaacgtaggtactacgaacgaacgtaaggaaccgccggtaacgggaccctacccgtagtaccgtctaggtacctaacgtacgtaccgttccttacgtaaccgtaacgtaacggtaaaccggtaccgtacaacgttgtaaacggtcgtagtacgacgtaagtacgtagtacggtaggtactagttttaaccttntacgtacgactaaccgtaccaacgggtacctactaccgggtacttaccgtaggttaaccgtaattaaccgtagttaacgtaactaaaccggtttataccgttacccttagaacgttaaccttaggtaccttcgggtaccttaaccggtcccgtacccggtttacctaacccgggggtaacgtaaccgggtaccgtaaacggaacgtttaaaaccgaacgttacggtaacggtaccggtgtaaacccgg

SEQ ID NO: 73240 - DNA, 475 bp, Homo sapiens
  misc_feature: GYAE6OF02IK7FU.36.39.D06.1.454.CMB.1.raw
tcagtacgctgtctcacgaccggtgctcgatttagtgacatctcgcagttctttggggcaggagtcagtcccaaccaggacacagcatggacatgagggtccctgctcagctcctgggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttccaattgaaaacaggggtcccatcaaggttcagtgcaagtcgatctgggacagattttactttcagcatcaccagccttgcagtctgaagatattgcaacatatttctgtcaactagttgctgatctcctcgacgttcgccaaggaccaaggtggaaatcgaaacgatgg

SEQ ID NO: 73241 - DNA, 517 bp, Homo sapiens
  misc_feature: GYAE6OF02IZQUS.36.39.D06.1.454.CMB.1.raw
  modified_base (320)..(320): a, c, t, g, unknown or other
  misc_feature (320)..(320): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttccaattgaaaacngggtccatcaaggttcagtgcaagtcgaatcgtagggacagtattttactttcagtcatcaccagcctgcagtctagaagtatattgactaactattactttctgttactaactagtttgacttgtacttcctcccttccgaccggttcggacccgaaggacccgtaagggtacgaaagtaccaaagtacgttacgg

SEQ ID NO: 73242 - DNA, 482 bp, Homo sapiens
  misc_feature: GYAE6OF02GF925.36.39.D06.1.454.CMB.1.raw
  modified_base (370)..(370): a, c, t, g, unknown or other
  misc_feature (370)..(370): n is a, c, g, or t
  modified_base (396)..(396): a, c, t, g, unknown or other
  misc_feature (396)..(396): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactattaaattggtatcagcagaagccagggatggcccctaagctcctgatctacgatgcttccaatttgaaaacaggggtccatcaaggttcagtgcaagtcgatctgggacagattttactttnagtcatcaccagcctgcagtctgaanatattgacaactattatttctagtcaactagttgctgatctccctccgtacgtcggccaaggaccaaggtgaaatcaacgatacgg

SEQ ID NO: 73243 - DNA, 589 bp, Homo sapiens
  misc_feature: GYAE6OF02H0EAT.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatccctccctgtctgcatctgtaggcgacagagtccaccatcacttgccaggcgagtcaggacattgacaacttatttaaattggtatcagcaagaagccgagggatcggcccctaagcctcctgatctacgatcgcttacctaagtttagaaaacgtacggggtacccaagtacgaaaggttcaagttgacaagtcgtatcgtgggactagtatttttacttcagtcactcaccagctgctagtctagaaagtacttagttgactaaactatttaactttctagttacaaacgttagtttcgacttagactttcctccccgtaccggttaaccggtttccgggaacccgtaaacgggggtaccctaaacggggttaggtaaaaaccgtaaccgaaaccgttaacgttacggg

SEQ ID NO: 73244 - DNA, 553 bp, Homo sapiens
  misc_feature: GYAE6OF02GGOIJ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacggagtcaccatcacttgccaggcgagtcaggacattgacaactatttaaattggtatcagcagaagccagggatggcccctaagctcctgatctacgatgtcttaccaatttagaaaacgaggggtacccaatcgaaggttcagtgacaagtcgatctagggacagtattttacttcagtcatcaccagcctgcagttctagaagtatattgacaactattatttctagttactaactagtttagcttagtacttccttcccgttaccgtaccgtttacccggaccgtaaacgggtacccgtaacgggttacggtaaacgtaccgtaaaccggtacgtaggttaccggg

SEQ ID NO: 73245 - DNA, 570 bp, Homo sapiens
  misc_feature: GYAE6OF02JCZXV.36.39.D06.1.454.CMB.1.raw
  modified_base (366)..(366): a, c, t, g, unknown or other
  misc_feature (366)..(366): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagagcaggatggcccctaagctcctgatctacgatgcttccaattgaaacagggtcccatcaaggttcagtgacagtcgatctgggacagtattttacttnagcatcaccagccttgctagtctagaagtatattacgactaaacgtattaagttttcctaggttacctaaaccgttgttttacgactttagtactttacccgttccccgtttacccggtaacggttttcccgggaaccccgtaaaggggtaacccctaaaggggttaccggaaaagtacccgtaaaaccggtacttaaccgggg

SEQ ID NO: 73246 - DNA, 501 bp, Homo sapiens
  misc_feature: GYAE6OF02ISO2P.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttccaatttgaaacaggggtcccatcaaggttcagtgcaagtcgatcgtagggactagattttacttcagtcattcaccagcctgcagtctagaagattattgacaacattatttctgtctaaactagtttgcttgacttcgtccctcagtaccgttcggccaagggaccaaggtacggaactacgaaacgtaacg

SEQ ID NO: 73247 - DNA, 527 bp, Homo sapiens
  misc_feature: GYAE6OF02HMIP3.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggcgacagagtcaccatcacttgccaggcgagtcaggacattgacaactatttaaattggtatcagcagaagccagggatggcccctaagctcctgatctacgatgcttccaattgaaacaggggtccatcaagttcagtgcaagtcgatcgtgggactagtatttttacttcagtcatcaccagcctgcagtctagaagatattgactaactattatttctgtactaaactgttttgcttgacttcccgttccctacccggtacgtttccggacccgtaaacggggtacccaaagggttacggaaactaccgaaacggtaacttacggg

SEQ ID NO: 73248 - DNA, 518 bp, Homo sapiens
  misc_feature: GYAE6OF02GIMUO.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttcaattagaaacagggtccatcaaggttcagtgacaagtcgatcgtgggactagtattttacttcagcatcaccagcctgctagtctagaatattattgactaactattatttctagttactaaactagtttcgcttagacttccgtcccttccgtaccggttccggaccgaagggtacccaagggttacgaaactacgaaacgtactacgg

SEQ ID NO: 73249 - DNA, 533 bp, Homo sapiens
  misc_feature: GYAE6OF02JU78V.36.39.D06.1.454.CMB.1.raw
  modified_base (448)..(448): a, c, t, g, unknown or other
  misc_feature (448)..(448): n is a, c, g, or t
tcagtacgctgtctcacgaccggtgctcgatttagtgacatctcgcagttctttggggcaggagtcagtcccaaccaggacacagcatggacatgagggtccctgctcagctcctgggctcctgctgctctggctctcaggtgccagatgtgacatccagatgacccagtcctccatcctccctgtctgcatctgtaggcgacagagtcaccatcacttgccaggcgagtcaggacattgacaactattaattggtatcagcagagccaggataggcccctaagctcctgatctacgatgacgttccaagttagaaactaggggtcccatctaaggttcagtgacaagtcgatcgtaggactagtattttactttcagtactatacaccagtcctgacagtctagaatatatgactaatagttatttctagtactaacgtagtttcgnttcgtactaccgttcccgttaccgtaccgttcggaccgaacgggtaacccgaagggtacggaaactaccgaacgtaacgttacgg

SEQ ID NO: 73250 - DNA, 528 bp, Homo sapiens
  misc_feature: GYAE6OF02HXAVW.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtccaccatcacttgccaggcgagtcaggacattgacaactatttaaattggtatcagcagaagccagggatggcccctaagctcctgatctacgatgcttacaatttagaaaacaggggtacccatcgaaggttcagtgcaagtcgatctagggactagtatttttacttcagctatcaccagcctgcagtctagaatattattgacaatattatttctagttacaacttagtttgcttgtattcccgtcccttcccggtacggttccggacccgtaagggacccgtaagggtacggaaactacgaaacgtacttacggg

SEQ ID NO: 73251 - DNA, 590 bp, Homo sapiens
  misc_feature: GYAE6OF02F8I9C.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattgtatcagcagaagccgagggatcggacccctaagcctcctgatctacgatcgtcttacctaaatttagaaaacgtacggggtacccaatacgaaggttacagtcgacaagtcgaatcgtgggaactagtattttacttcagcatcaccagcctgactagtacagaatatagttacgactaacgtattaacttttctagttacctaaacttaggttttacgaccgttagtacgtttcccgttaccccgttacccggtaaccggtttcccggaacccgtaaacggggtacccaaaggggttaacgaaacgttaccgtaaaaccggtacttaacggg

SEQ ID NO: 73252 - DNA, 542 bp, Homo sapiens
  misc_feature: GYAE6OF02GPMRK.36.39.D06.1.454.CMB.1.raw
  modified_base (259)..(259): a, c, t, g, unknown or other
  misc_feature (259)..(259): n is a, c, g, or t
  modified_base (373)..(373): a, c, t, g, unknown or other
  misc_feature (373)..(373): n is a, c, g, or t
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatgacccagtctcatcctcctgtctgcatctgtaggcacagacgtcaccatcacttgccagcgagtcaggacattcgacaactattaaatgtatcgancagaagccaggatcggaccctaagctctgatcctagatgcttccaatttagaaacgcgggtacccatcgtaaggtcagtgacaagtcgaatcgtagggactagtattttacttnagtacatacaccagcctgctagtctagaatatattgactaatattatttctagtactaagtagtttagcttagacttcccttcccgttacccggtacggttttacccggaccgtaacggggtaaccctaagggtaacggtaaacttaccgtaaaccggtaacttacggg

SEQ ID NO: 73253 - DNA, 526 bp, Homo sapiens
  misc_feature: GYAE6OF02JYDTK.36.39.D06.1.454.CMB.1.raw
  modified_base (373)..(373): a, c, t, g, unknown or other
  misc_feature (373)..(373): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcagtcaggacattgacaactatttaaattggtatcagcagaagccaggatggacccctaagctctgatctacgatgcttccaatttcgaaaacacgggtcctatacaagttcagtgcaagtcgatctgggactagtattttacttcngctatcaccancctgcagtcngaagtntatgacaactattactttctacgttacgaaacttagtttcgacttacgtacttcctccccgttaccgacggtttccggaccgtaagggaccctaagggtacggaaataccgtaaaccgagttacgg

SEQ ID NO: 73254 - DNA, 643 bp, Homo sapiens
  misc_feature: GYAE6OF02IP38B.36.39.D06.1.454.CMB.1.raw
  modified_base (320)..(320): a, c, t, g, unknown or other
  misc_feature (320)..(320): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatccctccctgtctgcatctgtaggcgacaggacgtccacatcacgtcgaccgaggcgagtacgaggactagttacgaactaaacttaatttaaattggtatacgagcaagaacgcgaggacgtcgacctaagctctagatcantgtctactaataagaaacgtcggtaccagtacgtaaggtactagtacgacgtaagtcgtaatcggtacggtaacgtaagtttacttttaacttacgacgtactactacgaacctacgtcctacggtactacggttactaggtaagtaagtttacacgtaacctaaacttatttaccgttttaacgttacgtaactaaacgtttaagttacgaccgtttgaacctttcccgtaccccgtttaccggtaaccggtttacccggaaccggtaaacgggtaacctaaaggggttaacgaaaccgtacgaaaaccggttagtaccggg

SEQ ID NO: 73255 - DNA, 518 bp, Homo sapiens
  misc_feature: GYAE6OF02IQ48V.36.39.D06.1.454.CMB.1.raw
  modified_base (316)..(316): a, c, t, g, unknown or other
  misc_feature (316)..(316): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (447)..(447): a, c, t, g, unknown or other
  misc_feature (447)..(447): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttaccaattanaaaacgaggggtacccatacaaggttcagtgacaagtcgatcgtagggacagtattttacttnagtcatcaccanccttgcagtctagaagattaattgactaaacattatttctagttacaactagtttncttgtattcctccctccgtacggttccgaccgtaagggacctaaggtaggaaactacgaaaccgtatacgg

SEQ ID NO: 73256 - DNA, 565 bp, Homo sapiens
  misc_feature: GYAE6OF02IATCX.36.39.D06.1.454.CMB.1.raw
  modified_base (321)..(321): a, c, t, g, unknown or other
  misc_feature (321)..(321): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcacagagtcaccatcacttgccaggcgagtcaggacattgacaactatttaaattggtatcagcagaagccagggatggcccctaagctcctgatctacgatgcttaccaatttgaaaacngggtacccatcaaggttcagtgcaagtcgatcgtgggactagtatttttacttcagcatcaccagcctgctagtctagaaagtatagttacgactaactaattatttctagttacaaacgttagttttcgacttacgtaacttcccgttccccgttacccggtaaccgtttcccgggaaccctaaacgggggtaccctaaaggggttacggtaaaactttaccggaaaaccggtacgttacggg

SEQ ID NO: 73257 - DNA, 534 bp, Homo sapiens
  misc_feature: GYAE6OF02HCYSQ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgactctacgatgcttaccaatttagaaaacgaggggtacccatcaaggttcagtgcaagtcgatcgtgggactagtacttttactttcagtcatccaccacgcctgcagtctagatatattgactaactattatttctagttacaaacgttagtttcgctacgtattccgttcccgttccgtaccggtttccggaccgtaacgggaccgtaagggtacggaaataccgaaacgacgtacgg

SEQ ID NO: 73258 - DNA, 565 bp, Homo sapiens
  misc_feature: GYAE6OF02GP92L.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctacctgactctacgatgtcttaccaatttagaaaacacggggtaccatcaaggttcagtgcaagtcgattctagggactagtattttacttcgagtcattcaccagccttagcctagttccagtaacgtataagttgacaactattactttctagttactaactagttttcgacttgtacttacccttcccgttaccggtacggtttacccggtaccggtaacgggtaacccgtaaggggttacgaaaccgtaacgtaaaccggtaacttaccggg

SEQ ID NO: 73259 - DNA, 574 bp, Homo sapiens
  misc_feature: GYAE6OF02GH3QL.36.39.D06.1.454.CMB.1.raw
  modified_base (319)..(319): a, c, t, g, unknown or other
  misc_feature (319)..(319): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggcgacagagtcaccatcacttgccaggcgagtcaggacattgacaactatttaaattggtatcagcagaagccagggatggcccctaagctcctgatctacgatgcttcaatttgaaaacngggtcccatcaaggttcagtgacaagtcgatcgtagggacagtacttttactttcagtcaatcaccagcctgctagtctagaagtatattgactaactatttaatttcgtagttactaaacttagtttacgacttaggtacttcccgttccccgttacccggtaccggtttcccgggaaccccgtaaagggggtaacccgtaaacggggttaacgggaaaaccgttacccgtaaaaaccggtaacgttaacgggg

SEQ ID NO: 73260 - DNA, 664 bp, Homo sapiens
  misc_feature: GYAE6OF02IEQPH.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccactccctccctgtctgctatcgtgtacggcgacagagtccacatcacttcgccaggcagtcgaaggactattgaactaactttaatttaaattaggtataccagacgaagaacgccggaagggactccggacccctaagccttcgtagacttaccgtacgagttacgtacctttaccgtaaagttttacggaaaacccggttacggggtaccccttaaagtaccgttaaagggttcaagtcgaacgtaacggtcgaacgttacgtagggtactaggtttactttttactacgagtactaactactaccgagtcctagactttaggattagaaacgtattacgttacgaacctaagtacttttaacgttcttacgtaaccgttaaagttgtttaccgacttacgtacctttcccgtacccgttaccggtacggttacccggaaccgtaagggacccgtaaggtagtaaacctacggtaacgcgttacgg

SEQ ID NO: 73261 - DNA, 667 bp, Homo sapiens
  misc_feature: GYAE6OF02JQEEC.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtcctccatcctccctgtctgcatctagtagcgacagacgtcaccatcacttgccaggcgagtcaggactattcgaactaacttatttaaattggtatcgtagacgaaggaacgccgaagggtactccggacccctaagcctaccgtgactactaacgtactcgtaccttaccgtaaagtttaacggaaaaccggtccggggtaccctaagtacgtaaacggtttcaggttacgacgtaacggtcgtatacgtagggaactagttactttttacgtacgagtactacgttaccaaccgtacgtaccttacggtaccgtacggttaccgtaaagtaacgtagtttacgtaacgtaaccttaaacgttaactttacgtttaccgtacgttaaccctaaagtttagtttcgacttacgttacttcccgtcccgttaccggtccggttaccggaccgtaacgggaaccgtaggtaacgtaacgtaacgtaaacgtgtacgg

SEQ ID NO: 73262 - DNA, 573 bp, Homo sapiens
  misc_feature: GYAE6OF02I1LU2.36.39.D06.1.454.CMB.1.raw
  modified_base (455)..(455): a, c, t, g, unknown or other
  misc_feature (455)..(455): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggactattcgaactaacttaatttaaattggtatacagacaagaacgccgagggactcggacccctaagcctctgatctacgatgtccttactaattagaaaacgtacgggtaccagtactaacggttacagtgactaagtcgtacgtcgtagggaactagttaactttttacttagacgtctatccaccgtagccttggctagtctagaagtattagttanactaactattactttcagttaacctaacgttagttcgacttgtacttccctacccggtccgtacgttccggaccgtaacgggacaagggttacgaaactaccgtaaacgcgttacggg

SEQ ID NO: 73263 - DNA, 562 bp, Homo sapiens
  misc_feature: GYAE6OF02HVGQC.36.39.D06.1.454.CMB.1.raw
  modified_base (458)..(458): a, c, t, g, unknown or other
  misc_feature (458)..(458): n is a, c, g, or t
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatgacccagtctccatcctccctgtctgcatctgtaggcgacagagtcaccatcacttgccaggcgagtcaggacattgacaactattaaattggtatcagcagaagccgagggatggccctaagctcctgatctacgatcgcttacaatttagaaaacgcggggtccatacgaaggttcagtgactaagtcgatcgtagggactagtactttttacttcagtctactcaaccacgcctgcagtctagaatattaattgactaactattaactttcttacttactaactaagttttnaccgttgtaattcccctacccgttcccggtaacggttcccgggacccgtaaacgggacccgtaacgggtaacggtaaacgttaccgtaaaccggtattaacggg

SEQ ID NO: 73264 - DNA, 696 bp, Homo sapiens
  misc_feature: GYAE6OF02F75J5.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctcctgtctgcatctgtagcgacagagtcacatcacttgccaggcgagtcaggacattagaactaacttaatttaaattggtatcagacagaagccgagggatcggacccctaagcctaccgtgacttctaacgtatcgtacctttacctaaagttttacggaaaaaccgtacgggggttaccctaagtacgtaaacggttacaaggttcgacgtaaacgttcgaacttacggtacggggtaactaaggtttaactttttaacctttcgaagtacctaacttccaaacccgtaggtcccttaggtacctaaggttcttaaggaaacgtatttaactttacggaacttaaacctaagttttacttttaccgtagttaacctaaacgtttagttttacgacctttacggtaccttcccgttacccccgttaccggttaacccggtttcccgggaaccgtaaaccggggtacccgtaagggtaacggtaaaacctaccggtaaaaccggtacgttacggg

SEQ ID NO: 73265 - DNA, 608 bp, Homo sapiens
  misc_feature: GYAE6OF02JA8OR.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatccctccctgtctgcatctgtagcgacagagtcaccatcacttgccaggcgagtcaggacattgacaactatttaaattggtatcagcagaagccagggatggccctaagctcctgactctacgatcgcttaccaattagaaaacaggggtacccatacgaaggttcagtgacaagtcgatcgtggacagtattttacttcagtacatcaccagcctgacctagtctagaacgtatattgactaacgtattaacttttctacgttactaaactaggtttttacgtaccttaggtaacctttccgttaccccgtttaccccggtaaccggtttttcccgggaaccccgttaaaacggggggtaaccccgttaaaggggttaccgggtaaaaacgttaaccccggttaaaaaccgggtaaccgtttaacgggg

SEQ ID NO: 73266 - DNA, 495 bp, Homo sapiens
  misc_feature: GYAE6OF02F41YL.36.39.D06.1.454.CMB.1.raw
  modified_base (391)..(391): a, c, t, g, unknown or other
  misc_feature (391)..(391): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttccaattgaaaacaggggtcccatcaaggttcagtgcaagtcgatctgggacagattttacttcagcatcaccagcctgcagtcngaagatattgcaacattatttctgtcaactagtttgctgatctccctccgacgttccggccgaacgggtaccaagggtaggtaaactacaaaccgaacgtacgg

SEQ ID NO: 73267 - DNA, 748 bp, Homo sapiens
  misc_feature: GYAE6OF02IOVV0.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgaccccagtctccatcctccctgtctgcatctgtaggcgacagacgtccaccatcacttgccaggcgagtcgaggacattgaactaacttaatttaaattgtatcagacagaagcgagggactcggacccctaacgcctccgtagactactacgatcgtaccttacctaagttaacgaaaacgtaccggggtacctaacgtacgtaaaggtttcaacggtagtacgaaggttacggtaacgttcggtacggggtaacttaaggtttaacttttttaaccgttttaccaacggttacctaaccttaccgaaaccccgtacgtcccttaggtaccgttacggtttacccgtaaggtaaacgttaaactttacgtttaacggtaaccttaaactttaaccgttttaacgtttttaccgttaacgtttaacctaaacgttttacgttttcgtaccgttcggtaaccgttttacccttccccccgggtttaaccggtacccgggtttaacccggaaccgggttaaaccgggaaccggttaacggggttaaacgtaaaccgtaaccggtaaacccggttacgttaccggg

SEQ ID NO: 73268 - DNA, 679 bp, Homo sapiens
  misc_feature: GYAE6OF02GR8JM.36.39.D06.1.454.CMB.1.raw
tcagtacgctgtctcacgaccggtgctcgatttagtgacatctcgcagttctttggggggcaggagtcagtcccaaccaggacacagcatggacatgagggtccctgctcagctcctggggctcctgctgctctggctctcaggtgccagatgtgacatccagatcgacccagtctccatcctcctgtctgcatctgtaggcgacagagtcaccatcactgccaggcgagtcaggacagttacgaactaactttaatttaaatttggtactcagacaaggaacgccgaaggggactcggaccccgtaagtcctcctcgtatccgtaacgattcgtcctttacctaaagtttacgaaaaccgtacggggtacccaagttacgtaaaggtttcaaggtacgacgtaaggtccgtaagttcgtagggtaactagtttaactttttaactttcgaagtctactccaaccgtacgcccgttagaccgtaagttccgtaaggtaagttaattaagtttacggtaacctaaaccgttacgttttacttttacgtcgtttaaccaaacggttacgttttacgacttaggttaccttcccgttaaccccgttaccggtaccgttaccgggacccgtaaacggggtaaccttacggggttacgaaaccgtaccgaaacggttatacggg

SEQ ID NO: 73269 - DNA, 602 bp, Homo sapiens
  misc_feature: GYAE6OF02I26DY.36.39.D06.1.454.CMB.1.raw
tcagtacgctgtctcacgaccggtgctcgatttagtgacatctcgcagttctttggggggcaggagtcagtcccaaccaggacacagcatggacatgagggtccctgctcagctcctggggctcctgctgctctggctctcaggtgccagatgtgacatccagatgacccagtctccatccctccctgtcctgcattcgtgtaggcgacagagtccaccatcacttcgaccaggcgagtcaggacattgacaacttaatttaaattggtatcagcaaggaagccgagggatcggacccctaaggcctccgtgactctacgatcgctttacctaagttacgaaaacgtcgggtaccatacgtaacgttcaagtgactagtcgatcgagggactagtattttacgttcagtctataccaccacgtcctcgtacgtagtcgtacgaagtattagtttacgactaaactatttactttccgtagttacctaaacgttagttcgtattcgtacgttcccgttaccccgttaccgggtaccggttaccggacccggtaaacgggacccgtaagggtaaacgtaagtaaccgaaccgttaacgtacggg

SEQ ID NO: 73270 - DNA, 553 bp, Homo sapiens
  misc_feature: GYAE6OF02JC2ZT.36.39.D06.1.454.CMB.1.raw
  modified_base (373)..(373): a, c, t, g, unknown or other
  misc_feature (373)..(373): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagagccagggatggccctaagctcctgatctacgatgcttccaatttagaaaacacggggtcccatacaaggttcagtgcaagtcgatctgggacagtattttacttnagtcatcaccagccttgctagtctagtaagattaattgacgtaactacttaacgttttcttcgttactaaacgttagttttagcttagtacttccgtccccgttaccggtaccggttccgggacccgtaaacggggaccctaagggttacggaaacgttaccgaaacgtaacgttacggg

SEQ ID NO: 73271 - DNA, 484 bp, Homo sapiens
  misc_feature: GYAE6OF02FGPBX.36.39.D06.1.454.CMB.1.raw
  modified_base (395)..(395): a, c, t, g, unknown or other
  misc_feature (395)..(395): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctcctgtctgcatctgtaggcgacagagtcaccatcacttgccaggcgagtcaggacattgacaactatttaaattggtatcagcagaagccagggatggcccctaagctcctgatctacgatgcttccaatttgaaacaggggtcccatcaagttcagtgcaagtcgatctgggacagtattttactttcagcatcacagcctgcagtctgaagntattgcaacattatttctgtcaactagtttgcttgatctccctccgacgttcggccaaggaccaaggtacggaaatcgaacgactacgg

SEQ ID NO: 73272 - DNA, 602 bp, Homo sapiens
  misc_feature: GYAE6OF02JFNNA.36.39.D06.1.454.CMB.1.raw
  modified_base (206)..(206): a, c, t, g, unknown or other
  misc_feature (206)..(206): n is a, c, g, or t
  modified_base (305)..(305): a, c, t, g, unknown or other
  misc_feature (305)..(305): n is a, c, g, or t
tcagtacgctgtctcacgaccggtgctcgatttagtgacatctcgcaggttctttgggggcaggagtcagtcccaaccaggacacagcatggacatgagggtccctgctcagctcctggggctcctgctgctctggctctcaggtgccagatgtgacatccagatgacccagtctccatccctcctgtctgcatctgtaggccganagagtccaccatcacttgcctaggcgagtcaggacattgacaactattaaattggtatcagtcagagcaggatcggtccctaagctctgactctacgtntcgtcttactaattacgaaacgtacgggtacctatacgtaagtacagtcgacgaagtcgactcgaggactaggttaactttttacttcagtctaacttccgaacccgagtcccttgacctagttccgtaagtaacgtattagttacgactaactatttaactttccgtagttacaaacgttagtttcgtacttcgttacttcccgttcccgttaccgtacgggttcccgtaacccggtaaacggggtaccgtaaacggggttaacggtaaccgtaaccggtaacggtacgttacggg

SEQ ID NO: 73273 - DNA, 640 bp, Homo sapiens
  misc_feature: GYAE6OF02JBL3I.36.39.D06.1.454.CMB.1.raw
  modified_base (306)..(306): a, c, t, g, unknown or other
  misc_feature (306)..(306): n is a, c, g, or t
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatgacccagtctccatccctcctgtctgcatctgtaggcgacagagtcaccatcacttgcccaggcgagtcaggacattgactaactatttaaattggtatcagcagagcgagggatcggaccctagtctccgtagactctacgntgtccttacgtaattacgaaaacgtcggggtacccatacgtaacggttacagtcgacgtaagtcgaatcggtagggactaagtttacttttaccgtttacacgtactaactccaacccgacgtccctaggtactacgttcaaggtaacgtattagttacgacctaaacttactttacgttttactacgtttaccaaaccgtttgtttacggttaccgttagttacctttcccgttccccgttaacccggttccgggttaacccggaaccggttaaaccggggtaacctaaaggggttaccggaaaacgttaaccggaaccggtacgtttacggg

SEQ ID NO: 73274 - DNA, 707 bp, Homo sapiens
  misc_feature: GYAE6OF02G674M.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagcgaggactcggcccctaagctaccgtgatctacgatgtccttacctaagtttacgaaaaccgtacgggggtaccctaagttacgtaaacgggtttcaaggttagtaccgtaaggttccgtaagttccggtagggggaacccttaagggtttaaccttttttttaaccgtttccgaaacggttacctaacgttaccgaaccccgttaacggtacccgtttcggaccgtaacggtttccttaagggaaactttaacgtttagttaccgaacgtaaacctttaatttactttttacgttacgttacctaaacgttaaggttttcgacctttagaacctttcccgttcccccgtaaccgggttaccgtttaccgggaacccgtaaaggggtacccgtaaaggggttaaccgaaacgttaaccggtaaacgttaacgtacggg

SEQ ID NO: 73275 - DNA, 634 bp, Homo sapiens
  misc_feature: GYAE6OF02F6932.36.39.D06.1.454.CMB.1.raw
  modified_base (301)..(301): a, c, t, g, unknown or other
  misc_feature (301)..(301): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtctccatcctccctgtctgctatctgtaggcacagacgtcaccatctacttgccaggcgagtcaggactattgactaacttaatttaaattggtatcagcagagccagggatcggaccctaagcctccngactctacgatcgtcttacctaatttacggaaactcggggtacccattacgaaggttcaggtacgacgaagtcgtatcgtacggactagttatttttacttcgagtcaacttaccgacctacgtcccgtagacgtacgtacgtagaaagttacgttagttcgaaccttaaactagttttaactttccgttagttacctaaaacggttacgttttgaccttgtaaccttccccgtttacccgtaccgttaaccccgggttcggtaaaccccgtaacggggtacccgttaaagggtaccggtaaaacgtaacccgtaaacgggtacttaacgggg

SEQ ID NO: 73276 - DNA, 506 bp, Homo sapiens
  misc_feature: GYAE6OF02FOSQP.36.39.D06.1.454.CMB.1.raw
  modified_base (320)..(320): a, c, t, g, unknown or other
  misc_feature (320)..(320): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttccaattgaaaacngggtccatcaaggttcagtgacagtcgatcgtagggacagtattttacttcagcatcacagtcctgctagtctagaatatattgacaactattatttctgtacaacgtatttgacttgactcctccctaccgtacgttaccgaaccgtaacgggaccaaggttcggaaatacgaacgtacgtacgg

SEQ ID NO: 73277 - DNA, 832 bp, Homo sapiens
  misc_feature: GYAE6OF02IGH1H.36.39.D06.1.454.CMB.1.raw
  modified_base (174)..(174): a, c, t, g, unknown or other
  misc_feature (174)..(174): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtcncctttatcctccctgtctgcatctgtaggcgacagagtcaccatcacttcgccaggcgagtcaggacattgacaactatttaaattggtatcagcagaagccgagggatcggacccctaagcctccgtagactcgtacgatcgtacttacctaaagttttacgaaaaccgtacgggggttacccctaagttaccgtaaagggttctaaggtcggtaaccgtaaacggttacggacgttacggttacggggactaaggtttacttttttttaaccgtttccgaaggtacctaacgtttacccgaaaccccgtaacggtccccgttacggtaccgttaacgggtttacccttaagggtaaaacgttaagtttaacgttttacggaaaccttaaaaccgttaagtttttaaaccgttttttaccgttaacgtttaacccgttaaaaacggttttcggttttttacggtaccgtttacggttaacccttttcccccgtttaacccccggttttaacccccgggttaacccggggtttttaaccccggggaacccccggttaaaaaccgggggggtaaccccgttaaaaacggggggtttaacccggggtaaaaaacccgtttaacccgggtaaaacccggttaaaccgggtttaaccggggg

SEQ ID NO: 73278 - DNA, 584 bp, Homo sapiens
  misc_feature: GYAE6OF02JLWAH.36.39.D06.1.454.CMB.1.raw
  modified_base (282)..(282): a, c, t, g, unknown or other
  misc_feature (282)..(282): n is a, c, g, or t
  modified_base (489)..(489): a, c, t, g, unknown or other
  misc_feature (489)..(489): n is a, c, g, or t
  modified_base (515)..(515): a, c, t, g, unknown or other
  misc_feature (515)..(515): n is a, c, g, or t
  modified_base (568)..(568): a, c, t, g, unknown or other
  misc_feature (568)..(568): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgaccccagtctccatccctcccgtgtactgacattctgtacggcgacagagttccaccatcacttgaccaggcgagtcaggactattgactaactatttaaattggtatcagcagacncgaggatcgccctaagctcctcggatctacgatcgtccttaccgtaatttacggaaaacgtcggggttaccctaagtacgtaaaggttactaaggtcgtacaaggtacgtaacttcggacgggtaactaggttaactttttaccttcgagtactactacctacccgagtcctagacgttagtcctagaactagttactgactaaatnttactttcctagtaccaacttgttanctgtactccgtaccgttcaaccggttcgccgtaaaggccgtaaggtcggtaanaccgtaacgactacgg

SEQ ID NO: 73279 - DNA, 680 bp, Homo sapiens
  misc_feature: GYAE6OF02G4LFA.36.39.D06.1.454.CMB.1.raw
  modified_base (242)..(242): a, c, t, g, unknown or other
  misc_feature (242)..(242): n is a, c, g, or t
tcagtacgctgtctcacgaccggtgctcgatttagtgacatctcgcagttctttggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatcacttgccaggcagtcaggactagttanactaacttaatttaacgttggtatacagacgaaggaacgaccggagggtagtcccggtaccccttaagccttacctggacttaccgtacgtatcgtcctaaccttaagttacgaaaacggtccgggtacctatacggtaaggttcgtaagtcgacgtaacggtcgtagttaccggtagggtacctaaacggtttaactttttaccgtttaacctacgaccgtactacccaaccctacgtaccgtcgtaccgacgttactaacgtaagtaacgttatttcgaactaacccgtaatttaccgtttacttagttacctaaacgttgtttacgtcttacgtccttcccgttaccccggtacccggtaccggttacccggtacccggtaaacgggaacccgtaacggggtaacgttaacggaacctaaaccggtacttacggg

SEQ ID NO: 73280 - DNA, 608 bp, Homo sapiens
  misc_feature: GYAE6OF02IDLHV.36.39.D06.1.454.CMB.1.raw
  modified_base (511)..(511): a, c, t, g, unknown or other
  misc_feature (511)..(511): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtcctccactccctcctgtctgcatctggtacggcgacagagtccaccatcacttgccaggcgagtcaaggactattagaactaacttaatttaaattggtatcagacaagaagccgaagggatcggaccctaagcctctagacttctacgatacgtccttacctaagtttacgaaacgtacgggtaccagtacgtaaggttcagtgacgagtacgtagtacgtagggactaagtttacttttaacgttacagtactactaccactcgtcctagtcctagtacctagaaatattacttacgaactaacgtatttacttacgtataacctaagttagtttncttacgtacttcccgtaccccgttaccggtacgttacccggacccgtaaggggtacccgtaaggggtaacctaacgtaaccgtaacggtagttacgg

SEQ ID NO: 73281 - DNA, 655 bp, Homo sapiens
  misc_feature: GYAE6OF02G2804.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtctccatccctccctgtctgcatctgtacggcacagagtcaccatcacttgccaggcgagtcaggactattcgaactaacttatttaaattggtatcagacaagaagccgagggactcggacccctaagcctacgtagactcgtacgatcgtacttacctaaagtttacgaaaacggtacgggtaccctaagtacgtaacggttacaacggtcgacgtaacggttcgacgttcggaggtaacctagtttaactttttacgtacgaacgtactacttaccaaccgagtcctaggacctagttactacgtaaatacttattacgaaccttaattaacgtttactttacgtacgttacctaaagtttacggttcgtacttacgtaccttcccttacccggttaccgttaaccgggttccggaacccgttaaacgggtacccgttaagggtaaccgttaaacgtaaccgtaaaccggtagttacggg

SEQ ID NO: 73282 - DNA, 732 bp, Homo sapiens
  misc_feature: GYAE6OF02JGD3Q.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctccgtggggctcctgctgctctggctctcaggtgccagatgtgacatccagatcgacccagtctccatccctccctgtctgcatctgtaggcacagagtcaccatcctacttcgaccaggcgtagtcaacggactagttacgaactaacttaatttaaacgttggtactacgaggacaaggaacgtccgaagggtacgtaccggacccctaaggtcctaccgtagtactaccgtaacgacgttcgtaccttaaccgtaagttaacgaaaacgtcgggtacctaagtacgtaaggtacaagtcgacgtaacgtcgaacttcggaggtaactagtttacttttacgttcagtactaagtccaaccgtgtaccctaggacttaggtcctaagggtaaataacgttacgttacgacctaaacgttaacgttttaacgtttcccgtaagttaacctaaacgttttacggttttacgaacccgtttctttaaaccggttccccgttaaccccggtttaaccgggttaccggtttaaccccggaaacccgggttaacgggtaaacccggtttaaagggtaaccgttaaaacccgggtaaccggttaaaaccggttacggttaccggg

SEQ ID NO: 73283 - DNA, 651 bp, Homo sapiens
  misc_feature: GYAE6OF02JCSA2.36.39.D06.1.454.CMB.1.raw
  modified_base (354)..(354): a, c, t, g, unknown or other
  misc_feature (354)..(354): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
  modified_base (546)..(546): a, c, t, g, unknown or other
  misc_feature (546)..(546): n is a, c, g, or t
tcagtacgctgtctcacgaccggtgctcgatttagtgacatctcgcagttctttggggcaggagtcagtcccaaccaggacacagcatggacatgagggtccctgctcagctccgtgggctcctgctgctctggctctcaggtgccagatgtgacatccagatcgacccagtctccatccctccctgtctgactattctggtaggccgacagactaccacctataccacgttcgaccgagggtcagtccgaaggtactagttacaacctaaacttaattttaaagtggtatacgagcgaaaggacgtccggaaggtactccggacccctaaggccttccgtagactcgttacgnttcgacttaacctaagttacgaaacgtcggtacctagtacgtaagtctaagtcgactagtcgatcgtaggactagttattttacgtnagtctataccagtcctacgngtactagtaccgtagaacgttatcgttaacgtacctaacgttaacgtttactttacgtaccgttacgtaacgtttacggttttanaccgttacgtacgtttccccgtcccgttaagttcccggtaccgtaacccggtaaggtaacccggttagaacggtaaccgttaacgtaaaccggttcgtaaccggg

SEQ ID NO: 73284 - DNA, 609 bp, Homo sapiens
  misc_feature: GYAE6OF02HE9SV.36.39.D06.1.454.CMB.1.raw
  modified_base (493)..(493): a, c, t, g, unknown or other
  misc_feature (493)..(493): n is a, c, g, or t
tcagtacgctgtctcacgaccggtgctcgatttagtgacatctcgcagttctttgggggcaggagtcagtcccaaccaggacacagcatggacatgagggtcccctgctcagctcctggggctcctgctgctctggctctcaggtgccagatgtgacatccagatgacccagtctccatcctccctgtctgcatctgtacggcgacagacgtcaccatcacttgccaggcgagtcaggacattgaactaacttattaaattggtatcagcaagagccgagggactcggaccctaagctcctgatctacgatcgtcttacctaagtttacgaaaacgtacgggtaccctagtaccgtaaggttactaggtacgacgtaagtacgtatacgtcgggaactagtttaatttttacgttacacgtactataccaccagtaccgtgtaccacgttagtaagaagtattacgtagtaactaacgtattacgtttacctnttaaccgaacttgtttcgacttgtaaccttcccgtaccccgtaccggtacgttacccgggacgtaaacgggtaccgtaagggtacgtaaacggtaccgtaaaccggtacttacggg

SEQ ID NO: 73285 - DNA, 782 bp, Homo sapiens
  misc_feature: GYAE6OF02H5L6B.36.39.D06.1.454.CMB.1.raw
  modified_base (170)..(170): a, c, t, g, unknown or other
  misc_feature (170)..(170): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgcagatgtgacatccagatcgacccngtcctccactcctcctgtctgcatctgtacggcgacagacgtcaaccatccacttcgaccgaggcgtagtcaggactagttacgaactaaacttaattttaaaagttggttaatacgagaccgaaggtaacgccgaagggacttccgggtacccctaaggccttacctaggtacttaccgtaagacgttcgtaccttactaaagttttaacggaaaacgtacggggtaccctaagttacgtaaacggtttcgaagttacggaaccgtaaggtacgtaacgttaccggtacggggtaacttaacggttttaactttttttaacgtttaccgaacggttacctaacgttaccctaaccgtacgttaccccgttacgttaaccgaacggttttacccgaaagggtaaacggttacttttaacgttacggaaacctttaacgttaagtttttaccttttacgttaacgttaactaacgttacggtttttcgacgtttacgtacccgttttaccctaccccggtttacccggtaacggtttcccgggaaaccgtaaccggggttaaccgtaacggggttaaaccggtaaacgttacgtaaaccggtagttacccggg

SEQ ID NO: 73286 - DNA, 628 bp, Homo sapiens
  misc_feature: GYAE6OF02IFU1L.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtcctccatccctcctgtctgcatcgtggtacggcgacagacgtacacctatcacgttcgccaggcgtagtcgaacggactagttacgaactaaactttaagttttaaacgttggtaatccgaagcaagaacggtccgagggacttccggacccctaagtccctaccgtgtaactacgtaaggacttcgtaccttactaagttaacgaaaacgtcgggtaccatacgtaacgttcagtcgaacgtacgtcgagtcgtacggactaagttacttttactcgagtctactacacgtacgtactgtacgtaacgtctaagaacgtattattacgaactaactaatttactttctagttactaaacgtgtttcgacttgtaccttccgtaacccgtaccgtaccggttaccggaaccgtaacgggtacgtaacggtaagtaacgtaacaacggtattacgg

SEQ ID NO: 73287 - DNA, 572 bp, Homo sapiens
  misc_feature: GYAE6OF02HOISU.36.39.D06.1.454.CMB.1.raw
  modified_base (416)..(416): a, c, t, g, unknown or other
  misc_feature (416)..(416): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtctccatccctccctgtctgcatctgtaggcacagagtcaccatcacttgccaggcgagtcaggacattcgactaacttatttaaattggtatcagcagaacgccgagggactcggacccctaagctcctgatcgtacgatcgtcttacctaattacgaaacgtcgggtacccaatacgaagttcagtagactaagtcgagtcgtaggactagttaactttttacgtcagtctacgtccaaccngtcctagtcagttcagtaatattagttcgactaactattatttctagtactaattacgtttgacttagtacttcccgtcccgttaccgttacggttcccggaaccggtaaacgggtacccgaagggttacgaaactaccggtaaacgtcgttacgg

SEQ ID NO: 73288 - DNA, 576 bp, Homo sapiens
  misc_feature: GYAE6OF02GK2W9.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatccacttgccaggcgagtcaggacattgacaactatttaaattggtatcagcagaacgccgagggatcggcccctaagctcctgactctacgatgccttactaattacgaaaacgtacgggtaccctatacgtaaggttcagtgactagtcgatcgtgggactagtacttttacgttcagtctatcaccacgtcctgctagtcgtagaagtatattcgactaacgtatttactttacttacgttactaaacgttagtttgaccttgtaccttcccgttccccgttaccggtaccggttcccggaccggtaaccgggtaaccgtaacgggtacgtaaacgtaccgtaaaccggtagttacggg

SEQ ID NO: 73289 - DNA, 686 bp, Homo sapiens
  misc_feature: GYAE6OF02H0XQ1.36.39.D06.1.454.CMB.1.raw
  modified_base (143)..(143): a, c, t, g, unknown or other
  misc_feature (143)..(143): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (223)..(223): a, c, t, g, unknown or other
  misc_feature (223)..(223): n is a, c, g, or t
  modified_base (313)..(313): a, c, t, g, unknown or other
  misc_feature (313)..(313): n is a, c, g, or t
  modified_base (380)..(380): a, c, t, g, unknown or other
  misc_feature (380)..(380): n is a, c, g, or t
tcagtacgctgtctcacgaccggtgctcgatttagtgacatctcgcagtttctttgggggcaggagtcagtcccaaccaggacacagcatggacatgagggtccctgctcagctccgtggggctcctgctgctcgtggcttcncaggtgccagatgtgacatccagatgacccagtctcatccgtcctgtcngacntctgacgcgangagtcacangtactcnccgagcgaggtcagactattagacctaattatttaaagttggtatacgagaccgaagaacgtcgaaggatacgcccctaagccttccganaactctacggatcgtcttacctaaattacggaaaacgtacgggtcctaatacggttaaaccgggttnaacggttacgtaacgtaacgtacgtagtacggtaaggtacttaagtttaactttttctaacgacgtacttaaccacctaaccgacgtcgtaacgtcgtaagttactaagtaatattaacgttacgaactaacttacgttacgtttactacgttaacgtaacgtttaacgttctacgttacgttaccctttaccccggtcccgtttaacccgggttaccggttaacccgggaacccgggtaaacgggtaaacccgggttaaagggtaaacctaaaaccggttaaaccgtaaccggttacggtaaggg

SEQ ID NO: 73290 - DNA, 759 bp, Homo sapiens
  misc_feature: GYAE6OF02HTW9D.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtcgccagatgtgacatccagactcgacccagtcctcactccctcctgtcctgctatctgtaggcacagacgtccacctatcctacgttcgaccgagggcgaacgttcgaacgggtactagttacgaaactaaacgtttaaatttttaaaagttcggtaacttaccgaacggtacgtaaacggaacgtacccggaaggggtaccgtaccgggtaccccctaaagtcccgttaccgttaggaacctttaccggtaacgtaacggtccgttaacctttaaccgttaaacggttaaacggaaaaaccggttcggggtacccctaaagttacgtaaaacggtttcgaacggttacgaaccgtaaggtacctaggtacggtagggtaactagttttacctttttaacgtagacgttacctaacgtacctaaccgtagtccgtacgtacgtacgtaccgtagtaaacgtaccttagtaaccgtaacgtaaacttacgtttacgtttactcggttaaaccctaattacgtttcgaacttacgtccgttacccgtccgtaccggttagttacccggaacggaacggacgttaaacgggacgtaaacctacgtaaacggtactcggg

SEQ ID NO: 73291 - DNA, 604 bp, Homo sapiens
  misc_feature: GYAE6OF02FV81T.36.39.D06.1.454.CMB.1.raw
tcagtacgctgtctcacgaccggtgctcgatttagtgacatctcgcagttctttgggggctctgggagaggagccccagccctgagattcccaggtgtttccattcagtgatcagcactgaacacagaggactcaccatggagttgggactgaactggattttcctttggctattttaaaaggtgtccagtgtgaagcgcagctggtggagtcgtgggggaggcttgggtacaggccgggcaggtccctgagacctctcctgtgcagtctctggtattcacctttgaagtattttgccatcgctacgtgggtccgcgtaacggttaccgagggaacggggtccgttgaggttgggtcgtcaactattagcgtaggtaatagttagggtagtagttagggttagttgcggtactcgttggtaggaggggccgtactacacgatctccagaacgacaacgaccgaacgaacctccctagtactctgtacaatacgaactagtactaggagtacggctaggacgacggtaccgtcgttagttacgttaacgtgttacgaacgtaaggtaacgtacgtaaacttactactaacgttacggtcttaacg

SEQ ID NO: 73292 - DNA, 594 bp, Homo sapiens
  misc_feature: GYAE6OF02FZB9H.36.39.D06.1.454.CMB.1.raw
  modified_base (423)..(423): a, c, t, g, unknown or other
  misc_feature (423)..(423): n is a, c, g, or t
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatgacccagtctccatcctccctgtctgcatctgtaggcgacagagtccaccatcacttgccaggcgagtcaggacattgaacaactatttaattggtatcagcagagcgaggatacggcccctaagctcctgactctacgtatcgtaccttacgtaattacgaaacgacgggtaccatacgtaaggttcgagtagacaacgtacgtagtacgtagggtactaaggttactttttaccgttctagcctaagttcccaaccgngtcccgtagacgtacgttcaaggtaatacgttaattgaacctaatacgtttattccgtattaccaaagttcgttagtcctagtactccgttaccccgtacgttacggtaaccggaccgtaaagggtacccgtaaggttaacggtaacgtaaccgtaaacgtacgttaacgg

SEQ ID NO: 73293 - DNA, 613 bp, Homo sapiens
  misc_feature: GYAE6OF02GH7AS.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtctccatcctccctgtctgcatctgtaggcgacagagtcaccatcacttgccaggcgagtcgaggacattagaactaacttaatttaaattggtatcgagcagaagccgagggactcggacccctaagcctcctgacttctacgatcgcttacctaattacggaaaacgtacgggtacccagttacgtaaggttcagtagacgtaagtcgtagtcgtagggactaaggtttatttttacctttagacgtctacttaccaacccacgtccttgaccgtacgttcgtaagaagtattacttagaaccttaactatttaactttcgtaacgttacaaaccgttagtttcgactgttacctacccgttcccgtaccggttaccggtcccggaaccgtaagggtaacctaagggtaacggtaaactacgaaaaccggtagtacggg

SEQ ID NO: 73294 - DNA, 558 bp, Homo sapiens
  misc_feature: GYAE6OF02FO173.36.39.D06.1.454.CMB.1.raw
  modified_base (472)..(472): a, c, t, g, unknown or other
  misc_feature (472)..(472): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatccctccctgtctgcatctgtaggcgacagagtcaccatccacttgccaggcgagtcaggacattgacaactatttaaattggtatcagcagaagccagggatcggacccctaagctcctgatctacgatcgcttacctaatttacgaaaacgtacggggtacccaagtactaaggttcaagttgacaagtcgatcgtgggacagtattttacgttacagcgtactcaccagtccttgactagtctagaatattattagactaactattactttctagttactaacttagtttcncgttgacttccgtcccgtccgtaccggttccggaccgtaacggggtaacctaacgggttacgaaacgtaccgaaacgtacgtacgg

SEQ ID NO: 73295 - DNA, 710 bp, Homo sapiens
  misc_feature: GYAE6OF02GS429.36.39.D06.1.454.CMB.1.raw
  modified_base (329)..(329): a, c, t, g, unknown or other
  misc_feature (329)..(329): n is a, c, g, or t
tcagtacgctgtctcacgaccggtgctcgatttagtgacatctcgcagttctttggggggcaggagtcagtcccaaccaggacacagcatggacatgagggtccctgctcagctcctggggctcctgctgctctggctctcaggtgccagatgtgacatccagatcgacccagtcctccatccctccctgtctgcattctggtaggcgacagacgtccaccatcactgccaggcgagtcaggactattcgaactaacttatttaaattggtatacagacaaggaacgaccgagggagtccggacccctaagcctctagtatcctaacgntcgtcttacctaagtttaacgaaaacgtccggtaccaatacggtaaacggttcaaggtacgacgtaacggtactacgttacggtagggtaacttaggtttaacttttttaacgttacgagtacctacttacccgaaccctagtacccgtaggacccttagttaaccgtaaggtaaacttactttaacgttacgaaccctaaacgtttatttaacgtttttacctacgttacctaaacggtttagtttaccgtactttacgaccgtttaccccgtttccccggtaccggtttacccgggttacccgggaacccgggtaaaggggaacccgttaaacggggttacggtaaaaccttaaccggtaaaccgtacggtttaccggg

SEQ ID NO: 73296 - DNA, 610 bp, Homo sapiens
  misc_feature: GYAE6OF02FXS40.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtcaccatccaacttgccaggcgagtcgaggacattcgacaacttatttaaagttgtatcagacagaagccgagggacgtcggacccctaagcctcctgtactcgtacgtatcgtcttactaattacgaaaacgtcgggtaccatacgaggttcagtcgacagtcatcgtggactagttactttacttacagtctactcacacgtcctgactagtcgtagaagtattattacgactaactactttactttcttacgtactaacgttacggtttctacgttacgtaacttcccgtttccccgttaccggttaacccggttaccggtaacccggtaaaccggggttaaccggtaaacgggttaacggtaaaacccgttacccgaaaaccggtaccggttaacggg

SEQ ID NO: 73297 - DNA, 639 bp, Homo sapiens
  misc_feature: GYAE6OF02F35E4.36.39.D06.1.454.CMB.1.raw
  modified_base (326)..(326): a, c, t, g, unknown or other
  misc_feature (326)..(326): n is a, c, g, or t
tcagtacgctgtctcacgaccggtgctcgatttagtgacatctcgcagttctttgggggcaggagtctagtcccaaccaggacaacagcatggacatgagggtccctgctcagcgtcctggggctcctgctggctctggctctcaggtgccagatgtgactatccagatgacccagtctccatcctcctgtctgcatcgtggtacggcgacagacgtcaccatctacttgccgaggcgagtcaggactatgaactaacttatttaagtggtatcagacaagaagcgagggactcggacccctaagcctcctagtactctatggtcncactacctaagtttaaccaacggtcgggtaccctaagttaacggattacgacgtcggactaggtagtatcgtaggacagtagtactttcacttctaccactagtcgagcctacgtcctcgaccacggtaccgtaggtaacgttcgttttacgtacctttaaacttttacgttaaccttcgttaaccgtaacgtaacgttacttaaccttaaccgtttacccgtaccggtttaccggttacccggaacccggttaaacgggacccgttaacgggttaaccggtaaacgtaacccgtaaaacggtcgttaccggg

SEQ ID NO: 73298 - DNA, 1104 bp, Homo sapiens
  misc_feature: GYAE6OF02IG54E.36.39.D06.1.454.CMB.1.raw
tcagtacgctgtctcacgaccggtgctcgatttagtgacatctcgcagttctttggggcaggagtcagtcccaaccagacacagcatggacatgaggtccctgctcagctcctgggctctgctgctctgctctcaggtgccagatgtgacatccagatcgacccagtctccactccctcctgtctcgcatctgtacggcacacgagtcaccatcacgttagccgaggcgagtacgacggtacacttcgaactaaccttaatttaaacgttaggttaactaccgtaagacaacggtaacgaccgtacggggaacgttccgggaccccttaaacgtcccgtttacccgtacgtaacgtttccgtaaccggtatacggccgtttaaccgtaaacgtttaaccgttaaaaaccggtaccgggggtttaacccctaacgttaaccggttaaacgggtttaccgtaaggtccgtaaccggtaaacggtaccgggtaacgttacggttaacggggtaaacccgtttaaacgtttaaacgttttttaacccgttttacggtaaaccgttccgtaaacgttaccccgtaaccggtaaacccggttacccggtttaccggtaaaccggttaccggttttaacgggttaaccgggttaaaacgggttttaaaccggttttaaaaggtttacccgggttaaaaccggttaaacccgttttaaaaccggttttaacccggtttttttttaaccgggttaacgggtttttaaaccccccgttaaaacggggtttttaaaccccggtttttttaggggttttaaccccggtttacccggggtttaaacccgtttttaacccccccgggttttttaaccccccccggtttaaccccccgggggttttaaaccccccggggggtttttttaaaaccccccggggtaaacccccccgggggttttaaaaaaccccgggggggtttaaaacccccccgggtttttaaaaaccccggggggtttaaaccccggggggtttaaaaaaaccccggtttttaaaaacccccgggttaaaaaacccccccgggggttttttaaaccccggtttaaaaccccggggggg

SEQ ID NO: 73299 - DNA, 712 bp, Homo sapiens
  misc_feature: GYAE6OF02H1SD0.36.39.D06.1.454.CMB.1.raw
tcagtacgctgtctcacgaccggtgctcgatttagtgacatctcgcagttctttgggggcaggagtcagtcacaaccaggacacagcatggacatgagggtccctgctcagctcctggggctctgctgctctggctctcaggtgccagatgtgacatccagatgacccagtctccatcctcctgtctgcatctgtaggcgacagagtccacatcacttgccgaggcgagtcaggactattgaactaaacttaattttaaattggtatacagcaaggacgaccgagggacgtcggaccccgtaagtcctaccgtgtactcgtacgtactcgtaccttacctaattttaacgaaaacgtacggggtaccctagtacgtaaggttacgagtcgtactaacggtacgtaagttcgtagggactaaggtttaacttttttacttacgaagtacctacgtaccgaacctacggtacctgaccgtacgttacgtaggaaagttaactttaagttacgaacctaaacttaacgtttactttttaccgtacgttaaacctaacgtttaacggttttcgtaccgtttgttaacccgtttccccttacccccggttacccggtttaacccggtttacccgggaacccgggttaaaacggggtaacccggttaaacggggttaacggtaaaacccgttaacccggtaaaaccggttaaaccggg

SEQ ID NO: 73300 - DNA, 667 bp, Homo sapiens
  misc_feature: GYAE6OF02IZ378.36.39.D06.1.454.CMB.1.raw
  modified_base (145)..(145): a, c, t, g, unknown or other
  misc_feature (145)..(145): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtnccagatgtgacatccagatcgaccagtctccatccctcctgtctgctatcgtgtaggccagagtacgtaccactactcacgttgccgaggcgtagtacacggactattcgaaactaacttaatttaaagttgtatacgacgtacgaaggtaacggaccgagggtacgtaccgggtacccctaacggtcctacgtcgtaactacgtacgtacgtctacctttaccgtaaagttaaccggtaaaacggtcccgggttaccaacgttacgttaacggtacgtaggtacgagtaaacgtccgtaagtcggtaggtaaccttagttaactttttacgttacacgtctactaccctacgccgtacgtacgacgtaacgtagtagaacgtatagttacgaactaactagttacttgtacgttactacgttaggttctacgtatacctttcccgtccgttaccggtaccgtaccggaaccggtaaacggtacgtaaagggttaaccgaaagtacccgtaagtacgtacgg

SEQ ID NO: 73301 - DNA, 569 bp, Homo sapiens
  misc_feature: GYAE6OF02ITVSN.36.39.D06.1.454.CMB.1.raw
  modified_base (370)..(370): a, c, t, g, unknown or other
  misc_feature (370)..(370): n is a, c, g, or t
  modified_base (441)..(441): a, c, t, g, unknown or other
  misc_feature (441)..(441): n is a, c, g, or t
  modified_base (563)..(563): a, c, t, g, unknown or other
  misc_feature (563)..(563): n is a, c, g, or t
tcagtacgctgtctcacgaccggtgctcgatttagtgacatctcgcagttctttggggggcaggagtcagtcccaaccaggacacagcatggacatgagggtccctgctcagctcctggggctcctgctgctctggctctcaggtgccagatgtgacatccagatcgacccagtctccatcctccctgtctgcatctggtaggcacgagacgtcaccatacacttcgccaggcgagtcaggactattagaactaacttaattttaaattggtatacagacagaacgcgagggatcggacccctaagcctactgactactacgatgtacttactaattagaaaccgtcggtaccatactaaggttacagtnacgagtcgtatcgtaggactagttatttacttcagctactaccaccagtcctagactacgtagtacgtaanacgttatacgactaactattacttcttagttacctaaattagtagttactacgtacgttcctacccgttacgacggttaccggaccgtacggtaaccgtaacggtagaacgtacgtaaacgngtacgg

SEQ ID NO: 73302 - DNA, 674 bp, Homo sapiens
  misc_feature: GYAE6OF02G0OGD.36.39.D06.1.454.CMB.1.raw
  modified_base (171)..(171): a, c, t, g, unknown or other
  misc_feature (171)..(171): n is a, c, g, or t
  modified_base (475)..(475): a, c, t, g, unknown or other
  misc_feature (475)..(475): n is a, c, g, or t
tcagtacgctgtctcacgaccggtgctcgatttagtgacatctcgcagttctttgggggcgaggagtcagtcccaaccaggacacagcatggacatgagggtccctgctcagctccgtgggctcctgctgctctggctctcaggtgccagatgtgacatccagatgacccngtctccatccctccgtgtcctgactatccttgaggcgaacaggattccaaccatccgacttgacccaaggccgagtcaggaacctagttagaaccaattaaatttaaagtttagggtatgaagccgtaaagaaggccgaagggtaagttcgggaacccccttaagccgtactcggtaatccgtacgaatcgctttaccaaagtttgaaaaacgtcgggttaccaacgtgtaaaggtctaaggttagcctaaaggtccgtaatacccgagggtaacgtagtaattttaaccgtttacgtaacgtntaacttacgaacctactaccgttcgacttaggtacctaggtaaagaattataaggtactaaactagtttaactttcgttacgtaccttaaactcgggtttactcggttatatacccgttcccttaccgttaaccggttccggtacgaaacgggtaccgttaacgggtaagtaacgtaaccgtaaacgtaaaccggtcgg

SEQ ID NO: 73303 - DNA, 715 bp, Homo sapiens
  misc_feature: GYAE6OF02JOZJL.36.39.D06.1.454.CMB.1.raw
  modified_base (203)..(203): a, c, t, g, unknown or other
  misc_feature (203)..(203): n is a, c, g, or t
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatgacccagtctccatcctccctgtctgcatctgtaggacgnacacgacgtaccaccactacctacgttcgaccgacggacgacgtacgaggactagtacgtaactaaacttaaagtttaaacgttaggttaacgtacgtaacgtacgtaacggaacggaccggaacgggtacgtaccggtacccgtaaccgtaccgtaccgtacgtacgtacgtacgtacgtacgtaccttacttaacgttaacgtaaacgtaacggtaccgtacgtaacgtaacgtacgtacgtacgtacgtaacgtacgtacgtacgtacggtacgtaacgttactttacttactacgtactactaccgtaccgtacgtaccgtacgtacgtacgtacgtacgtaagtaacgtaagtacgtactaactaacttacgtttacgttacgtactaacgttacgttacgttacgttacgtaccgttcccgttacccgttacccggtaccggttaccggtaacccggtaaccggtaaccggtaaacggtaacggtaaacgtaaccgtaacgtaacg

SEQ ID NO: 73304 - DNA, 579 bp, Homo sapiens
  misc_feature: GYAE6OF02HK1YM.36.39.D06.1.454.CMB.1.raw
  modified_base (119)..(119): a, c, t, g, unknown or other
  misc_feature (119)..(119): n is a, c, g, or t
  modified_base (145)..(145): a, c, t, g, unknown or other
  misc_feature (145)..(145): n is a, c, g, or t
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
  modified_base (257)..(257): a, c, t, g, unknown or other
  misc_feature (257)..(257): n is a, c, g, or t
  modified_base (263)..(263): a, c, t, g, unknown or other
  misc_feature (263)..(263): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
  modified_base (463)..(463): a, c, t, g, unknown or other
  misc_feature (463)..(463): n is a, c, g, or t
  modified_base (471)..(471): a, c, t, g, unknown or other
  misc_feature (471)..(471): n is a, c, g, or t
tcagtacgctgtctcacgaccggtgctcgatttagtgacatctcgcagttctttgggggcaggagtcagtcccaaccaggacacagcatggacatgacggggtccctgactcagctccnggggctcctgctgctctgctctacgnggtcnccgaagtattggcacacgtccgaatacgcaccccagtcttccatcccgtctntcgnacagttcgtgcggacacgagactcactancctancgacgaggcagcgaganacgtanactaacttaagttaaattaggtacacaagacaagaacgcgtaaggactacgacccctaagcctcagtacgtactacagtctctaacgtattaaacgaagtcggtacatacggaatcgaangtactagcgtancgagactatagttttacagagctaacnctaacgctactgacngttactagatanagtanacaactttntacctttncgttaacaagtagttacgacacgtttcaccccgtttcgaaccggtttccaccggtaaacggtacccgtaaggacgttaaaccgaacgtaacggtacaggttacccggg

SEQ ID NO: 73305 - DNA, 684 bp, Homo sapiens
  misc_feature: GYAE6OF02HPKAR.36.39.D06.1.454.CMB.1.raw
tcagtacgctgtctcacgaccggtgctcgatttagtgacatctcgcagttctttggggggcaggagtcagtcccaaccaggacacagcatggacatgagggtccctgctcagctcctgggctcctgctgctctggctctcaggtgccagatgtgacatccagatgacccagtcctccactccctccctgtctgcattcgtgtacggcgacaggacgtccaccatccacttcgaccgaggcgagtcgaggactattagaactaacttaattttaaagttggtatacgagacgaaggaacgaccgaggggacgtccggaccccgtaacgtcctacctagtactcgtacgatcgtacttacctaacgttaacgaaaacggtacgggtaccctaagtacgtaacggttcagtacgacgtacgtacgtacgtcgtagggaactagtttaactttttacctacgtacgtactactaccaccgtacgtaccgttcgaccgtagtacgtaagtaacgtagttagtacgtaactaacttagtttaactttacgttacgttaactaaccgttaggtttctacgttcgttacctttcccggtaccccgttcccggttaaccggttacccgggtaaccggtaacgggtaaccggtaaggttaaccggtaaacgttaaccgtaacggtacgtacggg

SEQ ID NO: 73306 - DNA, 621 bp, Homo sapiens
  misc_feature: GYAE6OF02GT43B.36.39.D06.1.454.CMB.1.raw
  modified_base (275)..(275): a, c, t, g, unknown or other
  misc_feature (275)..(275): n is a, c, g, or t
  modified_base (376)..(376): a, c, t, g, unknown or other
  misc_feature (376)..(376): n is a, c, g, or t
  modified_base (423)..(423): a, c, t, g, unknown or other
  misc_feature (423)..(423): n is a, c, g, or t
  modified_base (443)..(443): a, c, t, g, unknown or other
  misc_feature (443)..(443): n is a, c, g, or t
tcagtacgctgtctcacgaccggtgctcgatttagtgacatctcgcagttctttggggcaggagtcagtcccaaccaggacacagcatggacatgagggtccctgctcagctcctggggctcctgctgctctggctctcaggtgccagatgtgacatccagatgacccagtctccatcctcctgtctgcatctgtacggcacagagtcaccatcacttgccgaggcgagtcaggacattgacaacttatttaaattgtatcagcagagccgaggntcggaccctaagcctctgacttcgtacgatcgtccttacgtaatttagaaaacgtcggggtacctagtacgaaggttcaagtcgactaaggtcgagttcgnggtactagtactttttctcgatctatcacgacgctgactagtcgtanagtattgtagactaaacgtnttaactttcgtacgtacgtaacttacgtttcgacgtttagtccgttacccgttacccccggttacccggttaacccggttttaacccgggaacccgttaaacggggaaccccgtttaaacgggggtaaaccttaaaacccggtttaacccggtaaaacggttaacccggttaacgggg

SEQ ID NO: 73307 - DNA, 938 bp, Homo sapiens
  misc_feature: GYAE6OF02JN1QQ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtcctccactccctccctgtctgcatctgtaggcacagacgtaccacctatcctaacttgcccgaggacgagtcgacggactagttacgaactaactttaatttaaacgttggttacttacgaagtacgaaaggaacggtaccggagggtacgtaccggtaaccccgtaacggtcccttaccgtaagtaccgttaccggttaaccggtacgttaccgttaccctttaaaccgttaaacgttttaacggggtaaaaaccggttaccgggggttaccccctaaagttaaccggtttaaacgggtttaccgtaaggtttaaccggaacgttaaaccgggttaccgtaacggtttaccgggtaacgggtaaaccgttaaacggtttttaacctttttttaacccgttacggaaaccttaccggtaaaccttaacccgtaaccccggttaccggtaccctttaccgggtacgttaaccgggttccgttaaacgaaacggtttacgttaaacgtttaccggtaaacccttaacgtttaaaccgtttttaacgtttttaaccccgttacggtttaaaccgtaaaccggttttacggtttacggttaaccgtttaccggtttaaacccgtttccccggtttcccccggggtttaaccccggttaccgggtttaaccccggggaacccggggttaaacggggtaaaacccggtttaccgggggttaaaaggtaaaccccttttaaaccgggtaaaccgggttaaccgttaccgggg

SEQ ID NO: 73308 - DNA, 608 bp, Homo sapiens
  misc_feature: GYAE6OF02G68UZ.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggcgacagagtccaccatccacttgccaggcgagtcgaggactattgactaacttaatttaaattggtatcagacagaacgccgagggatccggcccctaagctcctgatctacgtatcgtcttacctaatttaacggaaaacgtacgggtaccctaagtacgtaaggttacaggtcgacgtaagtcgtacgtcgtagggactagttactttttacgttcagtctactaccaccacgcctgactacgtcgtagtaatattatagacctaagtatttatttcgtagttactaacgttagtttcgactcgtaccttcccgttaccccggtccggttaccggttacccggaaccggtaacgggtaacccgtaagggtaccggtaaaacgtaccggtaaacggtacgttacggg

SEQ ID NO: 73309 - DNA, 749 bp, Homo sapiens
  misc_feature: GYAE6OF02HEN49.36.39.D06.1.454.CMB.1.raw
  modified_base (284)..(284): a, c, t, g, unknown or other
  misc_feature (284)..(284): n is a, c, g, or t
  modified_base (323)..(323): a, c, t, g, unknown or other
  misc_feature (323)..(323): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtcgccagatgtgacatccagatcgacccagtctccatccctccctgtctagccatcctggtacggctacgagactccacctatcacttgccgaggcgagtcaggtactattacgaactaacttaatttaagtgtatacganacaagagccgaagggacttccggaccctagtcctccgtnacttctacgatctacttacaagttacggaaacgtccggtaccagtacgtaagttcagtagacagtaccgtatcggtaaggacttaaggtttacttttacgtatacgtactaaacgtccctaaaccgtccgtaccgttacggaaccgttacggtacgtaaacgtaaacgtaactttaccggtaacgtaacctaaacgttaacttttaccgttttaacgtaccggttaaaccttaaacggttttaaccggtttcgtaccttaccggttacccttttacccccggtaaccccccggttttaacccggttacccggggttaaaccccgggtaacccgggtaaaaccgggggttaaaccccggttaaaacggggttaaccgtaaaaacccgtttaaccggggttaaaaccccgttaccggggttaaccggg

SEQ ID NO: 73310 - DNA, 696 bp, Homo sapiens
  misc_feature: GYAE6OF02GMUE7.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcaggtgccagatgtgacatccagatgacccagtctccattcctccctgtctgcatctgtaggcgacagagtccaccatcacttgccgaggcgagtcaggactattgacaacttaatttaaattggtatcagacagaagccgagggactcggacccctaagcctccgtagtactactacgactcgttaccttacctaaagttttacgaaaacgtacggggttacccaagtaccgtaaaggtttacaaggtacgtactaaggttaccgtagttaccggtaggggtaactaaggtttaacttttttaacctttacgaacgtcctaaacttacaacccgtacggtcccttaggtacctaacgggttacctaaggtaaacggttacttaacgtttaggaaccttaaacgttaattttacgttttaccttagtttaactaaactttagtttacgaccgtttgaaccgttcccgttacccgttaccggttaccggttaccgggaacccgttaacgggaaccgtaacgggttacggtaaacgttaaccgtaaacggtattaccggg

SEQ ID NO: 73311 - DNA, 751 bp, Homo sapiens
  misc_feature: GYAE6OF02FQ3WQ.36.39.D06.1.454.CMB.1.raw
tcagtacgctgtctcacgaccggtgctcgatttagtgacatctcgcagttcgtttgggggcaggagtcagtcccaaccaggacacagcatggacatgagggtccctgctcagctcctgggctcctgctgctctggctctcgaggtgccgagtatgtagacatccagatcgaccctagtcctccactcctccctgtctgctatcgtgtacggacgacagacgtcacacttactactcgccgaggcacggtcaggactatagtaaacctaacttaaattttaaagttaggtataccgaagacgaagaaacgccggtaacgggtaacgttacccggacccccgttaagtccgtccgtacgacgttaccgtacgtatacggtacccttaacgttaacgttaaaccgtaaaaccgggtaccggggtacccaacggttacgtaaaccgggtttacgaaggtaccggttaaccgtaaggttacgaacgttaccggtagggtaacttaacggttttaactttttaccgttacgaacgtccttaaccgtacccgacccgtaggacccgttgaccgtacgttaccggtaagtaagtaacgttaagttacgaacgttaacttacgtttatttaccgttacgtaactaagtttacttcgacgttacgtactaccccggttcccgttaccggtaccggttaccgtaaccggaaccggtacggtaacggtaacggtaacgtaacccggtaaaggtccgttaacgg

SEQ ID NO: 73312 - DNA, 693 bp, Homo sapiens
  misc_feature: GYAE6OF02I8SSB.36.39.D06.1.454.CMB.1.raw
  modified_base (287)..(287): a, c, t, g, unknown or other
  misc_feature (287)..(287): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcggaccccagtcctccattccctcccctgtcctagcattctggtacggcgacagacgtcaccatcacttcgccgagcgagtacgaggacagttagaactaacttatttaaagttggtactcancgaaggaactcgagggactacgggtaccctaagctccgtagtactccgtacgattcggtccttacgtaaagttttacggaaaacgtcggggttacccattacgaacgggttacacggttacgaacgtaacggtcgtactacgggtagggtaacttagtttaactttttaccgttacacgtactactaccgacctaggtccccgttaagtacccgtacgttacgtacgtaaagtacgttacttacggacctaattacgtttaagtttccgttacggttaaaccttggtttaaccgtttacggttcttacggtaccttcccgttaaccggttccctaaccgggggtttccgaaccgtaaaggggtacctaacggggtaactaacgtaccgtaaacggagttaaccggg

SEQ ID NO: 73313 - DNA, 767 bp, Homo sapiens
  misc_feature: GYAE6OF02H0C0C.36.39.D06.1.454.CMB.1.raw
  modified_base (204)..(204): a, c, t, g, unknown or other
  misc_feature (204)..(204): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccatcctccctgtctgcatctgtacggcanagagtcacatcactgccaggcgagtcgaaggacattagactaactaactttaaaattaggttaactctaagacgaacgaaaggccgaaggggactaccggtaccccgtaagtcccgtcctaggtaactcgtaacgatcgtacttacctaaattaacggtaaaaccgtacggggtaccaacgtacgtaaggttacaagttacgactaaggtcgtaacgttacgtagggtaacaacggtttaactttttaactttaccgtacggtaactaaactacgttaaacccgacgttacccgtagttaccgaacggttacccgttaaaggtaacctaaagttaagttaccgtaaacgtaaaaccgtttaaatttacggttttaacttacgtttaaccgtaaaaccgtttaggttaccgtacgtttacgtaacccgtttcccgtacccgtttaaccccgggttaacccgggtttaacccgtaaccccgggtaaacggggtaaaccccggttaaacgggttaaaccgggtaaaaccttaaaaccggtaaaaccccgggtaggtttaacccggg

SEQ ID NO: 73314 - DNA, 561 bp, Homo sapiens
  misc_feature: GYAE6OF02FIAWC.36.39.D06.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
  modified_base (315)..(315): a, c, t, g, unknown or other
  misc_feature (315)..(315): n is a, c, g, or t
  modified_base (356)..(356): a, c, t, g, unknown or other
  misc_feature (356)..(356): n is a, c, g, or t
tcagtacgctgtctcacgaccggtgctcgatttagtgacatctcgcagttctttggggggctctgggagaggagccccagccctgagattcccaggtgtttccattcagtgatcagcactgaacacagaggactcaccatggagttgggactgaactggattttcctttggctattttaaaaggngtccagtgtgaagcgcagctggtggagtcgtgggggagcttggacagccggggnaggtccctgacgactctcctgtgcagtctctggacttcacctttgaagtattttcgcctatcgcactgggtccganaaggttccgagggtaacgggccttggagtgggtctcaactnttagctaggaatagtggtacgtagtgggttatggcggtactcgtgtagaacgggtcctatcaccatcctacagaacgacaacgaccaaagacctcctagtactctagacaaacgtagaacagtctagagagctggagacacgtccttagtacttacgagttacgacgtaaaggatacgaacttactaacgtacgtacggtctacg

SEQ ID NO: 73315 - DNA, 613 bp, Homo sapiens
  misc_feature: GYAE6OF02F3CI7.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtctccatccctcctgtctgcatctgtaggcgacagagtcaccatccacttgccgaggcgagtcaggactattgaactaacttaatttaaattggtatcagacagaagcgagggactcgggaccctaagctcctgactctacgatcgtcttacctaattacgaaaacgtacggggttacccaagtacgtaacggttcagtacgacgtaagtacgtagtacggtacgggactaaggtacttttacgtttctacgtactactacaccacgtccttgactagtctagtaagtattagttacgactaactatttactttacgtagttaactaacttagtttacgtcttacgtacttcccgttcccttcccggttacggttaacccggtaccggaaccgggtaccgtaacgggttaacgaaacgtaccgtaaaccggtacttacggg

SEQ ID NO: 73316 - DNA, 661 bp, Homo sapiens
  misc_feature: GYAE6OF02IZ63P.36.39.D06.1.454.CMB.1.raw
  modified_base (207)..(207): a, c, t, g, unknown or other
  misc_feature (207)..(207): n is a, c, g, or t
  modified_base (256)..(256): a, c, t, g, unknown or other
  misc_feature (256)..(256): n is a, c, g, or t
tcagtacgctgtctcacgaccggtgctcgatttagtgacatctcgcagttctttgggggcaggagtcagtcccaaccaggacacagcatggacatgagggtccctgctcagctcctagggctcctgctgctctggctctcaggtgccagatgtgactatccagatgaccctagtcctccatccctccctgtctgctatctgttgganacgagacgtccaaccatcacgttcggccggcaagtcagagctagttacncttaacttttaagtgtactctacgttaacaaacgacgggaaacccgccccgaaggtccctacccgtactacgttccgtaacggtcgtcctaccgtagttcgcggtaaggtacggtaccggtacccaaacgtacggttcgaaggtcggacgtaaggtacgggtaggtacggggaactagtactttctacgttcctactacttaactaactacgtacacctacgtaacggaattactttacgaccttaacttacgtactacggtactaacgagttaacctactaacgttacctccgttagaccgttacgtacccgacgtaccgggtactaacgggtaacgtaactaaccggtaaggtaccgttacggacgtacgtaccgtacctacccggtattccggtactttacg

SEQ ID NO: 73317 - DNA, 737 bp, Homo sapiens
  misc_feature: GYAE6OF02FMM5F.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatgacccagtctccattccctccctgtctgcatcctggagcgacagacgtcaccatcacttcgccgaggcgagtcaggaacattagaacctaattaacttttaaagttggttactcgtaaggcgtaaaggaaggccgaaggggtacgttccggaccccttaaagtcccgtacctcgtaattccgtaacgtatcgtacctttactaaaggttttacgaaaaaccggtcggggtaccctaagtacggttaaacggttcgtaaggttcaacggtaagttccgtaacgtcgttacgggtaactaggtttaacttttactttacgtactacttactaccaccgtaccgcgttacgacgttacgttacgtaagtaaggtaatttacgtgaaactattactttaacgtttacttaccgttaacgttacgttaaggtttcgtactttacggtacctttaccccgtcccggttaacccggttacccgggttacccggttaacccggggtaaacgggttaaccccggttaaaggggttaaccgttaaaacgggtcccggtaaaaaccggttcggtttaaccgggg

SEQ ID NO: 73318 - DNA, 637 bp, Homo sapiens
  misc_feature: GYAE6OF02JFW82.36.39.D06.1.454.CMB.1.raw
  modified_base (170)..(170): a, c, t, g, unknown or other
  misc_feature (170)..(170): n is a, c, g, or t
  modified_base (202)..(202): a, c, t, g, unknown or other
  misc_feature (202)..(202): n is a, c, g, or t
  modified_base (444)..(444): a, c, t, g, unknown or other
  misc_feature (444)..(444): n is a, c, g, or t
  modified_base (498)..(498): a, c, t, g, unknown or other
  misc_feature (498)..(498): n is a, c, g, or t
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcgaggtgccagatgtgacatccagatgacccngtctccatcctccctgctgcatctgtagcganacgagtcaccatcacttgaccagcgagtcaggcattcgacaactattaaagttggattcagacagaacgcagggatcggacccctaagctacctgtatactactatgccttacctaaatttacgaaaaaccgtcgggggttaccctaagacctaaagggtttccaacggttacgtcgtaaaacgttcggaaacgttcggttacggggaaacgtaacgggttaacttttttaaccggttttanaaaccgttcgaaacttaccgaaccctacggtacccttagacgtactaccgttanaaacggtattaattgacaactactatttcgtcgttaacaacttaagttcgtactgttaactcccgttcccgtaccgtacggttccggacgtaaccgggtaacgtaaccgggttaagtaagaccgtaaacgtagtaccgg

SEQ ID NO: 73319 - DNA, 676 bp, Homo sapiens
  misc_feature: GYAE6OF02F6ZAK.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtctccatccctcctgtctgcatctggtacggcgacagagtccacctatcacttgccgaggcgagtcacggactagttacgaactaacttaatttaaagttaggtactacgagacgagaacgacgagggacgtccggaccctaagcctacgtagtactacgtacgatcgtacttactaagttaacgaaacgtacgggtacctagtacgtaaggttcgtagtcgacgtaacgtacgtagtcggtagggtaactaggtttacttttacttacgagtactactaccaaccgtacgtcccgttagccgttacgttacgtaagaacgttattacgttagaacctaacgttattttacgtttcgtacttaactaacggttgtttacgacgttacgttaacctccccgtttacccggtaaccggtttacccggttaaccgggtaaccggtaaaccgggtacggttaacgggtaaccgtaaaccgttaacccggtaaacgttacggtaacggg

SEQ ID NO: 73320 - DNA, 781 bp, Homo sapiens
  misc_feature: GYAE6OF02GDEDE.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctccgtggggctcctgctgctctggctctcaggtgccagatgtgacatccgagatcgacccagtcctccacttccctcccgtgttctcgctatcgttaggtacggacgacgagtacgtccaacctatacctacgttcggccgtagggcgtacggtacaacggtaactagtacgaaactaacgtttaaattttaaaacgttggtaattcgaacgtacgaaacggaacggaccggtaaggggtaccgtaccggtaccccggttaaaggtccctttaccgtagtaccgttacttaacgtaacttcgtaccgtttaacctaaacgtttaaccgggaaaaacggtccggggttaacccctaaggttaaaccggtaacggttaccgtacggttaacgtaccgtaacgggtacgtacttacggggtaagggtaacctttacggtttaactttttaccgtttacgactaccgtactaccgtaaccgtaccgttcgtacggtaccttacgtacgtaagggtaaactacgttaattacgaaacttaacggttaactttcgtttacaacgttaccaacttaggtttcagttaccgtacttcccgttccgtaccggttaccgtccgggaaccgaacgggtacgttaacggtaacggaacctaacgggtaacgtaggtaccgg

SEQ ID NO: 73321 - DNA, 762 bp, Homo sapiens
  misc_feature: GYAE6OF02FQLKG.36.39.D06.1.454.CMB.1.raw
  modified_base (339)..(339): a, c, t, g, unknown or other
  misc_feature (339)..(339): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtctccatccctcctgtctgcatccgtggtacggacgacagacgtccaccatacctacttgaccgaggacgagtacaggactagttacgaactaacttaatttaattggtatcagacgaacgaacgccgagggacgtccggaccctaagcctcctgtattcgaacgtntcgtccttaccgtaattacgaaacgtcggtacctaagtacgtaaggtactagtacgtacgtaaggtccgtacgttacggtacggtaaacgttacgtttaacgttttttaaccgtacgtacgtaccgtaacgttaccgtaaccctacgggttcccttacggtacccgttagtaaccgttaagtaaacggttaattacgtttacggaacctttaaagtttaaccgtttttacgttttaacgttaccgttaaaccgttaacggttttaacgtttaccggtacgtttaaccgttaccgttttaccccggtttaaccccggttaacccgggttaaccccgggttaaccgggtaaccccggttaaacgggtaacccggtaacggggttaaacgaaaccggtttaacggaacccggttaacggttacggg

SEQ ID NO: 73322 - DNA, 895 bp, Homo sapiens
  misc_feature: GYAE6OF02IHS4A.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctccgtggggctcctgctgctctggctctcaggtgccagatgtgacatccagatacgacccagtcctccacttccctccctgtctcgctattctggtacggcgactaggactccaaccctattcctaacgttcgaccgaggggaccgtacggttacgaagggtaccttaagttacgaaacttaaacgtttaagttttaaaagtttgggttaactaccgtaaagaccaaacggtaaccggtacccggtaagggggtaaccgttacccgggtacccccgtaaaggtcccttacccgtaagtaacctttccgtaacggtagtaccgtttaaccgttttaaccgtaaacgttttaaacgggaaaacccggtaccggggttacccttaaacgtaacggtaacgggtttaccaacggttacaaccggttacggtacgtaaccgtttacgggtaacggggtaacctttaaggttttaaccgttttttaacccttacgaacggttaccttaaaccgttcccgtaaaccgtaccggttacccgtttaggacccttaaacgggttactaaggtaaacgttaacgtttacgttaacgaaacttaaaccgtttaacttttaaggttttaccctggtaaacctttaacggtttacgtttacgaccttacgttaaccctttcccggtaaacccccggtttcccgggttaacggttaaccccggggaaccgttaacggggtaaacccgtaaacggggtttacggaaaccctaaccggtaaccggtttacggtaaccggg

SEQ ID NO: 73323 - DNA, 710 bp, Homo sapiens
  misc_feature: GYAE6OF02H3KEE.36.39.D06.1.454.CMB.1.raw
tcagtacgctgtctcacgaccggtgctcgatttagtgacatctcgcagttctttgggggcaggagtctctctcagtcaggacacagcatggacatgagggtccctgctcagctccgtcgggactcctgctgctctggctccagactaccagatgtgacactccgagactgaccctagtttccacttcctcccgtgtctacgctacttcgtagggtaagacgacgaggtaccgttccaacctacttcgtacgttcggtaccggggttgacggtcgacgggtataacttaactacttacttacgttcggtacgtaggttacacgaacgtaacaaacggaaacggacggtaaacgtcctaaccgtacgaccttccgagtatagtatgattggtctcgtactagtctactacgtaccggtcggttaccctgttccggttaacggttccgagggttacgccggtaggtacggtagttaacggtagggtaccgtagttacccgacttcctaccaccgttacgccgacgtcgtacccgtcgacgtcgtaaccggtctaagggtatacgtacgttactaacgtttaatttagttaacgttaacgtaacttaaacggttcgtaggttacgtccggtacccgtaccgttacgttaccgggttaccgtttacggggaccggggttacgtaaaccgggtacgggtacggtaacggtaaccgg

SEQ ID NO: 73324 - DNA, 838 bp, Homo sapiens
  misc_feature: GYAE6OF02JNOTD.36.39.D06.1.454.CMB.1.raw
  modified_base (154)..(154): a, c, t, g, unknown or other
  misc_feature (154)..(154): n is a, c, g, or t
tcagtacgctgtctcacgaccggtgctcgatttagtgacatctcgcagttctttgggggcaggagtcacgtcccaaccaggacacagcatggacatgacggtccctgctcagctccgtgggctcctgctgctctggctctcgaggtcgccaagntcgtcgactacgtccagactccgaaccctgtcctcactccctccgtgtctacgctagtctacggtcggcacgagtacgtccaactgtacctacggtccgacgacggtcgtacgacgaacggtattacgtacgaacttaaacgttttagtttaaaaggttcggttaacacggtaacgacgtaacgggtaaccgtaccggtaacggtaaccgttccgggtaacccgttaacgttcccttaccgtacgtaacgttaccgttaacgtacgttcgtaacccgttaacttaacggttaaaccggaacggtaccgggttaaccctagttaaccggtaaagttcctaaaggtcgtaacggacgttacgtcgttacggtaaccgtacttaacgttactttaaccgttaccgaacgttcctaacgtaaccctaccgggaccgttaccgttaccggtaccgttaagggtaccgtaacggttaacgttaccgttaacggttacgttaaaccttaaagtttaacccggttttcttaacgttaccgttaaccgttacgttcgtttacgttacttacccgtaccggttaccccgttaccgggttaccgttaccggggttaacccgttacgggtaaaccggttaccgggttaacggtaaccgttaaaccggtaaccggtaaaccgtttcccgggtaacgg

SEQ ID NO: 73325 - DNA, 591 bp, Homo sapiens
  misc_feature: GYAE6OF02F3ZHQ.36.39.D06.1.454.CMB.1.raw
  modified_base (131)..(131): a, c, t, g, unknown or other
  misc_feature (131)..(131): n is a, c, g, or t
  modified_base (291)..(291): a, c, t, g, unknown or other
  misc_feature (291)..(291): n is a, c, g, or t
  modified_base (339)..(339): a, c, t, g, unknown or other
  misc_feature (339)..(339): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
  modified_base (450)..(450): a, c, t, g, unknown or other
  misc_feature (450)..(450): n is a, c, g, or t
  modified_base (479)..(479): a, c, t, g, unknown or other
  misc_feature (479)..(479): n is a, c, g, or t
tcagtacgctgtctcacgaccggtgctcgatttagtgacatctcgcagttctttgggggcaggagtcagtcccaacaggacacagcatggacatggacgggtccctgctcagctccgtggggctcctgtcngctcgtggctctcgaggtgaccagatggtgacactcagatcgacccagtctccactccctccctgtctgccattctggtacggacgacagagtccacctatcacgtcgccgtagcgagtacaggactatagaacttaagttatttaagtggtactcacgngaaggacgaccgaagggtcacggccctaagtcctcagtactcgtacgntcgtacttaacaagttacgaaacggtcggtaccagtacgtacggttanacgtgagagtacncgtggtacgaatcgtttaattttcgtcacgtactacacctacgcgtccgngtacgagtacggtaataggttatacgtanactatactttaggttctacgtatacgttatgtactaggtaccttccggcccttacggttacccgacggttaacccgacgtaacgtacggtaagactaaccggaactcggtag

SEQ ID NO: 73326 - DNA, 839 bp, Homo sapiens
  misc_feature: GYAE6OF02GDITR.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccagatcgacccagtcctccacttccctcccttgtctcgctacttcgttaggtacgggaccgtaaccgtaggacgttaccaaccctacttacccgtaccgttcggcccgaacggggaccgtaacggttaccaaacgggtaacctacgtttaacggaaaaccttaaaccgttttaaagtttttaaaacggtttgggttaaactaccgtaacggtacgaaacgggtaaacggacccggaagggggtaacgtacccgggtaacccccgtaagtcccgttaccgtcgtaacttaccgtaaccgtattccgttaccttaaccttaaaagtttacggaaaaccggtccggtacctaagtacgtaggttacgagtacgtactaaggtcgacgttcggtacggtaacgtacgttttaacgttttacgttacgtacgtactacctacctaaccgaccgtaccgttacgaccgtaacggttacgttaacgttaaacgtacgttacgtttacgaaccgttaaacgttacgttttacgtttacgttacgttaaccgtaacgttacggtttccgacgttacgttaccttcccggtcccttacccgggttaaccggttcccgggtaaaccggtaacccgggttaacggttaacgggtaaccggtaacgttaacccggtaaacggttgtaaccggg

SEQ ID NO: 73327 - DNA, 838 bp, Homo sapiens
  misc_feature: GYAE6OF02I93GB.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctccgtggggctcctgctgctctggctctcaggtcgccagatgtgacatccagatcgacccagtctccactcctccgtgtctgcatcgtaggtagcgacaggacgtaccaaccgtatcctaacgttcgaccgtaaggcgaggtacgaacggtactagttacgaacctaactttaagttttaaagttggtaactacggactacgaaacggacgaccggtaaggggtaccgttacccgggacccctaaaggtccgtttaccgtacggtaacgttccgtaaaggttaccttaccggttaaccttaaccgtaaaagtttaccgggaaaaacgttccggggtaaccctaaacggtttacgtaaaccggtttacgaacggtaccgtaacgttaaacggtctaacgttacggttagggaacttaaggttttaacctttttaaccgtagtaccgaaccgttacttacccgaaccgtaacgtcccggttagttacggtaaccgtacggtaacggttaaaccggtaactttaagggttaccctaaccttaacgtttaaacgttttttcgttaccgtttaaacgtaccctttaaaggtttacgttccggtttacttaacgttccctttaccccggttcccggtttaacccgggtaaggttaccccgggtaaccggaaacggtttaacccggaacggggttaaaccttaaaccgaacggtaaaccgtcgggttaaccgg

SEQ ID NO: 73328 - DNA, 805 bp, Homo sapiens
  misc_feature: GYAE6OF02I9HNO.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctccgtgggctcctgctgctcgtggctctacgaggtgccagatggtagactatccagatcgaccctagtcctcctactccctccgtgtctcgctagtcgtggtacggacgacgagtacgtccaacctattccgtacgttccggaccgaggtacgtacgtacgacggtacttagttaacgaaacttaacgtttaaattttaaaacgtggtaacctagaacggtacgaacgaacgccggtaaggggtactccgggtaacccctacggtctccgtacgtacgttccgtaacgtcttacctaccgtttaaactaaacggttaaacggaaaccggtccgggtaaccctagtaacgttaacgggtcgtaagtcgaacgtacgtcgtacgtacggtacggtaacgtaacgttttacgttttaacgtactacgtacgtaacctccgtaacccgaggttccgtagtaaccttaacggttagaaacggtaacttaaagttccggttaaactaacgttaaaccgtttaagtttttaccgtacgttaaccgtttaacgttacccggttagttaacgttcgttaacttccggtttaccccgtaaccggttcccgggttaaaccgggtacccggtaaaccgggtaaaccggtaaccgggttaaaggttaaaccgtaaacccggttacgaaaccggttacggttccggg

SEQ ID NO: 73329 - DNA, 726 bp, Homo sapiens
  misc_feature: GYAE6OF02GAA3O.36.39.D06.1.454.CMB.1.raw
  modified_base (487)..(487): a, c, t, g, unknown or other
  misc_feature (487)..(487): n is a, c, g, or t
tcagtacgctgtctcacgaccggtgctcgatttagtgacatctcgcagttctttgggggcaggagtcagtcccaaccaggacacagcatggacatgagggtccctgctcagctcctgggctcctgctgctctggctctcgaggtgccagatgtgacatccagatcggacccagtctccatccctcctgtctgcatcgtagtacgctacagagtcacatcactagccgacggcgacgtcgaggactattcgaactaacttaatttaaagttggtatcagtacaaggaacggccgtaagggactccggacccctaagcctacgtacgactcgtacgtatcgtacttactaattacggaaacgtcggggtacctaacgttacgaacggttacaagtacgtacgaacgtcgtaacgtcggtaacggtacgtaaagttttactttttaacctttcgaacgttccgtaactaccctaaccgtacgttacccgngttaacccgagtttccgtaaagaacggtttataacgttagtaaccctaagttaacgtttacgttttaccgtacgggttaaactacgtttaacggttcttaacggttacgttaaccctttcccgttaaccccggtacccggtttaaccggttaccccggggaacccgttaaacgggggtaaccccgtaagggtttaaaccggaaacccgttaaacggtaaacccggtacgtttaaccggg

SEQ ID NO: 73330 - DNA, 688 bp, Homo sapiens
  misc_feature: GYAE6OF02H1KPE.36.39.D06.1.454.CMB.1.raw
  modified_base (119)..(119): a, c, t, g, unknown or other
  misc_feature (119)..(119): n is a, c, g, or t
  modified_base (134)..(134): a, c, t, g, unknown or other
  misc_feature (134)..(134): n is a, c, g, or t
  modified_base (181)..(181): a, c, t, g, unknown or other
  misc_feature (181)..(181): n is a, c, g, or t
  modified_base (575)..(575): a, c, t, g, unknown or other
  misc_feature (575)..(575): n is a, c, g, or t
  modified_base (595)..(595): a, c, t, g, unknown or other
  misc_feature (595)..(595): n is a, c, g, or t
  modified_base (622)..(622): a, c, t, g, unknown or other
  misc_feature (622)..(622): n is a, c, g, or t
  modified_base (682)..(682): a, c, t, g, unknown or other
  misc_feature (682)..(682): n is a, c, g, or t
tcagtacgctgtctcacgaccggtgctcgatttagtgacatctcgcagttctttgggggcaggagtcagtcccaaccaggacacagcatggacatggagggtccctgctcagctcctgnggcctctgctgctcnggctactcgaggtgaccagatgtagacataccagatcgacccagtcnccactccctcctgtctgctatctaggacggcacagactaccactagtactactcgaccgaggtacgagtcgaggtacctagttagaacttaaactttaaagttttaaagttggtaactacgagaccgtaaggaaccggacggtaacgggtactacccggaccccgttaaagtcccgttaccgtagttaccgttaccgtaacgttacgttttacccgtttaaccgttaaaggtttaaccggaaaaccggttacggggtcctaacgtaccggttaaagttccgaaggtctaaccggtagttacgtacgtacgtaaggtacttaactttttacgtttcctagacgttacaaaccgttccgaaccgtacgccgttacgacttcggtaataggaacttntacgttacgataaccgtttntacgtttacacgttcaaattccgttancgtacctcgtcctccgtacggtccgtaacgacggtacgacgtaaggacctaacacgaccnggttcg

SEQ ID NO: 73331 - DNA, 794 bp, Homo sapiens
  misc_feature: GYAE6OF02FM6XD.36.39.D06.1.454.CMB.1.raw
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtgccagatgtgacatccgagatcgaccctagtcctcctactccctcctgtctgctatcgtaggtacggcacgaggtacgtaccaacctacttcctacgttcgaccgtacgggcgacgtcgaacggactaacgttacgaactaaaaccgtttaatttttaaaacggtttcggttaattaccgagaaccgaaggtaacggaccgaggggtacgtaccgggaccccgtaacgtccgtccgtaggtaacttaccgtaacggtactcgttacccgttaccttaaacgttaaaccgggaaaaacggttacccgggggttaccctaacggttaacgttaaaccgggttacgtaacgggttcaacggtaacggttacggtaacgtagggtttaccggtaacgtaaacgttttagttttaaccgtttaccgtaacggtactaactacccgtaaccgtaccgtcgttacgaccttaacggtcgttaaacggtaattaactttagttaccgtaaacttaaacgttactttaaacgtttcgtttaaacgttaccgtaaactttagttcgtacgttacgtacctttcccgttacccgtaccggttacggtcccggaaccggtaacgggtaccgaaggtaacgactaacggtaactaggtaccgg

SEQ ID NO: 73332 - DNA, 786 bp, Homo sapiens
  misc_feature: GYAE6OF02HCPLV.36.39.D06.1.454.CMB.1.raw
tcagtacgctgtctcacgaccggtgctcgatttagtgacatctcgcagttctttgggggcaggagtcagtcccaaccaggacacagcagtggacagtggagggtccctgctcagcctccgtgggctcctgctgctcgtggctctcgaggtcgccagatgtcgacactccgaagacgtaccgacccctagtcctaccaccttccccgttcccgtgttcgtacgtcctaagttcgttacgggacgaccggaccaggtaccttaccaacccgtataccgtacgttccggccggaaggtccggaacggttcgaaaggtactagttaacgaaacccttaaagtttaagtttttaaaccggttggtactaccggtaacggtaccaaagggaaaaccggtccggtaaagggtaccgtaccccggttaccccgtaaagtcccgttacccgtagacctttaccgaacggtacgtccgttaccttaaacgttaaagttaacgaaaaccgggtccggtaacccttagtaacggtaaccggtctagcggactaaacgcgtaactcgggtacgtacgttaactttacgtttttacgacgaacgtacacgttacccgacgtactacgtacgagttaccgtagacgattagactacgtactaacgtgttaaccgtttacacgtttaaacccgagttcgttacgtacctaggtaccccttaccgtccgtaccggtttaccgtccggtaacccgtacggtaaccgtaggtaaccgtaacgtaaccgtaccggttacgtaacgg

SEQ ID NO: 73333 - DNA, 897 bp, Homo sapiens
  misc_feature: GYAE6OF02JACN6.36.39.D06.1.454.CMB.1.raw
tcagtacgctgtctcacgaccggtgctcgatttagtgacatctcgcagttcgtttgggggcaggagtcagtcccaaccaggacacagcatggacatgagggtccctgctcagctccgtggggctcctgctgctctggctctcaggtcgccgagtatgtgacactccagactacgacctagtcctcctactccctcccgttgtctcgctatcgtggtacggaccgaacgagtacgtaccaaccctacttaccgtaacgttcggaccggacggggtaccggtaacggtacgtaacgggtaacttagttaacgaaaccttaaaacttttaaagttttaaagttcgggtaacttaggaaccgtacgtaaaacggaccggaccggtaacgggtaccggtaacccggtaccgtaaaccgtccgttaccgtaggttaaccgttacgtaacggtaccgtacgttaacccttaaaccggttaaaggtttaaaccggaaaacccgggttaccgggttaaccccgttaagttaaccgggttaacgggttacgtaacggtaaccggttaacgtaaacggttacggtacggttacggtaaccggttatttaaccgtttacgttttaccggtaccgtactaacgtacctaccggtaaccctcgggtaccctgtacgttacgttaacgtaagtacgtagttacccgttaagtaccttaaagtttccgttttaacttacgggtacgtttaaccgtttaaacggttgggtttaccctacgttaccggtttacccgttacccgtttacccgggtaaccggttaaccccggggttaacgaacccggggttaaaccggttaacgggtaacccggttaaaacgttaacccggggaaaccctttagggaccgttacggg

SEQ ID NO: 73334 - DNA, 760 bp, Homo sapiens
  misc_feature: GYAE6OF02HNHKK.36.39.D06.1.454.CMB.1.raw
  modified_base (145)..(145): a, c, t, g, unknown or other
  misc_feature (145)..(145): n is a, c, g, or t
  modified_base (154)..(154): a, c, t, g, unknown or other
  misc_feature (154)..(154): n is a, c, g, or t
tcagtacgctgtctcacgaccggtgctcgatttagtgacatctcgcagttctttgggggcaggagtcagtcccaaccaggacacagcatggacatgagggtccctgctcagctcctggggctcctgctgctctggctctcaggtnccagatgtnacatccagatcgaccctagtctccactccctccctgtctgacatcgtaggtacggaccgaacagtacgtaccaccagttacctaacttcggacccaagggtccgagttacgaacggacctattacgaactaaaactttaattttaaaagttggtaactacgaagccgtaaggaacgacccgtaaggggactaccggtacccccgtaagccctttaccgtacgtaacttaccgtaacggtacttacgttacccgttaacctttaaagtttaaacggaaaaccggttaccgggtaacccctagttaacgtaacggttacgtaagtacgaacgtaacggtacgtacgttacggtagggtacctaaggtttactttttaactacgacgtctaactacaccgtacgtaccgtagaccgtacggttacgagtaaagtacttaacgtacggtaactaataactttacgtttcttaacgtacttaacgtaagtttcgtaacgttagtaccttacccgttccccgtaccggttacccggttacccggtaaccggtaaacggtaaccggttaacgggtaacggtaaaccgtaacggtaacccgtaggttaaccggg

SEQ ID NO: 73335 - DNA, 886 bp, Homo sapiens
  misc_feature: GYAE6OF02FXPAK.36.39.D06.1.454.CMB.1.raw
  modified_base (154)..(154): a, c, t, g, unknown or other
  misc_feature (154)..(154): n is a, c, g, or t
tcagtacgctgtctcacgaccggtgctcgatttagtgacatctcgcagtttctttgggggcaggagtcagtcccaaccaggacacagcatggacatgagggtccctgctcagctccgtggggctcctgctgctctggctctcgaggtgccaagntggtgacatccgagatcgacccagtcctccatcccgtcctgtctgactacttcgtgtacggcgaactacgacgtaccacctattacccgtacgtttcgaccgaggaccgtagtaccgaacggtactagttacgaacttaaacgtttaagtttaaaagttcgggttaacttaccgacggtaacgtaacggaaaccgggtaccgtaaggggaaccgttccgggaaaccccgttaacgtaccctttacccgtaacctacgttacgtttaagtcgggtaccaccttaccgttaaccgttaaccggtttaaaccgaaccgggtttaccgggttaacccttaaaaggtttaaccgtactttacgaacggggcgttaaccggtagttacggtacttacggtacgaccgtattaaccggttacttaccctacctaccgtaacctacgtaccttacgaccgtaccgtacgtcccgtacggtaccgaacctacggtttaaccggtaagttttcccgtttaaagtacccttttaaaacgtttacgtttaaaccggttcggtttaaaccttaaggtaaaccgttttacccgttaaacgtttaaccccggttttaacccggtacccggtttttaaacccgggttaaaccgggttaaccccgggtaaacggggttaacccggttacggggttaaaaccggttaaacccggtttaacccggtaaaccggtttaacggttaaccgggg

SEQ ID NO: 73336 - DNA, 423 bp, Homo sapiens
  misc_feature: GYAE6OF01C44KM.10.42.D09.1.454.CMB.1.raw
  modified_base (422)..(423): a, c, t, g, unknown or other
  misc_feature (422)..(423): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgttgactcctggggccagggaatcctggtcaccgtctcctcagcctccaccaagggcccatcggtcttcccctggcgccctgctccaggagcacctccgagagcacagcggccctgggctgcctggtcaaggctacttcccactactatgctgagcgggctggcaaggcgcatagnn

SEQ ID NO: 73337 - DNA, 440 bp, Homo sapiens
  misc_feature: GYAE6OF01DAM71.10.42.D09.1.454.CMB.1.raw
  modified_base (424)..(424): a, c, t, g, unknown or other
  misc_feature (424)..(424): n is a, c, g, or t
  modified_base (430)..(440): a, c, t, g, unknown or other
  misc_feature (430)..(440): n is a, c, g, or t
tcagcatagtagtgcacgaccggtgctcgatttagacacatacgcgagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggtacatgttgactcctggggccagggaatcctggtcaccgtctcctcagccctccaccaagggcccatccggtcttcccctggccgccctgcctccaggacgcacctccgagacgccacagccggccctgggctgcctggtcaaggactacttcccatactatgctgagcgggctggcaaggcncatagnnnnnnnnnnn

SEQ ID NO: 73338 - DNA, 233 bp, Homo sapiens
  misc_feature: GYAE6OF01CAYSN.10.42.D09.1.454.CMB.1.raw
  modified_base (232)..(233): a, c, t, g, unknown or other
  misc_feature (232)..(233): n is a, c, g, or t
tcagcatagtagtgcacgaccggtgctcgatttagacacatacgcagggaaagggggtcaggctggaagctgaggatgtcggggtttattactgcatgcaagctacacactttcctcggacgttcggccaagggaccaaggtggaaatcacacgaactgtggctgcaccatctgtcttcatcttcccgccatctgacactactatgctgagcgggctggcaaggcgcatagnn

SEQ ID NO: 73339 - DNA, 438 bp, Homo sapiens
  misc_feature: GYAE6OF01CLAFX.10.42.D09.1.454.CMB.1.raw
  modified_base (423)..(423): a, c, t, g, unknown or other
  misc_feature (423)..(423): n is a, c, g, or t
  modified_base (428)..(438): a, c, t, g, unknown or other
  misc_feature (428)..(438): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggtacatgtttgactccgtggggccagggaatcctggtcaccgtctcctcagccctccaccaagggcccatccggtcttcccctggccgccctgcctccaggacgcacctccgagagcacagcggccctgggctgcctggtcaaggactacttcccactactatgctgagcgggctggcaaggcnatagnnnnnnnnnnn

SEQ ID NO: 73340 - DNA, 429 bp, Homo sapiens
  misc_feature: GYAE6OF01CXQ8J.10.42.D09.1.454.CMB.1.raw
  modified_base (339)..(339): a, c, t, g, unknown or other
  misc_feature (339)..(339): n is a, c, g, or t
  modified_base (418)..(418): a, c, t, g, unknown or other
  misc_feature (418)..(418): n is a, c, g, or t
  modified_base (424)..(429): a, c, t, g, unknown or other
  misc_feature (424)..(429): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgttgactcctggggccagggaatcctggtcaccgtctcctcagcctccaccaagggcccatccggtcttcccctggccgccctgctccaggancacctcgagagcacagccggccctgggctgcctggtcaaggctacttcccactactatgctgagcgggctggcaaggcncatagnnnnnn

SEQ ID NO: 73341 - DNA, 486 bp, Homo sapiens
  misc_feature: GYAE6OF01C4Q1S.10.42.D09.1.454.CMB.1.raw
  modified_base (472)..(486): a, c, t, g, unknown or other
  misc_feature (472)..(486): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaaggctggtacatgttgactcctgggccagggaatcctggtcaccgtctcctcagccctccaccaacgggcccactccggtccttccccgtggccgcccctcgcctccaggacgccaccgtccgagacgcaccacggccggcccgtggggcctcgcccgtggtaccaaacgggaccttacccgttcccaacttactacgtcgcttggacggccgggctgggaccaagggccgacatacggnnnnnnnnnnnnnnn

SEQ ID NO: 73342 - DNA, 233 bp, Homo sapiens
  misc_feature: GYAE6OF01COWYP.10.42.D09.1.454.CMB.1.raw
  modified_base (231)..(233): a, c, t, g, unknown or other
  misc_feature (231)..(233): n is a, c, g, or t
tcagcatagtagtgcacgaccggtgctcgatttagacacatacgcagggaaaggggtcaggctggaagctgaggatgtcggggtttattactgcatgcaagctacacactttcctcggacgttcggccaagggaccaaggtggaaatcacacgaactgtggctgcaccatctgtcttcatcttcccgccatctgacactactatgctgagcgggctggcaaggcgcatagnnn

SEQ ID NO: 73343 - DNA, 441 bp, Homo sapiens
  misc_feature: GYAE6OF01CPD1W.10.42.D09.1.454.CMB.1.raw
  modified_base (432)..(441): a, c, t, g, unknown or other
  misc_feature (432)..(441): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatcctggtcaccgtctcctcagcctccaccaaggcccatccggtccttcccctggccgccctgctccaggacgcacctccgagacgcacagccggccctgggcctgcctggtcaaggacctacttcccatactatcgctgagcgggctggacaaggcgcatagnnnnnnnnnn

SEQ ID NO: 73344 - DNA, 526 bp, Homo sapiens
  misc_feature: GYAE6OF01B860K.10.42.D09.1.454.CMB.1.raw
  modified_base (490)..(490): a, c, t, g, unknown or other
  misc_feature (490)..(490): n is a, c, g, or t
  modified_base (492)..(494): a, c, t, g, unknown or other
  misc_feature (492)..(494): n is a, c, g, or t
  modified_base (499)..(502): a, c, t, g, unknown or other
  misc_feature (499)..(502): n is a, c, g, or t
  modified_base (504)..(517): a, c, t, g, unknown or other
  misc_feature (504)..(517): n is a, c, g, or t
  modified_base (519)..(522): a, c, t, g, unknown or other
  misc_feature (519)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
tcagcatagtagtgcacgaccggtgctcgatttagacacatacgcaggggtaaagggggctggagtggggtctcggactacttaaatggtcttgctggataattacacactacgcagacttcgtgaagggccggttcaccatctcgagagacaactaccaagaacaacgcgttgaatctgctaaaatgaacagcctgagagccgaggacacggctgtatattactggtgtgagggactcgtccccccaggaaacggcgtggttacatcgtttgactccgtggggccagggaatcctggtacaccgtactcctcagcctccaccgagggccccagtccggtccttcccccgtggccgcccgtgccgtccgacgggacgccaacctcgagacgcacgagcggccgtgggactcgccgtggtaccaaggtaccttacgttcccgacttaccgtatcgactggacgcggggactggacctaagggcgacatgantnnnacgannnngnnnnnnnnnnnnnncnnnngngn

SEQ ID NO: 73345 - DNA, 488 bp, Homo sapiens
  misc_feature: GYAE6OF01DZHDL.10.42.D09.1.454.CMB.1.raw
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (430)..(430): a, c, t, g, unknown or other
  misc_feature (430)..(430): n is a, c, g, or t
  modified_base (457)..(457): a, c, t, g, unknown or other
  misc_feature (457)..(457): n is a, c, g, or t
  modified_base (461)..(488): a, c, t, g, unknown or other
  misc_feature (461)..(488): n is a, c, g, or t
tcagcatagtagtgcacgaccggtgctcgatttagacacatacgcaggggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtcccccagaaaggctggttacatgttgactccgtgggccagggaatcctggtcaccgtctcctcacgccctccaccgaacggcccactccggtccttccccctgggccgccccttcgcctccgaggcnccacctcgagngcacagccggccctgggctcgccgtggtcgaaggtcctacttccccatactatgctggacgcgggtcngggtaccaagggcctacgaatggctgnagcnnnnnnnnnnnnnnnnnnnnnnnnnnnn

SEQ ID NO: 73346 - DNA, 452 bp, Homo sapiens
  misc_feature: GYAE6OF01C039Q.10.42.D09.1.454.CMB.1.raw
  modified_base (447)..(452): a, c, t, g, unknown or other
  misc_feature (447)..(452): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtcccccagaaagggctggttacatgttgactccgtggggccagggaatcctggtcaccgtctcctcagcctccaccaagggccccatccggtccttccccctggccgcccctgctccgaggacgcacctccgagacgcacaggccggccctggggctcgcctggtaccaaggaccttaccttccccaactactatgctgacgcgggctggcaaggccgcatagnnnnnn

SEQ ID NO: 73347 - DNA, 464 bp, Homo sapiens
  misc_feature: GYAE6OF01DP3YF.10.42.D09.1.454.CMB.1.raw
  modified_base (430)..(430): a, c, t, g, unknown or other
  misc_feature (430)..(430): n is a, c, g, or t
  modified_base (454)..(464): a, c, t, g, unknown or other
  misc_feature (454)..(464): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatgtcccccagaaaggctggtacatgttgactccgtggggccagggaatccgtggtcaccgtctcctcacgcctccaccgaacgggcccacgtccggtccttcccccgtggccgcccctgcctccaggcgcacctcgagacgcacgagccggccgtgggctcgccgtggtacaacggacctaccttcccattactatcgctggacgccgggntcggacgaaggccgtacacgtagnnnnnnnnnnn

SEQ ID NO: 73348 - DNA, 476 bp, Homo sapiens
  misc_feature: GYAE6OF01DBK6V.10.42.D09.1.454.CMB.1.raw
  modified_base (465)..(476): a, c, t, g, unknown or other
  misc_feature (465)..(476): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtcccccagaaagggctggttacatgttgactccgtggggccagggaatccgtggtccaccgtctcctcacgccctccaccgaacgggcccactccggtcccttccccgtggccgtccctcgcctccgaggacgccacctccgagacgcacgacgccggcccgtggctcgccgtggtacaacggaccttaccttcccaacttactatcgcgtaggacggccgggctggacaagggcacatagnnnnnnnnnnnn

SEQ ID NO: 73349 - DNA, 364 bp, Homo sapiens
  misc_feature: GYAE6OF01BEAOD.10.42.D09.1.454.CMB.1.raw
  modified_base (358)..(364): a, c, t, g, unknown or other
  misc_feature (358)..(364): n is a, c, g, or t
tcagcatagtagtgcacgaccggtgctcgatttagacacatacgcagggaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttcccctggcgccctgctccaggagcacctccgagagcacagcggccctgggctgcctggtacaaggactaccttcccactactatgctgacgcggctggcaggcgcatgnnnnnnn

SEQ ID NO: 73350 - DNA, 522 bp, Homo sapiens
  misc_feature: GYAE6OF01DVW2K.10.42.D09.1.454.CMB.1.raw
  modified_base (490)..(522): a, c, t, g, unknown or other
  misc_feature (490)..(522): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaaggctggtacatgttgactcgtgggccagggaactcctggtcaccgtctcctcagcctccaccaagggcccagtccggtcttccccctggccgccctgcctccgaggacgccaccgtccgagacaccacgacgccggcccgtgggctcgcccgttggtaccaaacgggtaccttaccgttacccctaaccgttaaccttactcggtacgttacgggaacggccggggacgttcgggacgaagggcccgctaagtaggnnnnnnnnnnnnnnnnnnnnnnnnnnnnnnnnn

SEQ ID NO: 73351 - DNA, 500 bp, Homo sapiens
  misc_feature: GYAE6OF01EEBVP.10.42.D09.1.454.CMB.1.raw
  modified_base (486)..(500): a, c, t, g, unknown or other
  misc_feature (486)..(500): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtcccccagaaaggctggttacatgtttgactccgtgggccgaggaatccgtggtcaccgtctcctcacgcctccaccgaacgggcccacgtccggtccttccccctcggccgccccgtcgcctcccgaggacgccacctccgagacgcacacggccggcccgtcgggcgtcggcctcggtacgaaacggtacgtaccttccccaacttactaagtgacgttgacgggtccgggtcgtcggaccgaagggtccgactagtacgnnnnnnnnnnnnnnn

SEQ ID NO: 73352 - DNA, 389 bp, Homo sapiens
  misc_feature: GYAE6OF01EYYY2.10.42.D09.1.454.CMB.1.raw
  modified_base (273)..(273): a, c, t, g, unknown or other
  misc_feature (273)..(273): n is a, c, g, or t
  modified_base (376)..(389): a, c, t, g, unknown or other
  misc_feature (376)..(389): n is a, c, g, or t
tcagcatagtagtgcacgaccggtgctcgatttagacacatacgcagggaaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtccttcccctggcgccctgctccaggngccacctccgagagcacagccggccctggggcctgcctggcaagggactaccttcccactactatgctggacgcggggactgggacaacgggcgcaatagcgnnnnnnnnnnnnnn

SEQ ID NO: 73353 - DNA, 473 bp, Homo sapiens
  misc_feature: GYAE6OF01B87OI.10.42.D09.1.454.CMB.1.raw
  modified_base (460)..(473): a, c, t, g, unknown or other
  misc_feature (460)..(473): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtccccccagaaagggctggttacatgtttgactccgtggggccagggaatcctggtcaccgtctcctcacgcctccaccgaacgggcccatccggtccttcccccgtggccgccctgctccaggacgccacctccgagacgcacgagccggcccgtggggcctcggcccgtcggtccaagggtaccttaccttcccactactatgctgaggcgggcgtggacgaacggcgcgatagnnnnnnnnnnnnnn

SEQ ID NO: 73354 - DNA, 539 bp, Homo sapiens
  misc_feature: GYAE6OF01EZUAF.10.42.D09.1.454.CMB.1.raw
  modified_base (505)..(505): a, c, t, g, unknown or other
  misc_feature (505)..(505): n is a, c, g, or t
  modified_base (508)..(509): a, c, t, g, unknown or other
  misc_feature (508)..(509): n is a, c, g, or t
  modified_base (511)..(539): a, c, t, g, unknown or other
  misc_feature (511)..(539): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtccccccagaaaggctggttacatgttgactccgtggggccagggaatcctggtcaccgtctccctcacgtccctccaccgaacgggccccagtccggtccctttccccccgtgggcccgtcccctcggcctcccgagggacgccacccgtccgagacgcacgacggccggcccgtgggcctcggccgttggtacgaacggaccttaccttccccaacttactacgtcgccgttaggacggccggggtctacgggacccgtaaagggccgactaagtcggancgnngnnnnnnnnnnnnnnnnnnnnnnnnnnnnn

SEQ ID NO: 73355 - DNA, 485 bp, Homo sapiens
  misc_feature: GYAE6OF01EQ904.10.42.D09.1.454.CMB.1.raw
  modified_base (461)..(461): a, c, t, g, unknown or other
  misc_feature (461)..(461): n is a, c, g, or t
  modified_base (468)..(485): a, c, t, g, unknown or other
  misc_feature (468)..(485): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggaatctggtcaccgtctcctcacgcctccaccgaacgggcccagtcggtccttcccccgtggccgcccctgcctccgagggtacgccacccgtccgagacgcacgagccggcccgtgggctcgccgtcggtacaacggacctaccttccccaacttactatcgccgtggacggccgggctcgggcaagggccganatacggnnnnnnnnnnnnnnnnnn

SEQ ID NO: 73356 - DNA, 461 bp, Homo sapiens
  misc_feature: GYAE6OF01DH7JP.10.42.D09.1.454.CMB.1.raw
  modified_base (445)..(461): a, c, t, g, unknown or other
  misc_feature (445)..(461): n is a, c, g, or t
tcagcatagtagtgcacgaccggtgctcgatttagacacatacgcagggaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtccccccagaaagggctggttacatgttgactccgtggggccagggaatcctggtcaccgtctcctcagcctccaccaacgggcccatccggtccttccccctggcccgcccctgcctccaggacgccacctccgagacgcacagccggccctgggctcgccctggtcaacggactaccttcccactactatgctgagcgggactggcaaggcgacagtacgnnnnnnnnnnnnnnnnn

SEQ ID NO: 73357 - DNA, 402 bp, Homo sapiens
  misc_feature: GYAE6OF01BIDRE.10.42.D09.1.454.CMB.1.raw
  modified_base (350)..(350): a, c, t, g, unknown or other
  misc_feature (350)..(350): n is a, c, g, or t
  modified_base (387)..(402): a, c, t, g, unknown or other
  misc_feature (387)..(402): n is a, c, g, or t
tcagcatagtagtgcacgaccggtgctcgatttagacacatacgcagggaaagggccggttcaccatctcgagagacaacaccaagaacacgctgaatctgcaaatgaacagcctgagagccgaggacacggctgtatattactgtgtgagggatcgtccccccagaaaggctggttacatgttgactccgtggggccagggaactcctggtccaccgtctcctcacgccctccaccgaacggccccactccggtccttccccctggccgccctgcctcccaggacgccaccctccgagacgcacgacgccggccctgggctcgccgtggtaacgctactcccactactntgctgacggcgggacgtggacgaacggcgtacatcgnnnnnnnnnnnnnnnn

SEQ ID NO: 73358 - DNA, 523 bp, Homo sapiens
  misc_feature: GYAE6OF01BLI1B.10.42.D09.1.454.CMB.1.raw
  modified_base (490)..(491): a, c, t, g, unknown or other
  misc_feature (490)..(491): n is a, c, g, or t
  modified_base (494)..(523): a, c, t, g, unknown or other
  misc_feature (494)..(523): n is a, c, g, or t
tcagcatagtagtgcacgaccggtgctcgatttagacacatacgcagggaaaggggctggagtgggtctcgactattaatggtcttgctgataatacacactacgcagacttcgtgaaggccggttcaccatctcgagagacaacaccaagaacacgctgaatctgcaaatgaacagcctgagagccgaggacacggctgtatattactgtgtgagggatgtcccccagaaagggctggttacatgttgactccgtggggccaggaatcctggtcaccgtctcctcagcctccaccgaagggcccagtccggtccttccccctggccctccctcgcctccaggtacgccaccgtccgaagacgcacgtacgccggacccttcgggctacgcccgttggtacaaacggtaccttaccgttccccgaactttacctaagttcgacttaggaacgggccgggtcctagggccaaagggtccgactaagtacgnngcnnnnnnnnnnnnnnnnnnnnnnnnnnnnnn

SEQ ID NO: 73359 - DNA, 537 bp, Homo sapiens
  misc_feature: GYAE6OF01C699P.10.42.D09.1.454.CMB.1.raw
  modified_base (256)..(256): a, c, t, g, unknown or other
  misc_feature (256)..(256): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (509)..(509): a, c, t, g, unknown or other
  misc_feature (509)..(509): n is a, c, g, or t
  modified_base (514)..(537): a, c, t, g, unknown or other
  misc_feature (514)..(537): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaaatctgacaaaatgaacagcctgagagccgaggacacggctgtatattactggtgtgagggatcgtcccccaagaaaggctggtacagttgttnactcgtgggccgaagggaactcgtggtccaccgtcctctcagccctaccaaccgacggcccagtccgtcccttaccccnggcccncccgctcgccgaggacgccacccgtaccgaagacgccgaaacgcggtcccggcccgttcgggcttcggccgttacgggaaccgtaaacggtaccctttaaccctccccttaaccacgttaactcggtacgtcgggaacgtccggggagttcggaacgtaggaccgacngaagnnnnnnnnnnnnnnnnnnnnnnnn

SEQ ID NO: 73360 - DNA, 515 bp, Homo sapiens
  misc_feature: GYAE6OF01CQXDZ.10.42.D09.1.454.CMB.1.raw
  modified_base (473)..(473): a, c, t, g, unknown or other
  misc_feature (473)..(473): n is a, c, g, or t
  modified_base (487)..(487): a, c, t, g, unknown or other
  misc_feature (487)..(487): n is a, c, g, or t
  modified_base (490)..(515): a, c, t, g, unknown or other
  misc_feature (490)..(515): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtcccccagaaagggctggttacatgttgactcgtgggccaggatccgtgtcaccgtctcctcacgccctccaccgacggcccatccggtccctccccgtggccgtccctgcctccgaggcgccacctccgagacgccacgacgccggcccgtgggcctgcccgtggtaccgaacggtaccttaccctacccgaacttactacgtcggccgttaggacgggccggggtactcggggaccgtaaaggggccnccgtaagtaccggncgnnnnnnnnnnnnnnnnnnnnnnnnnn

SEQ ID NO: 73361 - DNA, 542 bp, Homo sapiens
  misc_feature: GYAE6OF01A6M6O.10.42.D09.1.454.CMB.1.raw
  modified_base (510)..(510): a, c, t, g, unknown or other
  misc_feature (510)..(510): n is a, c, g, or t
  modified_base (513)..(542): a, c, t, g, unknown or other
  misc_feature (513)..(542): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtcccccaggaaaggctggttacatgttgactccgtggggcagggatccgtggtcaccgtctcctcacgccctccaccgaacgggcccagtccggtcccttcccccgtgggcccgcccctgcctccgacggtacgccacccgtccgagacgccacgacggcccggcccgtcggggtcctcggtccgtcggtaccgtaacgggtaccttacccgttcccctaacgttaaccttagtcggcttagggacgggccgggtacgtacgggaccgaaagggcctacgagtaggcngannnnnnnnnnnnnnnnnnnnnnnnnnnnnn

SEQ ID NO: 73362 - DNA, 453 bp, Homo sapiens
  misc_feature: GYAE6OF01A21PE.10.42.D09.1.454.CMB.1.raw
  modified_base (437)..(453): a, c, t, g, unknown or other
  misc_feature (437)..(453): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaaggctggttacatgttgactcctggggccagggaatcctggtcaccgtctcctcagccctccaccaacgggcccatccggtcttcccctggccgccctgctcccaggcgcacctccgagagcacgagccggccctggctcgcctggtcaacggactaccttcccactactatcgcgtgaggcggctggacgaaggccgcatagnnnnnnnnnnnnnnnnn

SEQ ID NO: 73363 - DNA, 430 bp, Homo sapiens
  misc_feature: GYAE6OF01E1IBW.10.42.D09.1.454.CMB.1.raw
  modified_base (327)..(327): a, c, t, g, unknown or other
  misc_feature (327)..(327): n is a, c, g, or t
  modified_base (427)..(430): a, c, t, g, unknown or other
  misc_feature (427)..(430): n is a, c, g, or t
tcagcatagtagtgcacgaccggtgctcgatttagacacatacgcagggaaagggggctggagtgggtctcgactattaatggtcttgctgataatacacactacgcagacttcgtgaagggccggttcaccatctcgagagacaacaccaagaacacgctgaatctgcaaaatgaacagcctgagagccgaggacacggctgtatattactgtgtgagggatgtccccccagaaagggctggttacatgtttgactcctgggccagggaatcctggtcaccgtctcctcagccctccaccgaaggcccatccggtctcccctggcncctgctcaggcgcacctccgagagcacacgcggccctgggctcgcctggtcaaggactacttcccactactatgctgagcgggctggcaaggcgcatagnnnn

SEQ ID NO: 73364 - DNA, 767 bp, Homo sapiens
  misc_feature: GYAE6OF01A0911.10.42.D09.1.454.CMB.1.raw
  modified_base (127)..(127): a, c, t, g, unknown or other
  misc_feature (127)..(127): n is a, c, g, or t
  modified_base (651)..(651): a, c, t, g, unknown or other
  misc_feature (651)..(651): n is a, c, g, or t
  modified_base (659)..(659): a, c, t, g, unknown or other
  misc_feature (659)..(659): n is a, c, g, or t
  modified_base (678)..(678): a, c, t, g, unknown or other
  misc_feature (678)..(678): n is a, c, g, or t
  modified_base (706)..(706): a, c, t, g, unknown or other
  misc_feature (706)..(706): n is a, c, g, or t
  modified_base (733)..(733): a, c, t, g, unknown or other
  misc_feature (733)..(733): n is a, c, g, or t
tcagcatagtagtgcacgaccggtgctcgatttagacacatacgcagggaaaggggctggagtgggtctcgactattaatggtcttgctgataatacacactacgcagacttcgtgaaggccggttnaccatctcgagagacaacaccaagaacacgctagaactctgacaaagtgaaccagcctgacggacgccggtaggaccgacggtcgtagtaactagtttacgtggtaggtacggacgggtactacccggttacccccgaaaggtaaacgggtccttagggttaacctagtttcggttaccggtaccgtacccgggtacggggacccgtaaggggtaacctcccggttacgggtacctacccggttcctaccccgtacgaaccgtccccgtaacccgtaccggtaaccggggtaccccttacggttcccggttaccccgttacccccgggtcggccccggtaccccgttcggtaccccgtaccggtacgggtaacccgtaccgtaaccccgtaccggtaaacgtccgtaacccgaaccgttcgggaccccggtaccggtccgggtacctccgggtactaccgggtaacgtaccgtaccttaacccgtaccgtacctacgtacgtcgtacgtacgtacgtcggtacncggtacgnggtaccgagtacgtcgacngacgatcgactgacgtacgtcagtacgntacgcgttagccgagtactcgtaacgngtcacgtaggccttagccgtactatgtcgtaccg

SEQ ID NO: 73365 - DNA, 635 bp, Homo sapiens
  misc_feature: GYAE6OF01B9W56.10.42.D09.1.454.CMB.1.raw
  modified_base (608)..(635): a, c, t, g, unknown or other
  misc_feature (608)..(635): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaaagaaccacgctgaaatctgacaaatgaacagcctgagagccgaggacacggctgtacttattactgtggtggaggactaccggtaccccccaagggaaacgggtccttgggttaactagttggtttacgaccttccggtcggggaccgtaagggtaacttcccgtggtacctcccgttcctcctcctacgccctaccccaaccggaaccgggcccctacgtcccggttcccttcccccgtcggcccgtcccgtcgccgttacccgaagggccgtacccgtaacccgtaccggagtaccgaccctacggacggcccggtccccggtggtacgtccggtccggtacgggtacgaaacccggttacctttaacccgttaccccgtaacctacttacgtcgtggacgacggggccggtgtaccggtacgaacggcccgacgtacgtaggcctggacaggcnnnnnnnnnnnnnnnnnnnnnnnnnnnn

SEQ ID NO: 73366 - DNA, 728 bp, Homo sapiens
  misc_feature: GYAE6OF01CZORG.10.42.D09.1.454.CMB.1.raw
  modified_base (700)..(704): a, c, t, g, unknown or other
  misc_feature (700)..(704): n is a, c, g, or t
  modified_base (706)..(728): a, c, t, g, unknown or other
  misc_feature (706)..(728): n is a, c, g, or t
tcagcatagtagtgcacgaccggtgctcgatttagacacatacgcaggggaaaggggctggagtgggtctcgactattaatggtcttgctgataatacacactacgcagacttcgtgaagggccggttcaccatctcgagagacaacaccaagaacacgctagaatctgacaaatgaacagcctgagacggccggaggaccgacggctgtattattactggtgtggagggtactcccggtacccccgaaggaacgggtcgttacggtaactagtttggtttacgaacccgttcccgggtcgggggacccgtaaggggtaaccttcccggttacgggtcccgtaccggtccttccctaccgaccgtacccctaccccggaacccggaaaccggggcccctaacggtttcccggttcccccctttccccccggtcgggtcccccggttccccttcggaccccgttaccccgggaacgggtaaccgtcccaacccccggttacggaacggaaccggacccgaacccgggtaccggtacccccggggtcccccggttcggggtcccgttacccggtcccggttaccgggtaccgtaaaccgggtacccctttacccgttacccctaacccgtacgtttaccggcgtcggtacggtacgggtcggggtaccgtcgggaacgtaacgggccgtagacgttagcgcnnnnngnnnnnnnnnnnnnnnnnnnnnnn

SEQ ID NO: 73367 - DNA, 422 bp, Homo sapiens
  misc_feature: GYAE6OF01DQ6R3.10.42.D09.1.454.CMB.1.raw
  modified_base (417)..(422): a, c, t, g, unknown or other
  misc_feature (417)..(422): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaaggctggttacatgttgactcctggggccagggaatcctggtcacgtctctcagcctccaccagggcccatcggtcttcccctggcgccctgctccaggacgcacctccgagagcacagcgccctggctgcctggtcaggactaccttccactactatgctgagcggctggcaaggcgcatagnnnnnn

SEQ ID NO: 73368 - DNA, 431 bp, Homo sapiens
  misc_feature: GYAE6OF02GY1QK.10.42.D09.1.454.CMB.1.raw
  modified_base (425)..(431): a, c, t, g, unknown or other
  misc_feature (425)..(431): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctcaccaagggcccatcggtcttccccctggcgccctgctccaggagcacctccgagagcacagcggccctgggctgcctggtcaaggactacttcccactactatgctgagcgggctggcaaggcgcatagnnnnnnn

SEQ ID NO: 73369 - DNA, 440 bp, Homo sapiens
  misc_feature: GYAE6OF02HDJSC.10.42.D09.1.454.CMB.1.raw
  modified_base (432)..(440): a, c, t, g, unknown or other
  misc_feature (432)..(440): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtcccccagaaagggctggttacatgttgactcctggggccagggaatcctggtcaccgtctcctcagccctccaccaagggcccatccggtccttccccctggccgccctgcctccaggagcacctccgagacgcacagccggccctgggctgcctggtcaaggactacctcccactactatgctgagcgggctggcaaggcgcatagnnnnnnnnn

SEQ ID NO: 73370 - DNA, 358 bp, Homo sapiens
  misc_feature: GYAE6OF02F2LR2.10.42.D09.1.454.CMB.1.raw
  modified_base (355)..(358): a, c, t, g, unknown or other
  misc_feature (355)..(358): n is a, c, g, or t
tcagcatagtagtgcacgaccggtgctcgatttagacacatacgcagggaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggctactcccatactatgctgagcggctggcaaggcgcatagnnnn

SEQ ID NO: 73371 - DNA, 434 bp, Homo sapiens
  misc_feature: GYAE6OF02GKQ6C.10.42.D09.1.454.CMB.1.raw
  modified_base (427)..(434): a, c, t, g, unknown or other
  misc_feature (427)..(434): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaagggactacttcccactactatgctgagcgggctggcaaggcgcatagnnnnnnnn

SEQ ID NO: 73372 - DNA, 367 bp, Homo sapiens
  misc_feature: GYAE6OF02GNWWX.10.42.D09.1.454.CMB.1.raw
  modified_base (361)..(367): a, c, t, g, unknown or other
  misc_feature (361)..(367): n is a, c, g, or t
tcagcatagtagtgcacgaccggtgctcgatttagacacatacgcagggaaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttcccctggccgccctgctcccaggagcacctccgagagcacagcggccctgggctgcctggtcaaggactacttcccactactatgctgagcgggctggcaaggcgcatagnnnnnnn

SEQ ID NO: 73373 - DNA, 434 bp, Homo sapiens
  misc_feature: GYAE6OF02G6SOS.10.42.D09.1.454.CMB.1.raw
  modified_base (426)..(434): a, c, t, g, unknown or other
  misc_feature (426)..(434): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaaggcccatcggtcttccccctggcgccctgctccaggagcacctccgagagcacagcggccctgggctgcctggtcaagggactacttcccactactatgctgagcgggctggcaaggcgcatagnnnnnnnnn

SEQ ID NO: 73374 - DNA, 364 bp, Homo sapiens
  misc_feature: GYAE6OF02GSENM.10.42.D09.1.454.CMB.1.raw
  modified_base (357)..(364): a, c, t, g, unknown or other
  misc_feature (357)..(364): n is a, c, g, or t
tcagcatagtagtgcacgaccggtgctcgatttagacacatacgcagggaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttcccctggccgccctgctccaggagcacctccgagagcacagcggccctgggctgcctggtcaaggctactcccactactatgctgagcgggctggcaaggcgcatagnnnnnnnn

SEQ ID NO: 73375 - DNA, 369 bp, Homo sapiens
  misc_feature: GYAE6OF02GHMTI.10.42.D09.1.454.CMB.1.raw
  modified_base (359)..(369): a, c, t, g, unknown or other
  misc_feature (359)..(369): n is a, c, g, or t
tcagcatagtagtgcacgaccggtgctcgatttagacacatacgcagggaaagggccggttcaccatctcgagagacaacaccaagaacacgctgaatctgcaaatgaacagcctgagagccgaggacacggctgtatattactgtgtgagggatgtcccccagaagggctggttacatgtttgactcctgggccagggaatcctggtcaccgtctcctcagcctccaccaagggcccatcggtcttccccctggccgccctgctccaggacgcacctccgagagcacagcggccctgggctgcctggtcaaggactacttcccatactatgctgagcgggctggcaaggcgacatagnnnnnnnnnnn

SEQ ID NO: 73376 - DNA, 436 bp, Homo sapiens
  misc_feature: GYAE6OF02H2S58.10.42.D09.1.454.CMB.1.raw
  modified_base (428)..(436): a, c, t, g, unknown or other
  misc_feature (428)..(436): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgtttgactcctggggccagggatcctggtcaccgtctcctcagcctccaccaagggccccatccggtcttccccctggccgccctgcctccaggagcacctccgagagcacagcggccctgggctgcctggtcaaggactacttcccactactatgctgagcgggctggcaaggcgcatagnnnnnnnnn

SEQ ID NO: 73377 - DNA, 433 bp, Homo sapiens
  misc_feature: GYAE6OF02H2QQL.10.42.D09.1.454.CMB.1.raw
  modified_base (425)..(433): a, c, t, g, unknown or other
  misc_feature (425)..(433): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggacgcacctccgagagcacagcggcctgggctgcctggtcaaggctacttcccactactatgctgagcgggctggcaaggcgcatagnnnnnnnnn

SEQ ID NO: 73378 - DNA, 442 bp, Homo sapiens
  misc_feature: GYAE6OF02JHNLP.10.42.D09.1.454.CMB.1.raw
  modified_base (429)..(442): a, c, t, g, unknown or other
  misc_feature (429)..(442): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccgagacgcaccagcggccctgggctgcctggtcaaggactacttcccactactatcgctgagcgggctggcaaggcgcatagnnnnnnnnnnnnnn

SEQ ID NO: 73379 - DNA, 442 bp, Homo sapiens
  misc_feature: GYAE6OF02HB699.10.42.D09.1.454.CMB.1.raw
  modified_base (414)..(414): a, c, t, g, unknown or other
  misc_feature (414)..(414): n is a, c, g, or t
  modified_base (430)..(442): a, c, t, g, unknown or other
  misc_feature (430)..(442): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctcaccaggcccatcgtctcccctggcgccctgctccaggagccacctccgagacgcacaggccggccctgggctcgccctggtcaacgggacttaccgtcccactactatgctgagcgggntggcaaggcgcatagnnnnnnnnnnnnn

SEQ ID NO: 73380 - DNA, 435 bp, Homo sapiens
  misc_feature: GYAE6OF02GDS0X.10.42.D09.1.454.CMB.1.raw
  modified_base (422)..(422): a, c, t, g, unknown or other
  misc_feature (422)..(422): n is a, c, g, or t
  modified_base (428)..(435): a, c, t, g, unknown or other
  misc_feature (428)..(435): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgcctccaggacgcacctccgagagcacagccggccctgggctgcctggtcaaggctacttcccactactatgctgagcgggctggcaaggcncatagnnnnnnnn

SEQ ID NO: 73381 - DNA, 368 bp, Homo sapiens
  misc_feature: GYAE6OF02FGFKJ.10.42.D09.1.454.CMB.1.raw
  modified_base (361)..(368): a, c, t, g, unknown or other
  misc_feature (361)..(368): n is a, c, g, or t
tcagcatagtagtgcacgaccggtgctcgatttagacacatacgcagggaaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggacgcacctccgagagcacaggcgccctgggctgcctggtcaaggactacttcccactactatgctgagcgggctggcaaggcgcatagnnnnnnnn

SEQ ID NO: 73382 - DNA, 434 bp, Homo sapiens
  misc_feature: GYAE6OF02GVN7Q.10.42.D09.1.454.CMB.1.raw
  modified_base (423)..(434): a, c, t, g, unknown or other
  misc_feature (423)..(434): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccacaaggcccatcggtctcccctggcgccctgctccaggagcacctccgagacgcaccagcggccctgggctgcctggtcaaggctacttcccatactatgctgagcgggctggcaaggcgcatacgnnnnnnnnnnnn

SEQ ID NO: 73383 - DNA, 437 bp, Homo sapiens
  misc_feature: GYAE6OF02GVR74.10.42.D09.1.454.CMB.1.raw
  modified_base (324)..(324): a, c, t, g, unknown or other
  misc_feature (324)..(324): n is a, c, g, or t
  modified_base (351)..(351): a, c, t, g, unknown or other
  misc_feature (351)..(351): n is a, c, g, or t
  modified_base (424)..(437): a, c, t, g, unknown or other
  misc_feature (424)..(437): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaaggcccatcggtctccccctggcnccctgctccaggagccacctccgagancacagcggccctgggctgctggtcaaggactactcccactactatgctgacgcgggctggcaaggcgcatagnnnnnnnnnnnnnn

SEQ ID NO: 73384 - DNA, 435 bp, Homo sapiens
  misc_feature: GYAE6OF02F7ZIY.10.42.D09.1.454.CMB.1.raw
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (421)..(421): a, c, t, g, unknown or other
  misc_feature (421)..(421): n is a, c, g, or t
  modified_base (427)..(435): a, c, t, g, unknown or other
  misc_feature (427)..(435): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgttgactcctggggccagggaatcctggtcaccgtctcctcagcctccaccaagggcccatccggtccttccccctggccgccctgcctccaggancacctccgagngcacagcggccctgggctgcctggtcaaggactactcccactactatgctgagcgggctggcaggcncatagnnnnnnnnn

SEQ ID NO: 73385 - DNA, 551 bp, Homo sapiens
  misc_feature: GYAE6OF02IGGVQ.10.42.D09.1.454.CMB.1.raw
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
  modified_base (521)..(551): a, c, t, g, unknown or other
  misc_feature (521)..(551): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtccccccagaaaggctggtacatgttgactctgggccaggatcctggtccacgtctcctcagccctccaccgaagggtccccagtccgggttccttccccccgtcgggaccctcccgtcgcccgttacccgagggaccgtcccgacccctccggaagacgtccaacctcgggacccggtcccggtccgggcctcggcccgttgggtaaccgaacgtaccttaacccgttcccaaaccgtccctttagaccgtccgtaggacggccggggcctgggacccgaagggcnccgtaaggancnnnnnnnnnnnnnnnnnnnnnnnnnnnnnnn

SEQ ID NO: 73386 - DNA, 444 bp, Homo sapiens
  misc_feature: GYAE6OF02IAEW1.10.42.D09.1.454.CMB.1.raw
  modified_base (421)..(421): a, c, t, g, unknown or other
  misc_feature (421)..(421): n is a, c, g, or t
  modified_base (427)..(444): a, c, t, g, unknown or other
  misc_feature (427)..(444): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgttgactcctggggccagggaatcctggtcaccgtctctcagcctccaccaaggccatcggtcttccccctggcgccctgcctccaggagcacctccgagacgcacagcggcctgggctgcctggtcaagggactacgttcccactacatgctgacgcgggactgggcaaggcncatagnnnnnnnnnnnnnnnnnn

SEQ ID NO: 73387 - DNA, 490 bp, Homo sapiens
  misc_feature: GYAE6OF02F11LH.10.42.D09.1.454.CMB.1.raw
  modified_base (464)..(464): a, c, t, g, unknown or other
  misc_feature (464)..(464): n is a, c, g, or t
  modified_base (466)..(490): a, c, t, g, unknown or other
  misc_feature (466)..(490): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcacccatctcgagagacaacaccaagaacacgctgaatctgcaaatgaacagcctgagagccgaggacacggctgtatattactgtgtgagggatcgtccccccagaaagggctggttacatgttgactccgtggggccagggatcctggtcaccgtctcctcagcctccaccaagggcccatccggtcttccccctggccgcccctgcctccgaggacgccaccctccgaggacgccacacggccggccccgtgggctgccctggtccaagggacctacttaccccacttacctatcgcgtgacggtccgggctcggcaacgggcaccgagtaagnannnnnnnnnnnnnnnnnnnnnnnnn

SEQ ID NO: 73388 - DNA, 452 bp, Homo sapiens
  misc_feature: GYAE6OF02GHSFN.10.42.D09.1.454.CMB.1.raw
  modified_base (289)..(289): a, c, t, g, unknown or other
  misc_feature (289)..(289): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (445)..(452): a, c, t, g, unknown or other
  misc_feature (445)..(452): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtccccccagaaagggctggttacatgtttgactccgtgggccagggaatcctggtcaccgtctccncagccctccaccgaacgggccccagtccggtcctttccccctggccgcccctgcctccgaggacgccacctccgagacgcacgacgcggcccgtgggctgcctggcaagggactaccttcccactactatgctgacgcggcnggcgaggcnatagnnnnnnnn

SEQ ID NO: 73389 - DNA, 532 bp, Homo sapiens
  misc_feature: GYAE6OF02IRS1Z.10.42.D09.1.454.CMB.1.raw
  modified_base (503)..(503): a, c, t, g, unknown or other
  misc_feature (503)..(503): n is a, c, g, or t
  modified_base (505)..(532): a, c, t, g, unknown or other
  misc_feature (505)..(532): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtcccccagaaaggctggttacatgttgactccgtggggccagggaatccgtggtccaccggtcctcctcacggtccctccaccgaacgggcccctagtccggttccttcccccgtgggcccgcccctcgccttcccgaacggacgcctaacccgtccgaacgacgaccacgacggcccggcccgttcgggcctcgcccgtcggtacgaaacggtacctaccgttccccaagtactacgtcgacttggacggcgggctagggcaaagggccgactagtgcncnnnnnnnnnnnnnnnnnnnnnnnnnnnn

SEQ ID NO: 73390 - DNA, 554 bp, Homo sapiens
  misc_feature: GYAE6OF02IDI4U.10.42.D09.1.454.CMB.1.raw
  modified_base (285)..(285): a, c, t, g, unknown or other
  misc_feature (285)..(285): n is a, c, g, or t
  modified_base (507)..(507): a, c, t, g, unknown or other
  misc_feature (507)..(507): n is a, c, g, or t
  modified_base (512)..(513): a, c, t, g, unknown or other
  misc_feature (512)..(513): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (525)..(526): a, c, t, g, unknown or other
  misc_feature (525)..(526): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
  modified_base (533)..(535): a, c, t, g, unknown or other
  misc_feature (533)..(535): n is a, c, g, or t
  modified_base (537)..(538): a, c, t, g, unknown or other
  misc_feature (537)..(538): n is a, c, g, or t
  modified_base (540)..(541): a, c, t, g, unknown or other
  misc_feature (540)..(541): n is a, c, g, or t
  modified_base (544)..(544): a, c, t, g, unknown or other
  misc_feature (544)..(544): n is a, c, g, or t
  modified_base (547)..(548): a, c, t, g, unknown or other
  misc_feature (547)..(548): n is a, c, g, or t
  modified_base (550)..(551): a, c, t, g, unknown or other
  misc_feature (550)..(551): n is a, c, g, or t
  modified_base (553)..(554): a, c, t, g, unknown or other
  misc_feature (553)..(554): n is a, c, g, or t
tcagcatagtagtgcacgaccggtgctcgatttagacacatacgcagggaaagggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtcccccagaaagggctgttacatgttgactccgtgggccaggactcgtggtcaccgtctcctcncgcctccaccgaacgggcctagtccgtccttccccgtggccgtccctggcctccgaggcgacctaccgtaccgagacgacctacgacgccggtccgtacgggtctcgtcccgtagggtacgaaacggtacccttaccgtaccccaacgttaaccgtcgtcgtcgtacgtacgggccgggtccggtagggtaccgaaacgggccgtacgaacgttcgacgtancgtcnncgtncgngcgcnncngntgnnngnncnncgngcnngnncnn

SEQ ID NO: 73391 - DNA, 513 bp, Homo sapiens
  misc_feature: GYAE6OF02G2EQJ.10.42.D09.1.454.CMB.1.raw
  modified_base (493)..(513): a, c, t, g, unknown or other
  misc_feature (493)..(513): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggatcgtccccccagaaagggctggttacatgttgactccgtggggccaggaatccgtggtccaccgtctcctcagccctccaccaacgggcccactccggtccttccccccgtgggccgcccctgcctccgaggacgcctacctccgacgacgcacacgcccggccgtgggctcggcccgtggtaccgaacggtaccttacccttccctaactacctaagtcgcgtacggacggccggggcgtacgggacccgtaagggccgtaacgtaagtacgnnnnnnnnnnnnnnnnnnnnn

SEQ ID NO: 73392 - DNA, 501 bp, Homo sapiens
  misc_feature: GYAE6OF02JNSXF.10.42.D09.1.454.CMB.1.raw
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
  modified_base (375)..(375): a, c, t, g, unknown or other
  misc_feature (375)..(375): n is a, c, g, or t
  modified_base (440)..(440): a, c, t, g, unknown or other
  misc_feature (440)..(440): n is a, c, g, or t
  modified_base (466)..(466): a, c, t, g, unknown or other
  misc_feature (466)..(466): n is a, c, g, or t
  modified_base (471)..(471): a, c, t, g, unknown or other
  misc_feature (471)..(471): n is a, c, g, or t
  modified_base (476)..(476): a, c, t, g, unknown or other
  misc_feature (476)..(476): n is a, c, g, or t
  modified_base (479)..(479): a, c, t, g, unknown or other
  misc_feature (479)..(479): n is a, c, g, or t
  modified_base (481)..(501): a, c, t, g, unknown or other
  misc_feature (481)..(501): n is a, c, g, or t
tcagcatagtagtgcacgaccggtgctcgatttagacacatacgcagggaaagggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatcgtccccccagaaacgggctggttacattgtttagactccgttggggccagggaatcctggtccgaccgtcgtcctnacgcctccaccgacggcccatccggtctttccccccgnggcccgcccgtcgcctccgaggacgcaccctccgacgngccacgacgccggcccgtagggcctcgccttcgggacaaacgggtcctaccgttcccaccttacntcgctgacggacggccgtgggaaccngggcncgagngangnnnnnnnnnnnnnnnnnnnnn

SEQ ID NO: 73393 - DNA, 489 bp, Homo sapiens
  misc_feature: GYAE6OF02F84W6.10.42.D09.1.454.CMB.1.raw
  modified_base (219)..(219): a, c, t, g, unknown or other
  misc_feature (219)..(219): n is a, c, g, or t
  modified_base (451)..(451): a, c, t, g, unknown or other
  misc_feature (451)..(451): n is a, c, g, or t
  modified_base (466)..(466): a, c, t, g, unknown or other
  misc_feature (466)..(466): n is a, c, g, or t
  modified_base (473)..(489): a, c, t, g, unknown or other
  misc_feature (473)..(489): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgaggntcgtcccccagaagggctggttacattgttgactccgtggggccagggaatccgtggtccaccgtctcctcacgcctccaccgacgggcccagtccggtccttcccccgtggcccgcccgtgcctccgaggacgccacccgtccgacgacgcaccagcccggccgtgggcctcgccgtggtccgaacggtaccttaccttccccaacttactagcgctggacggccgggtcngggaccgaaggccgntaagtgnnnnnnnnnnnnnnnnn

SEQ ID NO: 73394 - DNA, 521 bp, Homo sapiens
  misc_feature: GYAE6OF02GLZBT.10.42.D09.1.454.CMB.1.raw
  modified_base (493)..(521): a, c, t, g, unknown or other
  misc_feature (493)..(521): n is a, c, g, or t
tcagcatagtagtgcacgaccggtgctcgatttagacacatacgcagggaaaggggctggagtgggtctcgactattaatggtcttgctgataatacacactacgcagactttgtgaagggccggttcaccatctcgagagacaacaccaagaacacgctgaatctgcaaatgaacagcctgagagccgaggacacggccgtatattactgtgcgaaagatacgtggacacatgtatggtccggcggggggggcaagtggacgtcgtggggccgaagggaccacggtcaccgtctcctcacgccctccaccgaacgggccccacgtccggtccttccccccgtcgggcccaccccgtccctaccaacgacgccacccgtcgtcggggggccacgacggccggcccgtcgggctcggccgtggtccgaacgggtaccttaaccttcccacctactatgctgaggccgggcgtgggacgaacgggcgacagtagnnnnnnnnnnnnnnnnnnnnnnnnnnnnn

SEQ ID NO: 73395 - DNA, 445 bp, Homo sapiens
  misc_feature: GYAE6OF02FWB23.10.42.D09.1.454.CMB.1.raw
  modified_base (432)..(445): a, c, t, g, unknown or other
  misc_feature (432)..(445): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtcccccagaaagggctggttacatgttgactcctggggccagggaatcctggtcaccgtctacctcagccctccaccaacgggcccatcggtctccccctggccgccctgctccaggcgcacctccgagagcacacggcggccctgggctcgcctggtcaaggtctacttcccaactactatgctgacgcgggctggcaaggcgcatagnnnnnnnnnnnnnn

SEQ ID NO: 73396 - DNA, 627 bp, Homo sapiens
  misc_feature: GYAE6OF02FRH25.10.42.D09.1.454.CMB.1.raw
  modified_base (244)..(244): a, c, t, g, unknown or other
  misc_feature (244)..(244): n is a, c, g, or t
  modified_base (304)..(304): a, c, t, g, unknown or other
  misc_feature (304)..(304): n is a, c, g, or t
  modified_base (549)..(549): a, c, t, g, unknown or other
  misc_feature (549)..(549): n is a, c, g, or t
  modified_base (561)..(561): a, c, t, g, unknown or other
  misc_feature (561)..(561): n is a, c, g, or t
  modified_base (574)..(574): a, c, t, g, unknown or other
  misc_feature (574)..(574): n is a, c, g, or t
  modified_base (580)..(580): a, c, t, g, unknown or other
  misc_feature (580)..(580): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
tcagcatagtagtgcacgaccggtgctcgatttagacacatacgcagggaaaggggctggagtgggtctcgactattaatggtcttgctgataatacacactacgcagacttcgtgaagggccggttcaccatctcgagagacaacaccaagaacacgctgaatctgcaaatgaacagcctgagagccgagacacggctgtatattactgtgtgtagggatcgtcccccagaaggctggttacntgttgctccgtgggcaggatcctggtacaccgtctcctcacgcctccaacgacggccccngtcccggtccttacccccgtgggccgtaccccgtcgtctccgagggtacgcgtaacccgtccgaacgacgaccgtaacgacggtcccggccccgttggggtaccctcgggtacccgttcgggtaaccgtaaaccgggttaccctaacccggtttaccccctaaacggttaaccgtactttaccggagtaacgtccggtccgggggacttacgggaaccgttagggaccgacttaactagggactnagtacacgcttnacgactgcaaggntaccgnacgtagaccngactnacgtctagtacgtagacgaccgactacancng

SEQ ID NO: 73397 - DNA, 746 bp, Homo sapiens
  misc_feature: GYAE6OF01DKHDQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggccctccagactaccgacggaataattgtgtagacacagtccgtccgccctacctgttctttgtcctccggagggactagtcgaccctaccctcctccgtgacgacgggcctagtcgagtagttagttagtacgtctttacgttacgccgttacggtaaccaacgaacgtaaaccgtcggaccgacggtccctacccggaggtcccttcctactacttactagtgtatcgactactacccgaaacggaccgggaccacggtcggacctacctaccccgagacccgtaggttaccagggtcggacgtaggggtcggtctggtacgaacgtacgtaccttacaccttcctaccaacctataccgacgaccgaccgtaccgtaaggaccgtccgtaaggtaacgtacgttcgtacgtacttaagttttaacttacgttacgttacgacgtacgtacggtacggtacgaccgtaacggtccggtaccttaccgttaccgtttaccggtttccggggaccgggtaaccgggtaaccgtaaggggtaggaacgtaacgtaacgtaaaaccggtcgttacgggtacgtacgtacgaccgtaacctacgttccgtcgtttaccc

SEQ ID NO: 73398 - DNA, 514 bp, Homo sapiens
  misc_feature: GYAE6OF01B56B9.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtctccaggggacagtgccaccctctcctgcagggccagtcagagtgttagtagcttcttagcctggtaccaacagaaacctggccaggctcccaggctcctcatctatgatgcatccaacaggccactggcatcccagccaggttcagtggcagtgggtctgtgacagacttcactctcaccatcagcagcctagacgcctagaaagtattactgactagtttattactgtacagcagcgtagcaactcggcctctctacgtttcggcggtacgggacctaagggtggaagtactacgaaacgtacgtgtggctgacacatcgtgtc

SEQ ID NO: 73399 - DNA, 487 bp, Homo sapiens
  misc_feature: GYAE6OF01CGBSX.49.46.E02.1.454.CMB.1.raw
tcagagtcgagagacacgaccggtgctcgatttagactcatctacagggaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtggtctgtgacagacttcactctcaccatcagcagcctagagcctgaagattctgctagtttatactgtcagcagcgtagcaactggcctctcactttcggcggaggaccaaggtggagatacaaagactgtgctgcacatctgtc

SEQ ID NO: 73400 - DNA, 511 bp, Homo sapiens
  misc_feature: GYAE6OF01D0HVP.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctaagcgcctgaagattctgtctagtttattactgtcagcagcgtaagctaactggcctctctactttcggcggagggaccaagggtggagactacgaaacgaacgtgtggactgaccacatcgtgttacc

SEQ ID NO: 73401 - DNA, 508 bp, Homo sapiens
  misc_feature: GYAE6OF01DLEJ2.49.46.E02.1.454.CMB.1.raw
  modified_base (402)..(402): a, c, t, g, unknown or other
  misc_feature (402)..(402): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctggtgacagacttcactctcaccatcagcaagccctaagagcctgaagattcngctagttttattactgtcagcagcgtagcaactggccttctctactttcgggcggacggaccaagggtggagactacaaacggactggtgctgacaccatctgtcc

SEQ ID NO: 73402 - DNA, 490 bp, Homo sapiens
  misc_feature: GYAE6OF01CXD6V.49.46.E02.1.454.CMB.1.raw
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
  modified_base (396)..(396): a, c, t, g, unknown or other
  misc_feature (396)..(396): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacaggccactggcatcccagccaggttcagtgcagtgggtcngtgacagacttnactctcaccatcagcagcctagagcctgaagattcngctagtttatactgtcagcagcgtaagcaactgcctctctactttcggcggaggaccaggtgagatcaaacgactgtgctgacacatcgtgtcc

SEQ ID NO: 73403 - DNA, 499 bp, Homo sapiens
  misc_feature: GYAE6OF01CP47E.49.46.E02.1.454.CMB.1.raw
tcagagtcgagagacacgaccggtgctcgatttagactcatctacagggaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatccccagccaggttcagtggcagtgggtctgtgacagacttcactctcaccatcagcagcctagagcctgaagattctgctagtttattactgtcagcagcgtagcaactcggccttctcactttcggcggagggaccaaggtggagatacgaaacgactgtggctgacaccatctgtc

SEQ ID NO: 73404 - DNA, 497 bp, Homo sapiens
  misc_feature: GYAE6OF01C7LIK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtaagcaactggcctctctactttcggcggagggaccaaggtggagatacaaacgactgtggctgcaccatctgtc

SEQ ID NO: 73405 - DNA, 505 bp, Homo sapiens
  misc_feature: GYAE6OF01BIPNE.49.46.E02.1.454.CMB.1.raw
  modified_base (261)..(261): a, c, t, g, unknown or other
  misc_feature (261)..(261): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagagtcgagagacacgaccggtgctcgatttagactcatctacagggaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaaccaanagaaacctggccaggctccaggctcctcatctatgatgcatccaacaggccactggcatcccagccaggttcagtggcaggtgggtctgtgacagacttcactctcacatcagcagcctagagcctagaagnttcngtctagtttatactgtcagcagcgtagcaacgtgcctctctacgtttcgggaggacgggaccaagggtgagagtacaaacgactggtggcttcgacaacatcgtgtcc

SEQ ID NO: 73406 - DNA, 499 bp, Homo sapiens
  misc_feature: GYAE6OF01CSPHA.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagtattctgctagttttattactgtcagcagcgtagcaacgtgcctctcacgtttcggcggagggaccaaggtggagatacaaacgactgtggctgacaccatctgtc

SEQ ID NO: 73407 - DNA, 490 bp, Homo sapiens
  misc_feature: GYAE6OF01AHMZ0.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaaacagggccactggcatcccagccaggttcagtggcagtgggtctgtgacagacttcactctcacatcagcagcctagagcctgaagattctgctagtttattactgtcagcagcgtagcaactgcctctcactttcggcggaggaccaaggtgagatcaaacgactgtgctgcaccatctgtc

SEQ ID NO: 73408 - DNA, 519 bp, Homo sapiens
  misc_feature: GYAE6OF01C8A5L.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtgcaggtgggtctgtgacagacttcacttctcacatcagcagcctagagcctgaagtattttgctagtttattactgtacaacagcgtaccacgaaggtacttctacgtttccggcccgttagggacccaggagtagggatatacaaacgtactgtggctgcactatctgttctctattccc

SEQ ID NO: 73409 - DNA, 564 bp, Homo sapiens
  misc_feature: GYAE6OF01BEJ1L.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcccctcgctactctggcgtcccacgataccaccggacggaaattagttgttgtacacagtctccggccgaccctcgtctttcgttctcccacggggacgagtgccaccctcctcctcgcgacgggccgacgtcgacgagtgtttagtagcttcttagtcctcggttaccgaaaccaagaaacctaggccgaacggacgtccccacgggctccctccatctatgatgcatccaacagggccactggcatcccacgccaggttcagtggcagtggggtctgtgacagacttcactctcaccatcagcagcctagagccctgaagattctgactagtttatttactgtcagcagcgtagccaacctgggccctctactacgtttcgggcgggacgggaccaacgggtggacggaatcaaacggaactggtggctgccaccagttctggtctc

SEQ ID NO: 73410 - DNA, 500 bp, Homo sapiens
  misc_feature: GYAE6OF01DRVUL.49.46.E02.1.454.CMB.1.raw
  modified_base (424)..(424): a, c, t, g, unknown or other
  misc_feature (424)..(424): n is a, c, g, or t
  modified_base (483)..(483): a, c, t, g, unknown or other
  misc_feature (483)..(483): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtggtctgtgacagacttcactctcaccatcagcagcctagagcctagaagattctgctagttttatactgtcagcagcgtancaactggcctctctacgtttcggacggagggaccaagggtgagactacgaaacgactgnggctgacaccatctgtc

SEQ ID NO: 73411 - DNA, 524 bp, Homo sapiens
  misc_feature: GYAE6OF01DB8SB.49.46.E02.1.454.CMB.1.raw
  modified_base (356)..(356): a, c, t, g, unknown or other
  misc_feature (356)..(356): n is a, c, g, or t
  modified_base (514)..(514): a, c, t, g, unknown or other
  misc_feature (514)..(514): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacaggccactggcatcccagccaggttcagtggcaggtgggtctgtgacngacttcactctcaccatcagcagcctagacgcctagaagtattctgtcttagtttactttactttcagtcagtcgtagctaacgtcggtcctctcgtacgtttcgggcggtacgggaccgaagggtggagagtacgaaacgacgtggtgtctgccacntctgtcttac

SEQ ID NO: 73412 - DNA, 518 bp, Homo sapiens
  misc_feature: GYAE6OF01C2JT7.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtcttgtctccaggggacagtgccaccctctcctgcagggccagtcagagtgttagtagcttcttagcctggtaccaacagaaacctggccaggctccaggcctcctcatctatgatgcatccaacacgggccactggcactcccagccaggtcaggtgcagtgggtctgtgacagacttcactctcaccatcagcagcctagagcctagaagtattctgactagtttattactgtcagcagtcgtaagctaactcggtcctctctacgtttcgggcggagggaccgaaggtggaagactacgaaacgtacgtggtggactggacaccattcgtgttc

SEQ ID NO: 73413 - DNA, 500 bp, Homo sapiens
  misc_feature: GYAE6OF01C71X8.49.46.E02.1.454.CMB.1.raw
  modified_base (395)..(395): a, c, t, g, unknown or other
  misc_feature (395)..(395): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcttagcctggtaccaacagaaacctggccaggctcccaggctcctcatctatgatgcatccaacagggccactggcatcccagccaggttcagtgcagtgggtctgtgacagacttcactctcacatcagcagcctagagcctgaagattcngtctagtttattactgtcagcagcgtagcaacgtggcctctctacgtttcggacggacgggtaccaagggtgagtatacaaacgactgtgctgacacatctgtac

SEQ ID NO: 73414 - DNA, 506 bp, Homo sapiens
  misc_feature: GYAE6OF01CQK4T.49.46.E02.1.454.CMB.1.raw
  modified_base (500)..(500): a, c, t, g, unknown or other
  misc_feature (500)..(500): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagacgcctagaagtattctgctagtttattactgtcagcagcgtagcaactcggccttctctacgtttcgggcggtacgggaccgaaggtggaagactacaaacgactgtgctgacacntctgtc

SEQ ID NO: 73415 - DNA, 502 bp, Homo sapiens
  misc_feature: GYAE6OF01EQZN4.49.46.E02.1.454.CMB.1.raw
  modified_base (496)..(496): a, c, t, g, unknown or other
  misc_feature (496)..(496): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtgggtctgtgacagacttcactctcaccatcagcagcctagacgcctagaagattctgctagtttacttactgtcagcagcgtagcaacgtggcctctctacgtttcggcggtagggacctagggtggagatacgaaacgactgtgctgacacntctgtc

SEQ ID NO: 73416 - DNA, 534 bp, Homo sapiens
  misc_feature: GYAE6OF01B125D.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagacgcctagaagtattctgctagtttattactgtcagcagcgtagcacgtcggcctctctacgtttcggcggtacgggaccgtaagggtggagtacgtacgaaacggtacgtggtacggacgttcggacctaaccctacttccgtgttccc

SEQ ID NO: 73417 - DNA, 524 bp, Homo sapiens
  misc_feature: GYAE6OF01BGSPZ.49.46.E02.1.454.CMB.1.raw
  modified_base (261)..(261): a, c, t, g, unknown or other
  misc_feature (261)..(261): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaaacctggccaggctcccaggctcctcatctatgatgcatccaacagggccactggcatcccagccaggttcagtggcagtgggtctgtgacagacttcactctcaccatcagcagcctagacgcctagaagtattctgctagtttattacgtgtcagcagcgtagcaacgtggtccctctctacgttcgggcggaacgggaccaagggtggaagtacgtacgaaacggtactggtacggctgaccactatcgttgttacc

SEQ ID NO: 73418 - DNA, 565 bp, Homo sapiens
  misc_feature: GYAE6OF01CROKX.49.46.E02.1.454.CMB.1.raw
  modified_base (357)..(357): a, c, t, g, unknown or other
  misc_feature (357)..(357): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccagggacagtgccaccctctctgcagggccagtcagagtgttagtagcttcttagcctggtaccaacagaaacctggccaggctcccaggctcctcatctatgatgcatccaaacgaggccacgtggccactccccaagcctaggttcaggtcggcaggtgggtcngtgacagactttcactctaccactatcagccagccctagagccctagaaacgtacttctgtactagtttacttactagtcagtcagtcgtaagacaacgtcggtcctctctacgtttcgggacggtacggaaccgtaaggtggaacgtacgtaacgaaacggtacgttacggtacggacttacgacctacctactccgttggttaccc

SEQ ID NO: 73419 - DNA, 569 bp, Homo sapiens
  misc_feature: GYAE6OF01C8FLL.49.46.E02.1.454.CMB.1.raw
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggctcccaggctcctcatctatgatgcatccaacnggccacgtggcactcccagccaggttcagtggcagtgggtctgtgacagacttcactctcaccatcagcagtcctagacgcctagaacgtattctgactagtttacttacgtgtacagcagcgtagacctaacgtcggtcccttctccgttacgtttcgggaccgggtacgggaccgtaaagggtggaacgtacgtaaccgaaaacggtacgttagggtacggtaccgtacgaccctacctacgttccgtgtttacccg

SEQ ID NO: 73420 - DNA, 582 bp, Homo sapiens
  misc_feature: GYAE6OF01CD79W.49.46.E02.1.454.CMB.1.raw
  modified_base (214)..(214): a, c, t, g, unknown or other
  misc_feature (214)..(214): n is a, c, g, or t
  modified_base (417)..(417): a, c, t, g, unknown or other
  misc_feature (417)..(417): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccacctctccngcagggccagtcagagtgttagtagcttcttagcctggtaaccaacgacgaaaccctgggaccaagggcctcccgaggctcctcatctatgatgcatccaaacaggccaacgtggacatccccgagcctaggttcaggtggctaggtcggggtctgtgacagaccttcactctacaccatcagcagcctagacgctagaagtnttcgtagctagtttatactgtacagtcaaggcgttaagacgtaacgtcggcccttactcgtaccgtttcgggacgggtaacgggtaccaaggggtagaacggacgttaacgaaacggtaacgttgggtacgtacgttaccgacacccttaagtcgttgtttaccc

SEQ ID NO: 73421 - DNA, 681 bp, Homo sapiens
  misc_feature: GYAE6OF01DMW1V.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtcgcccaccctctcctgcagggccagtcagagtgttagtagcttcttagcctggtaccaacagaaacctggccaggcctccaggcctcctcatctatgatgcactccaacgacgggccacgtggacactcccagccaggttcaggtcggctaggtgggtctgtgacagtacttcactctacaccatcacgcacgtctagacgtacctagaacgtatttcgtagtaccttaaggttttaactttaaccgttagtaccgtaaggtaccgtagggtaccggtttaacgaaccctaaaccggtttcccgggtacccctttaccggttaccgtttaaccgggtttacccgggggaccggggtaaacggggtaacccgtaaagggggttacggaaacggtaacgttaaccggaaaaaccggttacggttaggggtaccggtaccgtacgggacccctaaccgttaactttccggttgtttaccccg

SEQ ID NO: 73422 - DNA, 604 bp, Homo sapiens
  misc_feature: GYAE6OF01DP3LG.49.46.E02.1.454.CMB.1.raw
  modified_base (322)..(322): a, c, t, g, unknown or other
  misc_feature (322)..(322): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgttctttgtctccgaggggacagtcgcccaccctctcctgcagggccagtcagagtgttagtagtcttcttagcctaggtaccaaacaagaaacctggaccaggcctcccgaggcctcctcatctatgatgcatccaaacgnggccatggacactcccagcccaggttcaggtcggctaggtgggtctgtgacagtacttcactctacacctatcgacgcacgacctagacgctagaagtacttcgtgtacttagttttaattacgttgtactagacagtacgtaacgactaacgtcggtcccttacttcgttaccgtttcgggacgggtaacgggaccggtaagggtaggaacggtaacgtaacgaaaacggtaacgttcggtacggtccgtacggacctaaccgtacgttcgttcgttaccg

SEQ ID NO: 73423 - DNA, 539 bp, Homo sapiens
  misc_feature: GYAE6OF01A90AA.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcatccaacagggccactggcatcccagccaggttcagtggcagtgggtctgtgacagtacttcactctcaccatcagcagcctagacgcctgaagtattctgctagtttattactgtcagcagcgtagcaactcggccttctctacgtttcggcgggtaacgggtaccgtaagggtcggaagtacgtacgaaaacggtaacgttggtacggctacggacaacctattccgtgttaccc

SEQ ID NO: 73424 - DNA, 518 bp, Homo sapiens
  misc_feature: GYAE6OF01A5YEJ.49.46.E02.1.454.CMB.1.raw
  modified_base (511)..(511): a, c, t, g, unknown or other
  misc_feature (511)..(511): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacagggcccactggcatcccagccaggttcagtggcaggtgggtctggtgacagacttcactctcaccatcagcagcctagacgcctagaagtattcgtgctagtttacttactgtcagcagcgtacgacaacgtcgtccttctctacgtttcggacggtagggaccgagggtggagactacgaaacggtacgtgtggctgacacntcgtgtc

SEQ ID NO: 73425 - DNA, 533 bp, Homo sapiens
  misc_feature: GYAE6OF01A1DZ5.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtcggcaggtgggtctgtgacagacttcactctcaccatcagcagcctagacgcctagaagtacttctgactaagttttattacgttgtcagcagcgtagactaacgtcggtcctctctacgtttcgggcggtagggaccgaagggtggaagtacgtacgaaacgtacgtggtaggctacgacaccattcgtgttcc

SEQ ID NO: 73426 - DNA, 521 bp, Homo sapiens
  misc_feature: GYAE6OF01DWFR1.49.46.E02.1.454.CMB.1.raw
  modified_base (362)..(362): a, c, t, g, unknown or other
  misc_feature (362)..(362): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcaggtgggtctgtgacagcttnactctcaccatcagcagcctagagcctagaagtattctgactagtttattactgttcagcagtcgtaagcaactcggccttctctacgtttcgggacggtacgggaaccagggtggaagatacgaaacggtacgtgtggctggaccatactcgtgttcc

SEQ ID NO: 73427 - DNA, 641 bp, Homo sapiens
  misc_feature: GYAE6OF01BLKMN.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccagggacagtgccacctctcctgcagggccagtcagagtgttagtagcttcttagcctggtaccaacagaaacctggccaggctcccaggctcctcatctatgatgcatccaacagggccacgtggcatcccagccaggttcagtggcagtgggtctgtgacagacttcactctcaccatcagcagccctagacgccctaggaaagtactttccgtagtccttaaggttttaacttaacgttgttaccaaggtcaaggtcggttaacgaccgtaaacgttcgggtcccctttacgttacccgtaaccgtttttccgggggacccgggtaacgggggtaaccccgtaaagggggttacgggaacggtaaacgttaacccgaaaaaccgggtaaaccgttgggtacgggtaccttagggaccctaaccctaagttcccgttacggttcccc

SEQ ID NO: 73428 - DNA, 680 bp, Homo sapiens
  misc_feature: GYAE6OF01EEWSK.49.46.E02.1.454.CMB.1.raw
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggcctaggtcagagttgttagtagcctttcttagccttggtaccaacagaaacctggaccncggctcccaggcctcctcatctatgatgcanctacagccncaggcatcccagccgtaggttcagtggcgtaggtgggtctgtacgacagttctacacttctaccaacctactacgacgacgacgtaccgtaaggaccgtaccgtaaaggaacgttcacgttcgtacgtttaagtttttaacttaccgtcgtacgaacgtacgtacggttaccggtaacgaccgtaaccggtccgtacccttacgttaccgtttaacccgggtttaccgggggacgggggtaaaccgggtaaaacccggttaaagggggtacggtaaacgtaaccgttaaaaccggaaaaccggttacggtcgggttacggtaccgttaccgaacccgtaaccgttacgttccggttacg

SEQ ID NO: 73429 - DNA, 535 bp, Homo sapiens
  misc_feature: GYAE6OF01BV2E7.49.46.E02.1.454.CMB.1.raw
  modified_base (308)..(308): a, c, t, g, unknown or other
  misc_feature (308)..(308): n is a, c, g, or t
  modified_base (394)..(394): a, c, t, g, unknown or other
  misc_feature (394)..(394): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacnggccacgtggcatcccagccaggttcagtggcagtggtctgtgacagacttcactctcacatcagcagcctagacgcctagaagtnttctgtctagtttatactgtcagtcagtcgtagctaacgtcggccttcgtctacgtttcgggacggtacgggaccgtaagggtggaagtacgtacgaaacggtacgtggtacggactcgaccacctattccgttgttaccc

SEQ ID NO: 73430 - DNA, 505 bp, Homo sapiens
  misc_feature: GYAE6OF01BYNR5.49.46.E02.1.454.CMB.1.raw
  modified_base (402)..(402): a, c, t, g, unknown or other
  misc_feature (402)..(402): n is a, c, g, or t
  modified_base (488)..(488): a, c, t, g, unknown or other
  misc_feature (488)..(488): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgagggccactggcatccccagccaggttcagtggcaggtgggtctgtgacagtacttcactctcaccatcagcagcctagacgcctagaaagtnttctgactagtttattactgtcagcagcgtagctaacgtcggcctctctacgtttcggcggagggaccagggtgagatacaaacgntgtgctgcacntntgtc

SEQ ID NO: 73431 - DNA, 516 bp, Homo sapiens
  misc_feature: GYAE6OF01EN83F.49.46.E02.1.454.CMB.1.raw
  modified_base (385)..(385): a, c, t, g, unknown or other
  misc_feature (385)..(385): n is a, c, g, or t
  modified_base (506)..(506): a, c, t, g, unknown or other
  misc_feature (506)..(506): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagcttcactctcacatcagcagcctagacncctagaagattctgactagtttatactgtcagcagtcgtagcaacgtggtcctctctacgtttcggcgggacggaccgaagggtcggaagatacgaaacgacgtcgtggctcgacaacctntcgtgttacc

SEQ ID NO: 73432 - DNA, 547 bp, Homo sapiens
  misc_feature: GYAE6OF01B6PCO.49.46.E02.1.454.CMB.1.raw
  modified_base (309)..(309): a, c, t, g, unknown or other
  misc_feature (309)..(309): n is a, c, g, or t
  modified_base (387)..(387): a, c, t, g, unknown or other
  misc_feature (387)..(387): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggtcaggctcccaggctcctcatctatgatgcatccaacngggccacgtggcatcccagccaggttcagtggcagtgggtctgtgacagacttcactctcacatcagcagcctagacncctagaacgtattctgctagtttatactgtcagcagcgtagactaacgtcggtccctctcgtaccgtttcgggaccggtagggaccgaaagggtggaagtagtaaccgaaaggtaaccgtggtacggaccctacccaaccgtatccgttgtcctttaccg

SEQ ID NO: 73433 - DNA, 502 bp, Homo sapiens
  misc_feature: GYAE6OF01BY83Y.49.46.E02.1.454.CMB.1.raw
  modified_base (309)..(309): a, c, t, g, unknown or other
  misc_feature (309)..(309): n is a, c, g, or t
  modified_base (495)..(495): a, c, t, g, unknown or other
  misc_feature (495)..(495): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccagttcagtggcaggtgggtctgtgacagtacttcactctcaccatcagcagcctagacgcctgaagattcgtgctagtttattactgtcagcagcgtagcaacgtgcctctctacgttcggcggagggaccgaaggtggagagtacaaacgactgtgcgtgacacntcgtgtc

SEQ ID NO: 73434 - DNA, 617 bp, Homo sapiens
  misc_feature: GYAE6OF01D7041.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggcaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcaggtgggtctgtgacagacttcactctcaccatcagcacgtcctagacgcctagaagtactttcacgtctaggttttacttactgtacagtcaaggtcgtaacgactaacgtcgggtccctcgttacctaccggtttcgggaccgggtaacggggtaacccgtaaggggttacgggaaacggtaacgttaacccggaaaaaccgggtaccgtttaacgggtacgggtacccgttacgggtaccctaaaccccgtacgtttccgttcggtttaacccc

SEQ ID NO: 73435 - DNA, 497 bp, Homo sapiens
  misc_feature: GYAE6OF01BY339.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagcaactggcctctcactttcggcggagggaccaagggtggagatacaaacgactggtggctgcacatctgtcc

SEQ ID NO: 73436 - DNA, 520 bp, Homo sapiens
  misc_feature: GYAE6OF01BTHYF.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagacgcctagaagtattctgctagtttattactgtcagcagtcgtagcaacgtcggtcccttctctacgtttcggacgggtagggaccgaagggtggaagactacgaaacgacgtgtggctgacaccactcgtgttcc

SEQ ID NO: 73437 - DNA, 494 bp, Homo sapiens
  misc_feature: GYAE6OF01AG0BH.49.46.E02.1.454.CMB.1.raw
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
  modified_base (487)..(487): a, c, t, g, unknown or other
  misc_feature (487)..(487): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtgggtctgtgacagacttcactctcacatcagcagcctagacgcctagaagtnttctgctagtttatactgtcagcagcgtancactggcctctcactttcggcggaggaccaaggtggagatacgaaacgctgtggctgacacntcgtgtc

SEQ ID NO: 73438 - DNA, 584 bp, Homo sapiens
  misc_feature: GYAE6OF01B0MVP.49.46.E02.1.454.CMB.1.raw
  modified_base (262)..(262): a, c, t, g, unknown or other
  misc_feature (262)..(262): n is a, c, g, or t
  modified_base (420)..(420): a, c, t, g, unknown or other
  misc_feature (420)..(420): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaaanagaaacctggaccaggcctccaggctcctcatctatgatcgcactccaaacgacgggcccacgtggacactccccaagcccgaggttccaggtcggctaggtggggtctggtgactagacttcactctacaccatcacgcagcctagctcctagaagnttctgtctagttttactacgtntcagtcaggtcgtaancctaacgtcggtcccttacgtctacgtttcgggacggtaacgggaaccgaagggtacggagtaacgtacaaaacggtaccttagggtacggtccgttacgacccaacgtcttcgttcgtttacccg

SEQ ID NO: 73439 - DNA, 530 bp, Homo sapiens
  misc_feature: GYAE6OF01CJ8AA.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtctccaggggacagtgccacctctcctgcagggccagtcagagtgttagtagctttcttagcctggtaccaacagaaacctggccaggctccaggctcctcatctatgatgcatcccaacgacgggccacgtggcatcccagccaggttcaggtggcaggtgggtctgtgacagacttcactctcaccatcagcagctagagctagaatattctgtactagtttattacgtgtacagcagcgtagactacgtcgtcctctacgtacgtttcgggacggacgggtaccgaagggtaggagtacgtacgaaacgtacgtgtggactcgaccactactcgtgttcc

SEQ ID NO: 73440 - DNA, 519 bp, Homo sapiens
  misc_feature: GYAE6OF01CRTX7.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccacgtggcatccccagccaggttcagtggcagtgggtctggtgacagacttcactctcaccatcagcacgcctagacgcctagaagtattctgtctagttttattactgtcagcagcgtagacaacgtggtcctctctacgtttcggcggaggaccgaaggtggagacgtacgaaacgtacgtgtggctcgacaccactcgtgttc

SEQ ID NO: 73441 - DNA, 513 bp, Homo sapiens
  misc_feature: GYAE6OF01C719O.49.46.E02.1.454.CMB.1.raw
  modified_base (397)..(397): a, c, t, g, unknown or other
  misc_feature (397)..(397): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtgggtctgtgacagacttcactctcaccatcagcagcctagagcctgaagattcngctagtttattactgtcagcagcgtagcaacgtggtcctctcctacgtttcggcggtacgggaccaagggtggagacgtacgaaacggaactggtggctcgacaccatcttgttcc

SEQ ID NO: 73442 - DNA, 869 bp, Homo sapiens
  misc_feature: GYAE6OF01C13JI.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcaggagtgttagtagtcttcgttacgccgtacggtaaccaacgaacgtaaaaccctcggaccgaacgggccctaccccgagggtcccttccctacaacttcctaagtcgtaacttcggacctaacttaccccgaaaaccggaccggggacccctaacggttcgggacctaaccgttaccccccgaacggtccccggttaagggtttcccgaagggttccgggaccgtaacgggggttcggggttcccttagggttacggaaccgtaacggtacctttacccgacctttacctaccctaaccctagttaccgaacggtacctaaccggtaccccgttaaagggacccgtacccgttaaggtaaaacgttacgtttaccgtacggtacccgtttaaaggttttttaacctttaaccgttacggttaccgtaacggtaccgtaacgggtaccggttaacgaacccgtaaaccggttccgggtacccctttaccgttacccgtttaaccgggttttccggggaaccggggtaaaccgggtaacccggtaaagggggttacggaaacggttaaccgtaaccggtaaaaaccggtacgttcgggtacggtccttacggaaccctacctacgttccgttacgttacccg

SEQ ID NO: 73443 - DNA, 761 bp, Homo sapiens
  misc_feature: GYAE6OF01D0TJZ.49.46.E02.1.454.CMB.1.raw
tcagagtcgagagacacgaccggtgctcgatttagactcatctacagggggaaagggggaggaactagcgtcaggttaggacccgagagggaaccatggaagccccagctcacgcttctcttccttcctgcttactctggctcccagataccgaccggagaaattcggtgtttgtacaccagtctcccggccaccctgtctttgtctccaggggacagtgcccgaccctctcctgacagggccaaggtccagacgtgttagttagccttcttacgacctaggtaaccaaactaagtaaacctggtaccaacggctacccaaaggcctcctacacttcctagtcggacttggcctaacttacccgtaaacgacgggggcccctaaccggtacgggacctacgttccccggaacgtacccgtaacgggtttcctaaggtcgggtacggtaagggttcgggggttcctgggttacgaacgtagttaccttacacccttcctaccaacctataccgacgaccacgtacccgtaagacgtcccgttaaggaaacgtactttcgtacggtaccttaaggtttttactacgttgttaccagtacaagtcgttaacgtacttaacgtccgtaccttaccgttaccgtacggtttccgggaccgggtaacggggtaccgtaaagggtacggaacgtaaacgttaaccggaaaacggtacggtcggttacggaccttacggaactacccgttagttccgttcggtttaccc

SEQ ID NO: 73444 - DNA, 527 bp, Homo sapiens
  misc_feature: GYAE6OF01DWVDL.49.46.E02.1.454.CMB.1.raw
  modified_base (385)..(385): a, c, t, g, unknown or other
  misc_feature (385)..(385): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagngcctagaagtattctgctaagttttactactgtcagcagcgtagcaacgtcggcctctctacgttcgggcggagggaccaagggtggagtacgtacgaaaacggtaccgtggtacggcgtacgaccacctactcgtgttccc

SEQ ID NO: 73445 - DNA, 498 bp, Homo sapiens
  misc_feature: GYAE6OF01A7FM3.49.46.E02.1.454.CMB.1.raw
  modified_base (491)..(491): a, c, t, g, unknown or other
  misc_feature (491)..(491): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctagaagtattctgctagtttattactgtcagcagcgtagcaactggcctctctacgttcggcggaggaccgaaggtggagatacgaaacgatgtgctcgcacntctgtcc

SEQ ID NO: 73446 - DNA, 570 bp, Homo sapiens
  misc_feature: GYAE6OF01AO395.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatccccagccagggttcaggtggcagtgggtctgtgacagactttcactctcaccatcagcagccctagacgcctagaacgtactttctagtccttaagttttaacttaacgtggttacaggtcaggtcgtaagccaacgtcgggtcccttcgtcctaccgtttcgggacgggtagggaccgaagggtggaagacgtaaccaaaacggtacgttggtacggacttcggactaaccattccgttgttaccc

SEQ ID NO: 73447 - DNA, 511 bp, Homo sapiens
  misc_feature: GYAE6OF01EKGBW.49.46.E02.1.454.CMB.1.raw
  modified_base (309)..(309): a, c, t, g, unknown or other
  misc_feature (309)..(309): n is a, c, g, or t
  modified_base (505)..(505): a, c, t, g, unknown or other
  misc_feature (505)..(505): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacgnggccacgtggcactcccagccaggttcagtggcaggtgggtctgtgacagacttcactctcacatcagcacgcctagacgtacctagaatattctagtactagtttattactgtcagcagtcgtacgacaacgtcggcctctcacgttcggcggtaggaccgaggtggagatacaaacgtacgtgtgctcgcaacntctgtc

SEQ ID NO: 73448 - DNA, 519 bp, Homo sapiens
  misc_feature: GYAE6OF01B1A34.49.46.E02.1.454.CMB.1.raw
  modified_base (509)..(509): a, c, t, g, unknown or other
  misc_feature (509)..(509): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcaggtgggtctgtgacagacttcactctcaccatcagcagcctagacgcctagaagtattctgctagtttatactgtcagcagcgtagcaacgtcggccttctctacgtttcgggcggacgggaccgtaagggtggagactacgaaacggtactggtggctcgacaccntccgtgttcc

SEQ ID NO: 73449 - DNA, 511 bp, Homo sapiens
  misc_feature: GYAE6OF01CS4U4.49.46.E02.1.454.CMB.1.raw
  modified_base (310)..(310): a, c, t, g, unknown or other
  misc_feature (310)..(310): n is a, c, g, or t
  modified_base (469)..(469): a, c, t, g, unknown or other
  misc_feature (469)..(469): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccacctctcctgcagggccagtcagagtgttagtagcttcttagcctggtaccaacagaaacctggccaggcctccaggcctcctcatctatgatgcatccaacngggccatggcatcccagccaggttcagtggcagtgggtctgtgacagtacttcactctacaccatcagcagcctagacgcctagaagtattcagctagtttatactgtcagcagcgtagcacgtgcctctcgtacgtttcggacggaggaccgaagggngagtactacgaaacgtagtgtcgctcgacactatctgttacc

SEQ ID NO: 73450 - DNA, 509 bp, Homo sapiens
  misc_feature: GYAE6OF01A5ZU1.49.46.E02.1.454.CMB.1.raw
  modified_base (309)..(309): a, c, t, g, unknown or other
  misc_feature (309)..(309): n is a, c, g, or t
  modified_base (501)..(501): a, c, t, g, unknown or other
  misc_feature (501)..(501): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtgcagtgggtctgtgacagacttcactctcaccatcagcagcctagacgcctagaagtattctgctagtttattactgtcagcagcgtagctaacgtcggtcctctctacgttcggcggacgggaccagggtggagactacgaaacgtactggtgctcgcaccntcgtgtcc

SEQ ID NO: 73451 - DNA, 563 bp, Homo sapiens
  misc_feature: GYAE6OF01D9HA0.49.46.E02.1.454.CMB.1.raw
  modified_base (549)..(549): a, c, t, g, unknown or other
  misc_feature (549)..(549): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaacctggccaggctccaggctcctcatctatgatgcatccaacaggccactggcatcccagccaggttcagtggcagtggtctgtgacagacttcactctcaccatcagcagcctagacgcctagaaacgtacttcgtagacttagtttacttactgtacaggtcagtcgtaagcctaaccgtcggtacccttcgtacttacggtttcgggacgggtaacgggaccgtaaagggtggaacgtagtaaccgaaacgtaacgtggtacggctacggacctaaccgtnttccgtggttaccc

SEQ ID NO: 73452 - DNA, 641 bp, Homo sapiens
  misc_feature: GYAE6OF01CIYYH.49.46.E02.1.454.CMB.1.raw
  modified_base (402)..(402): a, c, t, g, unknown or other
  misc_feature (402)..(402): n is a, c, g, or t
  modified_base (429)..(429): a, c, t, g, unknown or other
  misc_feature (429)..(429): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtcgcccaccctctcctgcagggccagtcagagttgttagtagcttcttagcctaggtaccaacagaaacctggccaggcctcccgaggcctcctcatctatgatgcactccaacgacgggcccagtcggaccactcccgagcccgtaggttccaggtcggacgtaggtgggtctgtagactagtacttcactctacactncagctagcctagactaccgtagaactnttaccgtgtacttaagttttactacgtgtacagcgacgtcgtagacctaacgtcggtacccttcgtaccgttaccggtttccggggacgggtaaccgggtaacccgtaaagggggttacggaaacgaaccgttaaccgaaaaccgggttacgtcgggttaccgggtctaaccgggtacccaaacccgttcttcccgggttacgttttacccc

SEQ ID NO: 73453 - DNA, 544 bp, Homo sapiens
  misc_feature: GYAE6OF01C30FZ.49.46.E02.1.454.CMB.1.raw
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcttagcctggtaccaacagaaacctggccaggctcccaggctcctcatctatgatgcatccaacagggccactggcatccccagccaggttcagtgcagtgggtctgtnacagacttcactcncacatcagcagcctaagacgcctagaagtattcgtgacttaagttttacttaccgtgttacagcagcgtaagcaacgtggcctctctacgtttcgggacggacgggaccaagggtggaacgaactacgaaaacgtaacgttggtacggacttcggaccctaccgtaactcgttgttcc

SEQ ID NO: 73454 - DNA, 606 bp, Homo sapiens
  misc_feature: GYAE6OF01D9RAV.49.46.E02.1.454.CMB.1.raw
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgcccaccctctcctgcagggccagtcagagtgttagtagcttctagcctggtaccaanagaaacctggccaggctccaggctcctcatctatgatgcatccaacgngggccacgtggcactcccagccaggttcagtggcaggtgggtctggtgacagtacttcacttctacaccatcagcacgcctaagcgacctaggaacgtactttcgtagtccttaagttttacttacgttcgtacaggtcgaggtacgtaacgacctaacgttcgggtcccttaccgttcgttaccggtttcgggaccgggaagggtacccgtaaggggtcggaagtaacgttaacgaaacggttacgttgggtacggaccgttacggaccgtaaccctagttccgtcgtttacccg

SEQ ID NO: 73455 - DNA, 538 bp, Homo sapiens
  misc_feature: GYAE6OF01DN3D3.49.46.E02.1.454.CMB.1.raw
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcatccaacngggccactggcatcccagccaggtcagtgcagtgggtctgtgacagacttcactctcaccatcagcacgcctagacgcctagaagaattctagtctagtttattactgtacagcagcgtagctaacgtcgtcctctctacgtttccgggcggtaacgggaccgaagggtggaagtaagtacgaaacggtaacgttacggtaggacgtagacacctacttcgtgttacc

SEQ ID NO: 73456 - DNA, 548 bp, Homo sapiens
  misc_feature: GYAE6OF01EM96W.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgagggccacgtggcatcccagccaggttcaggtggcaggtgggtctgtgacagacttcactctcacatcagcacgcctagacgcctagaagtcttctgtactagttttatactgtacagctaggcgtagacaacgtcggtccttcgtctaccgtttcgggacgggtaacgggaccgtaagggtacggaagaacgttacgaaacgtacgtggtacggactcgacaacctattccgtgttcc

SEQ ID NO: 73457 - DNA, 503 bp, Homo sapiens
  misc_feature: GYAE6OF01A7GV5.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatccccagccaggttcagtggcagtgggtctgtgacagacttcactctcaccatcagcagcctagacgcctgaagattctgctagtttattactgtcagcagcgtagcaactggtcctctctacgtttcggcggagggaccaaggtggagtatacaaacgactgtggctgcaccatctgttcg

SEQ ID NO: 73458 - DNA, 668 bp, Homo sapiens
  misc_feature: GYAE6OF01C3M1I.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagcttcttagcctggtaccaacagaaacctggccaggctcccaggcctcctcatctatgatgcatcccaacgacgggcccacgtggcaactccccgaagtcccagggtttccaggttcggacgtaggttgggtctggtgaacagtacttcacttctcacctatcagcacgcctaaggacgtcccgtaggtaactacgtttcgtacgtacttaagttttaactttacgtgttacctaacggtccgtaacggtcgtaacgtaccgtaaaccgttcgggtacccctttcgttacccgttaccggttttccggggaccgggtaacgggggtaacccgtaagggggttacggaacggtaacggtaaccggaaaaccggtacgttagggtcggtaccgttacggaccctaccgtaacttccgttcgtttacccg

SEQ ID NO: 73459 - DNA, 495 bp, Homo sapiens
  misc_feature: GYAE6OF01DKO01.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtgggtctgtgacagacttcactctcaccatcagcagcctagagcctgaagattctgctagtttattactgtcagcagcgtagcaactggcctctctactttcggcggaggaccaggtggagagtacaaacgaactgtgctgacacatctgtcc

SEQ ID NO: 73460 - DNA, 613 bp, Homo sapiens
  misc_feature: GYAE6OF01CKTQ4.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggcccaggctcccaggcctcctcatctatgatgcatccaaacgacgggccacgtcggcactccccgagccctagggttcaggtggctaggtcgggtctgtagacagtccttcactctcaccatcagcagcctacgcgcctagaacgtattctaggtcttagttttattaccgtgtacaacgtcgacgtacgtaacgtacgtaaccgtcggtacccttccttcgtaaccggtttccgggaaccgggtacgggtaacccggagggtacggaacgtaacgtaaccgtaaaacggtacgttacggtaggtaccgtacggacctaaccgtacttccgtcggtttaccc

SEQ ID NO: 73461 - DNA, 534 bp, Homo sapiens
  misc_feature: GYAE6OF01BMTNG.49.46.E02.1.454.CMB.1.raw
  modified_base (261)..(261): a, c, t, g, unknown or other
  misc_feature (261)..(261): n is a, c, g, or t
  modified_base (311)..(311): a, c, t, g, unknown or other
  misc_feature (311)..(311): n is a, c, g, or t
  modified_base (407)..(407): a, c, t, g, unknown or other
  misc_feature (407)..(407): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaaacctggccaggcctcccaggctcctcatctatgatgcatccaacgngggccactggcatcccagccaggttcagtgcagtggtctgtgacagtacttcactctacaccatcacgcacgcctagcgtcctagaaagtacttcngactagttttacttacgtgtcagcagcgtagcacgtggcctntcncgttcggacggtacggacctagggnggacgagtaccgaaacggtacgtcggaggtctacggacctaccgattccgtgttacc

SEQ ID NO: 73462 - DNA, 573 bp, Homo sapiens
  misc_feature: GYAE6OF01B5KAT.49.46.E02.1.454.CMB.1.raw
  modified_base (290)..(290): a, c, t, g, unknown or other
  misc_feature (290)..(290): n is a, c, g, or t
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctccaggctcctnatctatgatgcatccaacgaggccactggcactcccagccaggttcagtggcagtggtctgtgacagcttcactcncaccatcagcagcctagacgcctagaacgtattcgngtacctagttttaactaccgtgtacgacgtcgagcgtaagacctaacgttcggcccttactaccgttacgtttccggggacggacgggtaccgaagggttacggacgtaacgtaccgaaaacggtacgttggtacggacttcggaccctaaccgtacttccgttgttaccc

SEQ ID NO: 73463 - DNA, 517 bp, Homo sapiens
  misc_feature: GYAE6OF01ELZE1.49.46.E02.1.454.CMB.1.raw
  modified_base (261)..(261): a, c, t, g, unknown or other
  misc_feature (261)..(261): n is a, c, g, or t
  modified_base (508)..(508): a, c, t, g, unknown or other
  misc_feature (508)..(508): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaaacctggccaggctcccaggctcctcatctatgatgcatccaacagggccactggcatcccagccaggttcagtggcaggtgggtctgtgacagtacttcactctcaccatcagcagcctagacgcctagaagtattctgctagttttattactgtcagcgagcgtagctaacgtggtccttctcgtacgttcgggcggtaggaccgagggtggagtactacgaaacgacgtgtagcgtgcacntcgtgttcc

SEQ ID NO: 73464 - DNA, 588 bp, Homo sapiens
  misc_feature: GYAE6OF01B600C.49.46.E02.1.454.CMB.1.raw
  modified_base (289)..(289): a, c, t, g, unknown or other
  misc_feature (289)..(289): n is a, c, g, or t
  modified_base (397)..(397): a, c, t, g, unknown or other
  misc_feature (397)..(397): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctaggtaccaacagaaacctggccaggctccaggctccncatctatgatgcatccaacgaggccactggcactcccagccaggttcagtgcagtggtctgtgacagtacttcactctcaccatcagcagcctagacgcctagaagtnttctgtactagtttatactgactagtcagtacgtagacaacgtcggtaccttaccgtacgtaccggtttcgggaccggggtaacggggaacccgtaaaggggttacggaacgtaacgttaaccgaaaaccggttaacgtacgggttagggaccttacgggacctaacccgtaatttccgttggtttacccc

SEQ ID NO: 73465 - DNA, 541 bp, Homo sapiens
  misc_feature: GYAE6OF01ECCKI.49.46.E02.1.454.CMB.1.raw
  modified_base (428)..(428): a, c, t, g, unknown or other
  misc_feature (428)..(428): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccacgtggcactcccagccgaaggttcagtggctaggtgggtctggtgacagtacttcactctcaccatcagcacgcctaagagcctagaagtattctgactagttttattacgtntacagcagcgtagctaacgtggtccttctctacgtttcggacgggtacgggaccgaaggtggagaagtacgaaaacgtacgtagtcggactcgacctaccattcgtcgttacc

SEQ ID NO: 73466 - DNA, 598 bp, Homo sapiens
  misc_feature: GYAE6OF01EQGQE.49.46.E02.1.454.CMB.1.raw
  modified_base (261)..(261): a, c, t, g, unknown or other
  misc_feature (261)..(261): n is a, c, g, or t
  modified_base (290)..(290): a, c, t, g, unknown or other
  misc_feature (290)..(290): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaaacctggccaggctcccaggctcctnatctatgatgcactccaacgagggccacgtggacatcccagccctaggttcagtggcaggtgggtctgtgacagacttcactctcacatcagcagcctagacgcctagaagtattctagtctaagttttaacttacgtgtactagacgagtacgttagaccgtaacgtcgggtacccttcgtacgtaccgtttccggggacgggtacgggtaacccgaaagggttacggaacggtaacgtaccggaaaaacggtacgttagggtacggaccgtacggaccctaacccgtagttcccgtggtttacccc

SEQ ID NO: 73467 - DNA, 648 bp, Homo sapiens
  misc_feature: GYAE6OF01A73KC.49.46.E02.1.454.CMB.1.raw
  modified_base (291)..(291): a, c, t, g, unknown or other
  misc_feature (291)..(291): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagcttcttagcctggtaccaacagaaacctggccaggctcccaggctcctnatctatgatgcatccaaacgcgggccaacgtggacactcccgagccctaagggttccaggtgggacctagggttcgggtctggtcgaacgacgtacttccactctcaacctatcacgacacgtacctaagacgtcccgtagaaacgtattctacgtaccttaaggttttaactttaccgtgtaccgtaacgtcgtaacgggcggttaacgacccgtaaacgttcgggtaccccttcgtaccgttaaccggtttccgggaccgggtaacgggtaacccgtaagggtacggaacgtacgtaaccgaaaacggtacgttcggtacggacgttacgaccgtaactcttcgttcgttacccg

SEQ ID NO: 73468 - DNA, 573 bp, Homo sapiens
  misc_feature: GYAE6OF01C1ZJL.49.46.E02.1.454.CMB.1.raw
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggaccaggctcccaggctcctcatctatgatgcatccaacngggccactggcatcccagccaggtcagtgcagtggtctgtgacagacttcactctacaccatcagctaacgcctaagacgcctagaaagtacttcgtagtacttaaggttttattaccgtggttaccaaggcgaggtacgtaacgactaaacgttcgggtacccttcttaccgtaccgtttcgggacgggtaacgggtaccgaaggggttcgaaggtactaagaaacgtacgtggtaggctcggacacgtactcgtcgttacc

SEQ ID NO: 73469 - DNA, 760 bp, Homo sapiens
  misc_feature: GYAE6OF01ADR9K.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcagggccagtcagagtgttagtagcttcttagcctggtaccaacagaaacctggccaggcctcccgaggcctcctcatctatgatcgacactccaacgcgggccacgtcggcactcccgagcccgtagggttccaggtcggcgtagggttcgggtctggtacgaacgtacggtacctttaccgaccttccctaccgaaccctacttaccgaacggtacccaacggtacccgttaaggaccgtcccgttaaggaaacgtttctttacgtacgttaacctttaacggtttttaacttaccgttcggtaacccgacggttaccgaacggttaccggttaacgaacccgtaaccggttccgggtacccctttaccgttacccggttaaccgggtttaccggggaccggggtaaacgggtaacccggttaaacggggtagggaaaccggtaaaccgtaaacccgggtaaaacggttcggttacgggtccgggtacccgttaccggaccccgtaaccgttaccgttttcccgttcggtttaccccc

SEQ ID NO: 73470 - DNA, 545 bp, Homo sapiens
  misc_feature: GYAE6OF01EUBH1.49.46.E02.1.454.CMB.1.raw
  modified_base (356)..(356): a, c, t, g, unknown or other
  misc_feature (356)..(356): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttctagcctggtaccaacagaaacctggccaggcctcccaggctcctcatctatgatgcatccaacagggccacgtggcactcccagccaggttcaggtggcaggtgggtctgngacagtactctactctcacatcagcagcctagacgtcctagaagtattcgtgacttagtttattactgtcgagcagtcgtgacacgtggtcctcgtctacgttcgggacgggacggaccgtaagggtagaggtaacgtacgaaacgtacgtaggtcggtctacggaccacccgtacttccgtgttaccc

SEQ ID NO: 73471 - DNA, 561 bp, Homo sapiens
  misc_feature: GYAE6OF01BGSN7.49.46.E02.1.454.CMB.1.raw
  modified_base (520)..(520): a, c, t, g, unknown or other
  misc_feature (520)..(520): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagcttcttagcctggtaccaacagaaacctggccaggcctcccgaggctcctcatctatgatgcactaccaacgacgggccacgtggaccactcccgagccgtaggttcaggtcggacgtaggttggggttggacagtacttcgacgctacacatcagacacgctagacgccgtagaagttatttgacttagtttattactgtacaactcgtactacagagtacttcacgtttccggaccgtggaccagtagtagatacgtacgaaacgtacgtggtcgntaggccacctatcgttcgttacttacacttccgtcccgtac

SEQ ID NO: 73472 - DNA, 540 bp, Homo sapiens
  misc_feature: GYAE6OF01EZ1GE.49.46.E02.1.454.CMB.1.raw
  modified_base (265)..(265): a, c, t, g, unknown or other
  misc_feature (265)..(265): n is a, c, g, or t
  modified_base (313)..(313): a, c, t, g, unknown or other
  misc_feature (313)..(313): n is a, c, g, or t
  modified_base (353)..(353): a, c, t, g, unknown or other
  misc_feature (353)..(353): n is a, c, g, or t
  modified_base (400)..(400): a, c, t, g, unknown or other
  misc_feature (400)..(400): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagaaattgtgttgactacagtctccggccaccctgtctttgtctccaggggacagtgccaccctctcctgcagggccagtcagagtgttagtagtacttcttagcctggtaccaanagaaacctggccaggctcccaggctctcatctatggatgcatccaacngggccatggcatccagccagttcagtggcagtggtctgtnacagacttcactctacactatccgagcacgtctagacgcctgaagtntcgtgctagtttatactgtcagtcagtacgtagactaacgtcgtcctactactacgttacggcggagggaccaaagggtcgaagtactaacgaaacggtactcgggtagacgtacggaccaaccgtatccgtcgttaccg

SEQ ID NO: 73473 - DNA, 644 bp, Homo sapiens
  misc_feature: GYAE6OF01C2TZ0.49.46.E02.1.454.CMB.1.raw
  modified_base (443)..(443): a, c, t, g, unknown or other
  misc_feature (443)..(443): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtcgcccaccctctcctgcgagggccagtcagagttgttagtagtcttcttagcctggtaaccaacgaagaaacctggacccaagggcctacccgaggtcctcctacattctatgatcgacatccaaacgacgggccacgtggccaactccccagcctaaggttcaggtcggcgtaggtgggtctggtcgaacagtacttcactctacacatcagcacgctagactctagaagtacttcgngtacttagttttactacgtgtaacaacgtacggtaccgttaaccagtaaggttacctttaccgtaccgtttccgggaccccgttaggggaccctagggtaagttacggtaacttaacgaaccgaaaacgggtaacgttgggtaccggtaaccgttcggaacccctaaccgttacttccgtttacgttccttcgtaaccccg

SEQ ID NO: 73474 - DNA, 600 bp, Homo sapiens
  misc_feature: GYAE6OF01D76LD.49.46.E02.1.454.CMB.1.raw
  modified_base (429)..(429): a, c, t, g, unknown or other
  misc_feature (429)..(429): n is a, c, g, or t
  modified_base (435)..(435): a, c, t, g, unknown or other
  misc_feature (435)..(435): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagcttcttagcctggtaccaacagaaacctggccaggcctccaggcctcctcatctatgatcgcatccaacgcgggcccacgtggaccactccccagcccgtaggttccaggtggcaggttcgggtctgtcgactagtaccttcacttctacaccatcagcacggtccctaaggacgtcctaggaactntttcgngtacttagttttactaccgtgttacagtactagtacgtaacgacctaacgtccgggtccttcgtaccgtacggtttaccgggacgggtacgggaaccgtagggtacggaagtacgtaacgaaacggtcgtgggtacgcgtacgaccaacgtcttcgtgttacccg

SEQ ID NO: 73475 - DNA, 578 bp, Homo sapiens
  misc_feature: GYAE6OF01BKYPY.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcactcccagccaggttcagtggcaggtgggtctgtgacagtacttcactctcaccatcagcacgcctagacgcctagaagtattctgactagttttattacgtgtacagcaggtcgtagactaacgtcggtcccttcgtacctacgtttccgggacgggtacggggaacccaaaggggttcggaacggtaacttaccgaaaacggtacgttacgggtgggaccgttcggaccctaacccgtacttccgttggttacccg

SEQ ID NO: 73476 - DNA, 549 bp, Homo sapiens
  misc_feature: GYAE6OF01C77WO.49.46.E02.1.454.CMB.1.raw
  modified_base (415)..(415): a, c, t, g, unknown or other
  misc_feature (415)..(415): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcttagcctggtaccaacagaaacctggccaggctcccaggctcctcatctatgatgcatcccaacgacgggcccacgtggccaactccccagcccaggttcaggtggcaggtgggtctgtgacagacttcactctcaccatcagcacgcctagacgcctagaacgtattcgngtctagttttacttactgtacagcagtcgtaagctaacgtcggtccttctctacgtttcggcggaagggaccgaagggtggacgtacgtacgaaacgtacgtggtcggacttcgactacctacttcgtgttacc

SEQ ID NO: 73477 - DNA, 581 bp, Homo sapiens
  misc_feature: GYAE6OF01B8DO7.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctcatctatgatgcatccaacagggccactggcatcccagcccaggttcagtggcaggtgggtctggtgacagacttcactctcaccatcagcagacctagacgtccgtagaaacgtattacgtcgtacttagtttaattacgttgtacgagactagcgtaacgacgtaacgtcggtccttcgttctacgtttcgggacgggtaacgggaccgtaaggggtacggaaggtaacgtaacgaaaacggtacgttaggtacggccgtacggaccaccgtacttcgttcgttacccg

SEQ ID NO: 73478 - DNA, 723 bp, Homo sapiens
  misc_feature: GYAE6OF01CFWFR.49.46.E02.1.454.CMB.1.raw
  modified_base (215)..(215): a, c, t, g, unknown or other
  misc_feature (215)..(215): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtcttgtctccaggggacagtgccaccctctccgngcgacggcctagtcaggtagttagttagtacgtctttacgttacgtccgtacggtaaccaaacgaaacgtaaaccgtcggaccgacggtccctaccggaggtccctcctactacttctagtagactcgactactaccaacggacggacctacggtcgactacctaccgacgtaccgtaggttcgagggttcgacgtacgggttcggtcgtggtacgaacgtacgtccttaccgactcctaaccacctacgtacgacgacacgtaccgtaaggaccgtacgtaaggtaaacgttcgttaccgtacgtaacgtttaacggtttttaacttaccgtacggttaacgacgtacgaacggtacggtaacgtaaccgtacggtccgtacccttaccgttacgtttaacccgggttcggggaacgggtaacggtaaccggtaaggggtacgtaacgtaacgtaaccgaaacgtcgtcgggtacgtacgtacgacctaactcgttcgtcgtttacc

SEQ ID NO: 73479 - DNA, 559 bp, Homo sapiens
  misc_feature: GYAE6OF01CUZIO.49.46.E02.1.454.CMB.1.raw
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaaacngggccacgtggcactcccagccaggttcagtggcaggtggtctgtgacagacttcactctcacatcagcagcctagacgcctagaagtattctgtctagtttattacgtgtacagtacagtcgtagactaacgtcggtcccttcttccgtacgtttccgggacgggtacgggtacccgaaagggtcgggaagtacgtacgaaaacggtacgttggtacggctacggaccacctacgtcgttcgttaccg

SEQ ID NO: 73480 - DNA, 706 bp, Homo sapiens
  misc_feature: GYAE6OF01BYF1Z.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtcgcccaccctctcctgcgagggccagtcagagttgttagtagctttctagcctaggtaccaaacagaaacctggaccaggcctccgaggcctcctcactctatgatgcactccaacgacggccactggacactcccagcctaggttcaggtcggacgtaggtgggtctggtagacgtacgtacttcgaccttactccaaccgatacgaacgacctacgacccgttaaggaccgtaccgttaggtaaacgtacgttttccacgggttactttaaacggttttttaacttaaccgttcggttaaccgtacggtaacccgtaagggtaccggttaaacggtacccgtaaaccggttcgggtaccctaacgtttccgttaaccgttacccggttttacgggggaccgggtaaacggggtaacccgtaaaggggtacggaaacgtaacgtaacgtaaaaccggtacggtacggtacggaccttacggaccctacgtacttcggttacc

SEQ ID NO: 73481 - DNA, 547 bp, Homo sapiens
  misc_feature: GYAE6OF01CJO86.49.46.E02.1.454.CMB.1.raw
  modified_base (288)..(288): a, c, t, g, unknown or other
  misc_feature (288)..(288): n is a, c, g, or t
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
  modified_base (533)..(533): a, c, t, g, unknown or other
  misc_feature (533)..(533): n is a, c, g, or t
tcagagtcgagagacacgaccggtgctcgatttagactcatctacagggaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaacctggccaggctcccaggctcctnatctatgatgcatcccaacagggccactggccatccccagccaggttcagtggcaggtgggtctgtgacagacttccactctcaccatcagcngcctagagcctgaagatttcngctagtttattacgtgtcagcacgnggtacgtacaaccgtggtcccttcgtctaccgttcgggaccgggagggacccgaaagggtgggaacgtataccgaaacggtactggttcggacgtcgaccaacccncttcgtcgttaccg

SEQ ID NO: 73482 - DNA, 562 bp, Homo sapiens
  misc_feature: GYAE6OF01CF6NV.49.46.E02.1.454.CMB.1.raw
  modified_base (311)..(311): a, c, t, g, unknown or other
  misc_feature (311)..(311): n is a, c, g, or t
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggaccaggctcccagtctcctcatctatgatgcatccaacnggccactggcatcccagccaggttcagtggcaggtgggtcngtgacagtacttcactctcaccatcagcagcctagacnctagaagtattcgtagtcttaagttttatactgtcaagctaagtcgtaagacaacgtcggtacccttcttccgtaccgtttcgggacgggtaacgggtaaccgtaagggtacggaacgtaacgttaacgaaaacggtacgtaggtcgactacggaccactactcgtgttccc

SEQ ID NO: 73483 - DNA, 572 bp, Homo sapiens
  misc_feature: GYAE6OF01CFAV2.49.46.E02.1.454.CMB.1.raw
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccagggacagtcgcccaccctctcctgcagggccagtcagagtgttagtagcttcttagcctggtaccaacagaacctggccaggctccagcctctcatctatgatgcactccaacgcgggccacgtggacactcccagcctaggttcaggtcggactaggtcgggtctgtagacagtcttcactctcaccatcagcacgctagacnctagaagtcttcgngtctagtttacncttgacagctagcgtagaccgtaacgtcggtacctccttacgtaccgtttcgggacggtacggaccggtaaagggttgaaacggtaacgtaacgaaaacggttctcgggtacgtcgtacgaaccctaccgtacttcgtacgttacccg

SEQ ID NO: 73484 - DNA, 590 bp, Homo sapiens
  misc_feature: GYAE6OF01A7171.49.46.E02.1.454.CMB.1.raw
  modified_base (419)..(419): a, c, t, g, unknown or other
  misc_feature (419)..(419): n is a, c, g, or t
  modified_base (476)..(476): a, c, t, g, unknown or other
  misc_feature (476)..(476): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacgagaaacctggccaggcctcccaggctcctcatctatgatgcatccaacgagggcccacgtcggaccactccccagcccgtaggttcaggtggctaggtcgggtctgtcgacagtacttcactctcacctatcagcagcctagacgacctagaacgtnttcgtgtacttagttttactacgtgtacagtcagtcgtacgacaacgtcgtcccttntccgtacgtttcgggacggtaacgggacccgtaaagggtcgggaacgtactaaaccggaaacggtaccgttggtacggtacctcggaccctaacccgtattccgtcgtttcccg

SEQ ID NO: 73485 - DNA, 567 bp, Homo sapiens
  misc_feature: GYAE6OF01AEDD8.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgacgggccacgtggcactcccagccaggttcaggtgcaggtgggtctgtgacagtacttcacttctcaccatcagcacgcctagacgcctagaacgtacttctgtacttagttttacttacgtgttacacgtcgtagtcgtagactaacgtcggtccttctacgtacgtttccgggacgggtaacgggaccgtaagggtggaacggtaacgtaacgaaacggtacgtggtacggcgtgtaccaccgtatcgttgttccc

SEQ ID NO: 73486 - DNA, 578 bp, Homo sapiens
  misc_feature: GYAE6OF01EJJBK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaacctggccaggctcccaggcctcctcatctatgatgcatccaacgagggccacgtggcactccccagccaggttcagtggcaggtgggtctgtgacagcttcactctcaccatcagcagccctagacgcctagaagtactttctgacttagtttattacgtgtcagcagcgtacgacctaacgtcggacccttcttaccgtaccggtttcgggaccgggtacgggaacccgtaaagggtcgggaacgtaacgttacgaaaaccggtacgttagggtacggaccgttcggacctaaccctattcccgttgttccc

SEQ ID NO: 73487 - DNA, 521 bp, Homo sapiens
  misc_feature: GYAE6OF01CUCNT.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacaggccactggcatcccagccaggttcagtgcagtgggtctgtgacagacttcactctcaccatcagcagcctaagacgacctagaaagatttacgtgtactaagttttaacttactgtacagcagcgtaagctaacgtggcctctctacgtttcggacggaggaccaagggtgagactacgaaacgaactgtggactgacacaatctgttacc

SEQ ID NO: 73488 - DNA, 548 bp, Homo sapiens
  misc_feature: GYAE6OF01DGQDV.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccaccctctcctgcagggccagtcagagtgttagtagctttcttagcctggtaccaacagaaacctggccaggctcccaggctcctcatctatgatgcatccaacagggccactggcatcccagccaggttcagtggcagtgggtctgtgacagacttcactctcaccatcagcagcctagacgcctgaagatttctgcctagttttattacgtgtcctagcagcgttagcaacgtcggccttctcgtacgtttccgggcggtaacggggaccaagggttggaaggaactacgaaaacggtaacgttggtaggaccgtggaaccaccgtaatcgttggtttaccc

SEQ ID NO: 73489 - DNA, 641 bp, Homo sapiens
  misc_feature: GYAE6OF01ERJ77.49.46.E02.1.454.CMB.1.raw
  modified_base (260)..(260): a, c, t, g, unknown or other
  misc_feature (260)..(260): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcttgtctccaggggacagtgccaccctctcctgcagggccagtcagagtgttagtagcttcttagcctggtaccaanagaaacctggccaggctccaggctcctcatctatgatgcatccaacagggccactggacacctaccacgaccgtacggtacgtagtacggacgtacggtcgggttcggtaggtacgtaacgtaacgtacgttacctacctacctacctaacctactactacgtaccgtacgaccgtacgtacgtacgtacgtaacgtacgttacgtacgtacgttaagtttaactttacgttacgtacgtacgtacgacgtacgtacgaccgtacgtacgtccgttcttaccgttacgttaccggtacgggtacgggtaaccggtaacggtacggtacggtaagtaacgtaaacgaacgtacgtacgtacgtacgtacacctacgtcgtcg

SEQ ID NO: 73490 - DNA, 545 bp, Homo sapiens
  misc_feature: GYAE6OF01DVTZL.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggcccagtcagagtgttagtagcttctagcctggtaccaacagaacctggccaggctcccaggctcctcatctatgatgcatccaacgacgggccacgtggcactcccagccaggttcagtggcagtggtctgtgacagacttcactctacaccatacagcacgcctaagacgtcctagaagtacttctcgtacttagtttacttactgtacagcagcgtagacaacgtcggccttcgtctacgtttcggacgggtacgggtaccgaggtggagtactacgaaacggtacgtcggtgcgtcgacctaccgactccgtgttaccc

SEQ ID NO: 73491 - DNA, 617 bp, Homo sapiens
  misc_feature: GYAE6OF01DE13C.49.46.E02.1.454.CMB.1.raw
  modified_base (290)..(290): a, c, t, g, unknown or other
  misc_feature (290)..(290): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagcttcttagcctggtaccaacagaacctggccaggctcccaggctcctnatctatgatgcatcccaacgacgggccacgtcggcactcccagcctaaggttcaggtggcaggtcgggtctggtgactagtaccttcactctaccactatcagcagcctaagcgctagaagtattctcgcttagttttattacgtgtacagcgagtcggtaagctaacgtcggtccttcgttacctacggttttccgggacgggtaaaccgggtacccgtaagggggttacggaaacggttaacgtaaccggtaaaaccggtaacggttcgggtaccggggtaccttacgggtaaccctaccttaacgttccgtttcggtttacccc

SEQ ID NO: 73492 - DNA, 567 bp, Homo sapiens
  misc_feature: GYAE6OF01CHLX1.49.46.E02.1.454.CMB.1.raw
  modified_base (405)..(405): a, c, t, g, unknown or other
  misc_feature (405)..(405): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcatccaacgagggccacgtggccactccccagccaggttcaggtggcagtgggtctgtgacagacttcactctcaccatcagcagcctagagcctgaagattcngctagtttatactgtcagcagtcgtagactaactcggtcccttctcgtacgtttcgggacggtaacgggacccgtaagggtcggaacgaacgttaaccgaaaaccggtacgttcgggtacgggtaccgttacgacccgtaacctacttccgttcggttaccc

SEQ ID NO: 73493 - DNA, 603 bp, Homo sapiens
  misc_feature: GYAE6OF01AIO6T.49.46.E02.1.454.CMB.1.raw
  modified_base (417)..(417): a, c, t, g, unknown or other
  misc_feature (417)..(417): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagtcttcttagcctggtaccaacagaacctggccaggcctccaggctcctcatctatgatgcatccaacgacgggccacgtggcactcccagccaggttcaggtggctaggtgggtctggtcgacagtacttcacttcctacacctatcacgcacgacctagacgcctagaaacgtnttctcgtacttagttttacttacgtgtcagtcacggtcgtaacgcctaacgttcggtacccttcttaccgtaccggtttcgggaccgggtaacgggtaaccgaaggggttacggaacggtaactaaccggaaaaccggtacgttgggtacggcttacgacccaaccgtagttccgttgtttacccg

SEQ ID NO: 73494 - DNA, 750 bp, Homo sapiens
  misc_feature: GYAE6OF01DU0VU.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagatacccaccggagaaattgtgttgacacagtctccggccaccctgttctttgtctccaggggacagtcgcccaccctctcctgcagggccagtcagtagtgttagtagctttcttagcctggtaccaaacagaaacctggccaggcctccgaggcctcctcatctatgatgacactaccaacgacgggccacgtcggaccacgtccccagtcccgtagggttccaaggttcggaccgtaggggttcggggtcttggtacggtaaccgtaaggtaaccctttccgaaccttccctaaccgaaccctaatccgaacgccgtaacgacccttaaggacgtcccgttaagaaacgttactttcgtacgtacgttttaacggtttttaacttaccgttacgtaccgaacggtacgtaacgggaccgtttaacggacctaaaccggttcccggttacccttccgttaccgttacccgggtttcgggggaaccgggtaaaccggggtaccgtaaagggggttacggaaacggtaaccgttaaaccgggaaaaccggttcggtacgggtacgggaccgttaccggacccttaaacccgggctttaccgtcggtttaaccc

SEQ ID NO: 73495 - DNA, 637 bp, Homo sapiens
  misc_feature: GYAE6OF01CBNPK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggcctcctcatctatgatgcatccaacgcgggccacgtggcactcccgagcctaggttcaggtcgacgtaggtgggtctggtgaacgagtaccttcaccttcctaccaccatccgacgacacgtccctaaggacgtacccgtaggaaacgttctttcgtaggtaccttaagtttttaacttaccttgtactagtccaacggtacgtaacgtacctaacggtccggtacccttcgttacccgttacggtttccgggaaccgggtaacgggaccgtaaaggggtggaacgtactaacggaaaaccggtagtcggttaggaccgttcggacccaaccgtacgttcgttacgttaccc

SEQ ID NO: 73496 - DNA, 716 bp, Homo sapiens
  misc_feature: GYAE6OF01BW0VY.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtcgcccaccctctcctgcgagggccagtcagagtgttagtagcttcttagcctaggtaaccaacgacgaaaccgtggccaggcctcccgaggcctcctcatctatgatgcactccaaacgacgggccacgtggaccacgtaccccaggcccgtaggttccaggttcggcgtagggttcgggtctggtagactacgtacctttccgaaccttcctaccgacctataccgaacgtccgaacgtcccttaaggaccgtaccgttaaggaaaacggtttctttacccgtggttaaccttacggttttttaacttacggttacgtacgaacggtcgtaacggtacggtttaacgaccgtaaccggttccggtacccttacgttaccgttaccgggttcggggaacccggggtaacggtaacccggtaagggttacggaacgttaaacgtaacccgaaacggttacgttcgggtaccggtacgtacggaccctaaccgtcgtttccgttcgtttaacccg

SEQ ID NO: 73497 - DNA, 569 bp, Homo sapiens
  misc_feature: GYAE6OF01EBFCX.49.46.E02.1.454.CMB.1.raw
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
  modified_base (420)..(420): a, c, t, g, unknown or other
  misc_feature (420)..(420): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcagggccagtcagtagtgttagtagctttctagcctaggtaccaanagaaacctggccaggcctccaggcctcctcatctangatgcataccaacgngggccacgtggcacgtcccagccgtaggttcaggtggctaggtgggtctggagacagtactcgactctacacctatcagcacgtcctaagcgacctagaactnttcctgtacttagttttactacttgcagcagcgtagactacgtcggtaccttccgtacgtaccggttcgggacgggtaacggtaccgagggtaggaacgtacgtaacgaaacggtactggtacgactcggacactagttcgtgttaccg

SEQ ID NO: 73498 - DNA, 682 bp, Homo sapiens
  misc_feature: GYAE6OF01AIZ7D.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgagggacagtcgcccaccctctcctgcagggccagtcagtagtgttagtagtcttcgtagcctggtaaccaacagaaaccctggccaggcctcccaggtctcctcatctatgatgcatccaacgcgggccacgtgccactccccgagtcctaggttcaggtcggacctaggttcgggttcctaggttacgaacgtacggttaccctttcgaaccgtttcctaaccgaacccgtacgttccgaaccgtaccgtaaccggtaccccgttaacgggtaacccgtacccgttaacggtaaacgttaccgtttacgttacgtacgtttaacgttttaacgttaccgttacgtacgtagtacgacgtacgtacgacctacgtcgtaccttccgtacgtacggtttaccggacgggtaacgggtaccgtaagggtggaacgtacgtaaccgaacggtacgtggtacgcgtacgacgtacctcgtccgttgttaccg

SEQ ID NO: 73499 - DNA, 671 bp, Homo sapiens
  misc_feature: GYAE6OF01CS0IN.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccgaggctcctcatctatgatgacactaccaacgacgggcccacgtggccactcccagccgtaggttcaggtggcgtaggtcgggtctggtgactacgtacttcaccttctaccacctataccgacgacctaacggcccttaaggaccgtacccgttaaggaaacgttactttaccgtacggtaccgtttaagtttttacttaccgttcgttaccgaagcccgtaggtaccgtaacgacccgtaaccggttcggtaccccttcttacccgttaccggtttcggggaaccgggtaacgggaaccgtaaggggtcggtaacgtaacgtaaccgaaaacggttacgtcgggtacgccgtacggtaaccaccgttaacgtcgtttacgttacccg

SEQ ID NO: 73500 - DNA, 532 bp, Homo sapiens
  misc_feature: GYAE6OF01C9I5F.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcataccaacgacgggccacgtggcactcccagccaggttcagtgcagtgggtctgtgacagacttcactctcaccatcagcacgccctaagacgcctaggaatattctgactagttttatacgtgtacagcagtcgtagcaacgtcgcctctctacgtttcgggcggtaacgggaccgaagggtgaagtacgtacaaacggactggtagcttcgacacctactctcgttacc

SEQ ID NO: 73501 - DNA, 649 bp, Homo sapiens
  misc_feature: GYAE6OF01C7BHP.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctcccggccaccctgtctttgtctccgaggggacagtcgcccaccctctcctgcgagggccagtcagagtgttagtagtcttcttagcctggtaccaacgaagaaaccgtggccaagggcctcccgaggcctcctcattcctatgatcgacactccgaacgacgggccacgtggccactcccgagccaggttcgagtcggcaggtcgggtctgtgacagtccttcgactcctcacatcagcacgaccttagacgtacctagaacgtacttcgtagtctttaagttttaacttacgtcgttacgacgtacgtacggtacgtaacgacccgtaacgttcggtacccttcttccgtttaaccgggtttccggggaacgggtaaccggggtaacccgtaaggggttacggaacgtaaacgtaaccgggaaaacggttcggttagggtacggccttacggacctaccgtattccgttcgtttacccg

SEQ ID NO: 73502 - DNA, 577 bp, Homo sapiens
  misc_feature: GYAE6OF01DXTLS.49.46.E02.1.454.CMB.1.raw
  modified_base (291)..(291): a, c, t, g, unknown or other
  misc_feature (291)..(291): n is a, c, g, or t
  modified_base (385)..(385): a, c, t, g, unknown or other
  misc_feature (385)..(385): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagcttcttagcctggtaaccaacagaaacctggccaggctccgaggctccnatctatgatgcatccaacgagggccacgtggcactcccagcccaggttcaggtggctaggtgggtctgtagacagtacttcactctacacctancagcacgcctagacgcctagaagtcttctagacttagttttacttactgtcagcgtagtacgtacgacaacgtcggtaccttccgttacgtaccggtttccgggacgggtacgggtaaccgtaagggtagggaacgtacgtaacgaaacggtacgtggtacggtcgtacgacctactacttcgttgttaccg

SEQ ID NO: 73503 - DNA, 727 bp, Homo sapiens
  misc_feature: GYAE6OF01DH3LG.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctccagataccaccggagaaattgtgttgacacagtctccggccaccctgtctttgtctccgaggggacagtcgccaccctctcctgcgagggccagtcagagtgttagtagcttcttagcctaggtaccaactagaaacctggccaggcctcccgaggcctcctcatctatgatcgcactccaaacgcggcccaacgtcggccacgtccccagcccgtaaggtttccaaggtcgggacgtagggttcggggtctggtcgaacgtacgtacctttccaacctttcctaccaaccccgtatacccgaacggacccaacggtacccgttaacggacgtacccggttaagtaacgttactttaccgtagtacctttaagtttttacttacgttcgtacgagacgtacggtacgttaacggacctaaccggttccggtacccttaccgttaccggttacccggtttaccggggaccggggttaacgggtaacccggtaaggggtacgggtaaacggtaaccggttaacgaaaacccgggtacggttacgggtcggttacccgtacgaaccctaccgtacgtttccgttccgtttacccg

SEQ ID NO: 73504 - DNA, 559 bp, Homo sapiens
  misc_feature: GYAE6OF01A46AW.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggcctcccaggcctcctcatctatgatgcatccaacagggccacgtggccactcccagcctaggttcaggtggcaggtggtctgtgacagtacttcactctcaccatcagcacgcctagacgcctagaacgtattctgtactagttttactctgtcagcagtcgtagacgactcggtcccttctctacgttcgggacgggtacgggacgtaagggtggaacgtacgtaacgaaacggtacgtacggtcggtaccgtacgacctaacctagttcgttcgttaccc

SEQ ID NO: 73505 - DNA, 526 bp, Homo sapiens
  misc_feature: GYAE6OF01BB9RA.49.46.E02.1.454.CMB.1.raw
  modified_base (309)..(309): a, c, t, g, unknown or other
  misc_feature (309)..(309): n is a, c, g, or t
  modified_base (352)..(352): a, c, t, g, unknown or other
  misc_feature (352)..(352): n is a, c, g, or t
  modified_base (376)..(376): a, c, t, g, unknown or other
  misc_feature (376)..(376): n is a, c, g, or t
  modified_base (396)..(396): a, c, t, g, unknown or other
  misc_feature (396)..(396): n is a, c, g, or t
  modified_base (516)..(516): a, c, t, g, unknown or other
  misc_feature (516)..(516): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtggcagtgggtctgngacagacttcactctcaccatcancagcctagacgctagaagtnttctgacttagtttattactgtcagtcagcggtagactaacgtcgtccttctctaccgtttcgggacgggacggaccgaagggtggagtagtacgaaacggacgtcgtggctacgcaacntcgtgttacc

SEQ ID NO: 73506 - DNA, 632 bp, Homo sapiens
  misc_feature: GYAE6OF01EO6CH.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcataccaacgcggccagtggacactcccagccaggttcaggtgcaggtgggtctgtgacgagtacttcacgtctaccacctatcgagcacgtcctaagacgtccctaggtaaactacttcgtacgtacgtttaagttttaacgtttacgtacggtacacgtccgtaagggtacgtaacgaacctaaccggttcggtaccccttacgttaccttaccggtttaccggggaccggggtaacggggtaacccgtaagggtacgggaacgtaaccgtaacggaaaaccggtacggtaggtacgggcttacggaccaaccgtacttcgtgttacccg

SEQ ID NO: 73507 - DNA, 672 bp, Homo sapiens
  misc_feature: GYAE6OF01A0UNF.49.46.E02.1.454.CMB.1.raw
  modified_base (201)..(201): a, c, t, g, unknown or other
  misc_feature (201)..(201): n is a, c, g, or t
  modified_base (205)..(205): a, c, t, g, unknown or other
  misc_feature (205)..(205): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtcctcggaggacngtcnccctcctcctctgcgcggctagtcagtgttgttagtagtcttactcgcgtacgtaacaagaacgtaacgtcgacgacggtccctaccgacgtcccttcctactacttacttagtagtagtcgactacctacccaaacggccgggaccctacggtcggacctaccccgtacccgaccgtaccggttacggttaccgagggtcggacgtgggttcggtcgtggtacacgacgttaccttacgtacctcctaccaactactacgacgcgaccgtaccgtaagccgtacgtaaggaacttcttacgtcgtacgtttaagtttactacgttgtacgtacgacgtacgtcgtaacgactacggtccgtccttcgtacctttcgggtacgggacgggtaccggtaacggtgggtacgtacgtacgtaaacgaacggtgttcgggactcgtacgacctacgtctcgttcgttacc

SEQ ID NO: 73508 - DNA, 545 bp, Homo sapiens
  misc_feature: GYAE6OF01BCDOA.49.46.E02.1.454.CMB.1.raw
  modified_base (405)..(405): a, c, t, g, unknown or other
  misc_feature (405)..(405): n is a, c, g, or t
  modified_base (534)..(534): a, c, t, g, unknown or other
  misc_feature (534)..(534): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccaggggacagtgccaccctctcctgcagggccagtcagagtgttagtagcttcttagcctggtaccaacagaaacctggccaggctccaggctcctcatctatgatgcatccaacagggccacgtggcactcccagccaggttcagtggcagtgggtctggtgactagtacttcgactctcacctatcagcagcctagacgtcctagaaacgtnttctgctaagttttacttactgtacagtcagcgtagacaacgtcggtcccttctacgtacgtttcgggcggtacgggaccgtaaagggtggaagacgtacaaacggtactggtacggctcgacctaccncttcgtgttcc

SEQ ID NO: 73509 - DNA, 635 bp, Homo sapiens
  misc_feature: GYAE6OF01CF540.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccacctgtcttgtctccagggacagtgccaccctctcctgcagggccagtcagagtgttagtagcttcttagcctggtaccaacagaaacctggccaggctccaggcctcctcatctatgatgacatcccaaacgacgggcccaacgtcggaccaactccccgagtcccctaagggtttccaggttcggcgtaggtgggtctggtcgacagtacttcacctctaccaccatcacgtcagcctaagcgtacctagaacgtacttccgtgtaccttaagttttactaacgtgtacagcgtaagcgtaagaccgtacgtcggtcccttcgttacgtaccggtttccgggacgggtacgggtaaccctaggggtacggaacgtaacgtaaaccgaaaccggtaacgttcggggtacggttacccgtacggaaccctaacccgtactttccggtcgttttaaccccg

SEQ ID NO: 73510 - DNA, 534 bp, Homo sapiens
  misc_feature: GYAE6OF01BZZS9.49.46.E02.1.454.CMB.1.raw
  modified_base (312)..(312): a, c, t, g, unknown or other
  misc_feature (312)..(312): n is a, c, g, or t
  modified_base (407)..(407): a, c, t, g, unknown or other
  misc_feature (407)..(407): n is a, c, g, or t
  modified_base (525)..(525): a, c, t, g, unknown or other
  misc_feature (525)..(525): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctcatctatgatgcatccaaacgngggccactggcactcccagccaggttcagtggcaggtgggtctggtgacagtcttcactctcaccatcagcagcctagacgcctagaagtattcngtactagtttactactgtcagcagcgtagacctaacgtcggcccttctcgtacggtttcgggcggtacgggaccaagggtgaagtactacgaaacgtactggtacggctcgcctaacnttctgttcc

SEQ ID NO: 73511 - DNA, 566 bp, Homo sapiens
  misc_feature: GYAE6OF01EBFNK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccaccctctcctgcagggccagtcagagtgttagtagcttcttagcctggtaaccaacagaaacctggccaggcctcccaggctcctcatctatgatgcatccaaacgacgggccacgtggcactcccagccaggttcagtggcaggtgggtctggtgacagtacttcactctacacatcagcagcctagacgccgtagaagtactttcgtgtacttagttttattacgtgtacagtcagtcgtacgacgtaacgtcggtacccttctcctacgtttcgggacgggtacgggaaccgtagggacggtagtaacgtaacgaaacggtacgtaggtcggactcggaccacctattcgtgttaccc

SEQ ID NO: 73512 - DNA, 576 bp, Homo sapiens
  misc_feature: GYAE6OF01DMYBW.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcagggccagtcagagtgttagtagcttcttagcctaggtaccaacagaaacctggccaggctcccaggctcctcatctatgatgcatccaacgcgggccacgtggcatcccagcctaggttcagtcggcaggtggtctggtgacagtacttcactctacacatcagcagcctaagcgacctagaacgtattcgtgacttagttttaactacgtgtacagtcagtcgtagcaacgtcggccttctcgtacgttcgggacggtacgggaaccgtaagggtcggaacgtaactaacgaaaaccggtaacgttacggttacggacttacggaacccaccgtacgttccgttcggttaccc

SEQ ID NO: 73513 - DNA, 560 bp, Homo sapiens
  misc_feature: GYAE6OF01BU45W.49.46.E02.1.454.CMB.1.raw
  modified_base (412)..(412): a, c, t, g, unknown or other
  misc_feature (412)..(412): n is a, c, g, or t
  modified_base (545)..(545): a, c, t, g, unknown or other
  misc_feature (545)..(545): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcataccaacgacgggccacgtcggcactccccagccaggttcaggtggcaggtggtctgtgacagtacttcactctcaccatcacgcagcctagacgcctagaagtacttcngtctaagtttacttacgtgtactagctagtcgtaagacgaacgtcgccttctcctacgtttccggacggtacgggacgtaagggtaggacgtacgtacgaaacggtacgtaggtcggtacgtcgacctaaccncttcgtcgttacccg

SEQ ID NO: 73514 - DNA, 625 bp, Homo sapiens
  misc_feature: GYAE6OF01DUW73.49.46.E02.1.454.CMB.1.raw
  modified_base (424)..(424): a, c, t, g, unknown or other
  misc_feature (424)..(424): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgttctttgtctccgaggggacagtcgcccaccctctcctgcagggccagtcagagtgttagtagcttcttagcctggtaaccaacgagaaacctggaccaggcctcccgaggtcctcctcatctatgatgcactccaacgcgggccacgtggacactcccagcctaggtcaggtcggctaggtcggtctgtagactagtacttcactctacactatcacgcacgactagacgctaaggaactnttctagtacttaagttttataccgtgtaccgtagtacgtaacgtacgtaacgtaccgtaacgttccgggtaccttcgttaccgttaccggtttaccggggacggggtaacgggaaccgtaaggggtaaggtaacgtaacgtaaccggaaaacggtacgttgggtaaccgtcgtacgacctaacgtacttcggtcttacccg

SEQ ID NO: 73515 - DNA, 573 bp, Homo sapiens
  misc_feature: GYAE6OF01D3QZU.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctcatctatgatgcatccaacgacgggccacgtggccactcccagccaggttcaggtggcaggtgggtctgtgacagtcttcactctcaccatcagcagcctagcgcctagaagtattctgactagttttacttacgtgtaccaacgacgtcctaacacgtaggtactttccgtacgtttcccggcccgttagggacctaggtacgtaggaacttaacgtaccgaaaacggtacgttggtcggaccttacgaccctaccgtacttcgttacgttccttctaaccg

SEQ ID NO: 73516 - DNA, 548 bp, Homo sapiens
  misc_feature: GYAE6OF01D5D7H.49.46.E02.1.454.CMB.1.raw
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (406)..(406): a, c, t, g, unknown or other
  misc_feature (406)..(406): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgacgggccacgtggcactcccagccaggttcagtggcaggtgggtctgtgacagtacttcactctcaccatcagcagcctagacncctagaagnttcngtctagttttatactgtcagcagtcgtagacaacgtcggccttctctacgtttccgggacgggtaacgggaccgtaaagggtgggaagtacgtacgaaaacggtacgtagggtcgcgtacggaccacctattcgtgttaccg

SEQ ID NO: 73517 - DNA, 569 bp, Homo sapiens
  misc_feature: GYAE6OF01B5O8A.49.46.E02.1.454.CMB.1.raw
  modified_base (375)..(375): a, c, t, g, unknown or other
  misc_feature (375)..(375): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggctcccaggctcctcatctatgatgcatcccaacgacgggccacgtggcactcccagccaggttcaggtggcaggtggtctgtgacagtacttcactcncaccatcagcagcctagacgtcctagaagtctttcgtgtactagttttaactacgttgtacagcagtcgtaacgactaacgttcggtcccttctacgtaccgtttcgggaccgggtaacgggaccgaagggtaggaacgtacgtaacgaaacggtacgttggtacggctacgacctacctacttcgtcgttacc

SEQ ID NO: 73518 - DNA, 534 bp, Homo sapiens
  misc_feature: GYAE6OF01CWZ9C.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagatacccaccggagaaattgtgttgacacagtctccggccaccctgtctttgtctccaggggacagtcgcccaccctctcctgcagggccagtcagagtgttagtagcttcttagcctggtaccaacagaaacctggccaggcctcccaggcctcctcatctatgatgcatccaacgacgggccacgtggcactccccagccaggttcaggtggcaggtgggtctgtgacagacttcactctcaccatcagcacgcctagacgcctagaagtattctgtactagtttacttactgtacagcagtcgtagactaacgtcgtcctctctacgtttcggcggacgggaccgaagggtgagacgtacgaaacgtacgtgtggctcgacactactctgttcc

SEQ ID NO: 73519 - DNA, 576 bp, Homo sapiens
  misc_feature: GYAE6OF01AR1OR.49.46.E02.1.454.CMB.1.raw
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagagcttcttagcctggtaccaacagaaacctggccaggcctcccgaggcctcctcatctatgatgcatccaacgcgggccactggccagtcccagccaggttcagtggcaggtggtctgtgacagtacttcacgtctcacctatcagcacgctagctcgtagaagtnttcgngacgttagtttatacgtgactagcagtacgtagacctacgtcggtacccttacgtcgtacggtttccgggacgggaacgtaccgtaaggggttacggaacgtaacgtaccgaaaaaggtccgtaggtcggaccgttaggacccaccgttattccgttaggttaccc

SEQ ID NO: 73520 - DNA, 599 bp, Homo sapiens
  misc_feature: GYAE6OF01DI3J8.49.46.E02.1.454.CMB.1.raw
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcttagcctggtaccaacagaaacctggaccaggctcccaggcctcctcatctatgatgcatccaacncgggccactggcatccccagccaggttcaggtgcaggtgggtctgtgacagtacttcactctccacctatccagccagccctaagcgcctagaagtactttcgtgtacttagttttaacttacgtcgttacagtaccgaggtcgttaacgactaacggtcggtccctcgttcgtaaccggtttcggggacgggtaacggtaccgaaggggttcggaagtaacgtaccgaaaaccggttaacgtcgggtacggtccgtacgggaccctaccgtaattcccgttggttccc

SEQ ID NO: 73521 - DNA, 558 bp, Homo sapiens
  misc_feature: GYAE6OF01BNCG1.49.46.E02.1.454.CMB.1.raw
  modified_base (358)..(358): a, c, t, g, unknown or other
  misc_feature (358)..(358): n is a, c, g, or t
  modified_base (361)..(361): a, c, t, g, unknown or other
  misc_feature (361)..(361): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcttagcctggtaccaacagaaacctggccaggcctccaggcctcctcatctatgatgcatccaacgagggccacgtggcatcccagcctaggttcagtggctaggtgggtctgtnacngtactcactctacaccatcagcagacctagacgtcctagaagtacttcagcttagtttattacgtgtcagtcaaggtcgtacgacaacgtgcccttcgtcctacgtttccgggacgggtaacggaaccgtagggtacggagtactaacgaaacgtacgttgacgggtactcgacctaccgtcgttcgttcggttacc

SEQ ID NO: 73522 - DNA, 748 bp, Homo sapiens
  misc_feature: GYAE6OF01AN3BZ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgcccaccctctcctgcagggccagtcagagtgttagtagcttcttagcctggtaaccaacagaaacctggccaggcctcccgaggcctccgtcatctatgatgcactcccaaacgacgggccctacgtcgggacctacgtccccaacggtcccgtacgggtttaccgaaggttcggggaccgtaaggggttcggggttccttggttacggaaccgtaacgggtacctttacccgaacctttccttaccaacccgtacttaccgaacggccctaacggtacccgtaacggaacgtcccgttaaggaaacgttacgtttaccgtacgtacgtttaagttttacgtttaaccgtcgttacaacggtacctaaggtccgttaacgaaccctaacgtccggtacccttccgttaccgttacgggtttccggaccggggtacgggtaacccggtagggtacgggaacggtaaccgttaaccggaaaaccggttacggttacgggtacggtaccgttacggacctaacccgtcgtttccgtcgtttacccg

SEQ ID NO: 73523 - DNA, 745 bp, Homo sapiens
  misc_feature: GYAE6OF01C62AE.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctaggtaccaacagaaaccctgggacccaaggcctccccgaggtcctacctcatctatgatgcatcccaaacgcgggaccacgtggacctacgtccccagcccgtaaggtttccaggttggcctagggttcgggtactggttacgaactacggtaccttcacgtttcctacaaccctagtaccacggtacctaacggacccttaaggaccgtacccggttagaaacggttaacttttccgtacggtccgtttaaggtttttaacttaacgtctacgtacggtccgacgttacggttaacgtacccgtaaacggtttccgggtacccttaccgttacccgttacccgggtttttcggggaacccgggttaaccggggtaacccgtaaagggggttaccggaaacggttaaccgttaacccgggtaaaaacggtaccggtttacggtaaccgggtccttaacggaccccgtaaccttacgttccgttcggtttaccc

SEQ ID NO: 73524 - DNA, 526 bp, Homo sapiens
  misc_feature: GYAE6OF01A4KEE.49.46.E02.1.454.CMB.1.raw
  modified_base (414)..(414): a, c, t, g, unknown or other
  misc_feature (414)..(414): n is a, c, g, or t
  modified_base (519)..(519): a, c, t, g, unknown or other
  misc_feature (519)..(519): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaacctggccaggctcccaggctcctcatctatgatgcatccaaacgacgggccacgtggacactccccagcctaggttcaggtcggcaggtcgggtctgtgactagtacttcacttctcacctatcagcacgcctagacgcctagaacgtnttctgctagttttactacgtgtcagctagcgtagacacgtcgccttctctacgttcggcggtagggaccagggtgagtactacgaaacgcgtgtcgctcgacacntcgtgtc

SEQ ID NO: 73525 - DNA, 591 bp, Homo sapiens
  misc_feature: GYAE6OF01D7HSV.49.46.E02.1.454.CMB.1.raw
  modified_base (262)..(262): a, c, t, g, unknown or other
  misc_feature (262)..(262): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagctttctagcctggtaccaanagaaacctggaccaggcctcccaggcctcctcatctatgatgcactaccaacgacgggccacgtggaccactccccgaagcccgtaaggtttcaggtgggcctaggttcgggtctggtcgacgagtacttcactcctacaccatcagacacgacctagacgtcctagaagtattctagtacttagttttacttacttgtacgagtctagtacgtacgacgtaacgtcggtccttctaccgtacgtttccgggacggtaccgggacgtagggtacgaagtacgtaacgaaacggtacgtggtcggcgtacgacactacgttcgtgttacc

SEQ ID NO: 73526 - DNA, 660 bp, Homo sapiens
  misc_feature: GYAE6OF01DA81Y.49.46.E02.1.454.CMB.1.raw
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
  modified_base (461)..(461): a, c, t, g, unknown or other
  misc_feature (461)..(461): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtcttgtctccgaggggacagtcgccacctctcctgcagggccagtcagagttgttaagtgtcttcttagcctaggtaaccaacgagtaaacctggaccacgggcctcccgaggtccctcctactattctatggactcgactactacccgaacgacgggcccacgtcggacctactcccgagcccgtagggttccaggtcggctagggtgggtctggtgaactcgtacttcaccgtctacacatcgaacncgaacgtccctaggacncgttagaaacgttnttcgtgtactttaagtttcttacgtgtacagacgtacggacgttacgactaccgtcgtaccttcgttaccgttacggttccgggggaaccgggtaagggtacccggtaaaggggtcgggtaacgtaaaccggtaaccgaaaacggttcgttagggttccggaccgtcgaaccctacgttacgttccgtacggtttaccc

SEQ ID NO: 73527 - DNA, 580 bp, Homo sapiens
  misc_feature: GYAE6OF01COSZ7.49.46.E02.1.454.CMB.1.raw
  modified_base (421)..(421): a, c, t, g, unknown or other
  misc_feature (421)..(421): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggaccaggctcccaggctcctcatctatgatgcatccaaacgacgggcccacgtggaccactccccaagcccaaggtttcaaggtcggcaggtgggtctggtgacagacttcactctcaccatcagcacgcctagacgcctagaagtattcngtactagtttattactgtcagcagcgtaagcaacgtcggccttctcgtacgtttcgggacggtaacgggtaccgaagggttcggaacgtacgtacgaaaaccggtacgtacgggttacggaccgttacggacctaaccgtacttccgttaggtttaccc

SEQ ID NO: 73528 - DNA, 631 bp, Homo sapiens
  misc_feature: GYAE6OF01BGCUR.49.46.E02.1.454.CMB.1.raw
  modified_base (382)..(382): a, c, t, g, unknown or other
  misc_feature (382)..(382): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttggtctccgagggacagtcgcccaccctctcctgcagggccagtcagtagttgttagtagtctttcttagccttggtaccaacagaaacctggccaggcctcccaggcctcctcattcctatgatgcataccgaacgacgggcccaacgtggaccactcccgacgccgtaggttcgaggtcggcgtaggtcgggtntggtgactagtactccactctacacctatcagcacgacctagacgtcgtagaagttcttacgtcgtacttagtttactacgttcgtactaaggtctaggtacgtacgacctaacggtcgtacccttctcgttaaccgggttccggaccgggtaaggtaccggtaaagggtcggtaacgtaacgttaaccggaaacggtacgttcgggtacggtaccgtacggaccctaacgttcttcgtcgtttacccg

SEQ ID NO: 73529 - DNA, 515 bp, Homo sapiens
  misc_feature: GYAE6OF01AXMJO.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcacgcctagacgcctagaagtattctgctagtttattactgtcagcagcgtagacacgtcgcctctctacgtttcggcggacgggaccgaagggtggagtagtacaaacggtacgtgtggctcgacaccatcgtgttcc

SEQ ID NO: 73530 - DNA, 592 bp, Homo sapiens
  misc_feature: GYAE6OF01BX4NS.49.46.E02.1.454.CMB.1.raw
  modified_base (406)..(406): a, c, t, g, unknown or other
  misc_feature (406)..(406): n is a, c, g, or t
  modified_base (578)..(578): a, c, t, g, unknown or other
  misc_feature (578)..(578): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagcttcttagcctggtaccaacagaaacctggccaggctcccaggctcctcatctatgatgcatccaacgcgggccacgtggcactcccagccaggttcagtggcaggtgggtctgtgacagtacttcactctacaccatcagcacgcctagacgcctagaacgtnttcgtgtacttagttttaacttacgttcgtacgagtcgagtcgtacgactaacgtcggtacccttccgttaccgttaccgtttccggggaccggtacgggtaaccgtaaggggtacggaacggtaacgtaaccgaaaacggtacgttggtacggtacgtacggaccaacctnttccgtgtttaccc

SEQ ID NO: 73531 - DNA, 549 bp, Homo sapiens
  misc_feature: GYAE6OF01A6HXB.49.46.E02.1.454.CMB.1.raw
  modified_base (309)..(309): a, c, t, g, unknown or other
  misc_feature (309)..(309): n is a, c, g, or t
  modified_base (399)..(399): a, c, t, g, unknown or other
  misc_feature (399)..(399): n is a, c, g, or t
  modified_base (495)..(495): a, c, t, g, unknown or other
  misc_feature (495)..(495): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccagttcagtggcaggtgggtctgtgacagacttcgactctcaccatcagcagtcctagacgcctagaagtnttcgtgctaagtttacttacgtgtccagcagacgtaacgaccaaacgttcgggccccttgtacctacgtttcgggacgggtacgggacctaagggnggagaacgttacgaaaacgtactggtaggcttcggactaaccattcgtcgttcc

SEQ ID NO: 73532 - DNA, 512 bp, Homo sapiens
  misc_feature: GYAE6OF01DR2NX.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacacgggccactggcactcccagccaggttcagtggcaggtggtctgtgacagacttcactctcaccatcagcagcctagacgcctagaagtattctgtctagttttattactgtcagcagcgtagcaactggccttctctacgtttcgggcggtaacgggacgagggtggagactacgaaacgactgtgctgacacatctgtacc

SEQ ID NO: 73533 - DNA, 639 bp, Homo sapiens
  misc_feature: GYAE6OF01CGBK3.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtgcccaccctctcctgcagggccagtcagagtgttagtagcttcttagcctaggtaccaacagaaacctggccaggcctcccaggcctcctcatctatgatcgcactccaacgacgggcccacgtggcctactccccgagtccctaggtttcaggttcggctaggtgggtctaggtcgacgtacggtaccttcaccgttcctaccgaacctacgtcacgaccacgacccgttaagacgtccgtagaacgtattcgtagtacttagtttacttacgtgtactacgcgtacgtcgtacgactacgtcggtcctaccgttacgttaccgtttccgggaacgggtacgggtaaccggtaagggtacggaacgtaacgtaaccggaaaacggtcgtacggtacggacgtacgacccttaaccgtacttcgttccgtttaccg

SEQ ID NO: 73534 - DNA, 561 bp, Homo sapiens
  misc_feature: GYAE6OF01CXT9L.49.46.E02.1.454.CMB.1.raw
  modified_base (387)..(387): a, c, t, g, unknown or other
  misc_feature (387)..(387): n is a, c, g, or t
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (447)..(447): a, c, t, g, unknown or other
  misc_feature (447)..(447): n is a, c, g, or t
  modified_base (462)..(462): a, c, t, g, unknown or other
  misc_feature (462)..(462): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtctccgaggggacagtcgcccaccctctcctgcagggccagtcagagtgttagtagcttcttagcctaggtaccaacagaaacctggccaggctcccaggctcctcatctatgatgcatccaagacggccactggacactcccagccaggttcagtcggctaggtggtctggtgacgtagacttcacctctcaactatcngtcacgctagacgcctagaagtatttcgngtctaagtttnttacngttcagtcagcgtanacctacgtggtcctntacgttacgttccggacgggaggtaaccgagggtgaaggtcctaagaaaccggtattgggtaacgcgttaaccggacttaacccgattcgttcgtaccg

SEQ ID NO: 73535 - DNA, 526 bp, Homo sapiens
  misc_feature: GYAE6OF01D47TT.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgacgggccactggcatcccagccaggttcagtgcagtgggtctgtgacagtacttcactctcaccatcagcagcctagacgcctagaagtattctgtctagtttacttactgtacagcagcgtagactacgtcggcctctcgtactttcgggcgggtacgggaccgaaggtggaagacgtacgaaacggtactggtggctcgacacctattcgtgtcc

SEQ ID NO: 73536 - DNA, 552 bp, Homo sapiens
  misc_feature: GYAE6OF01A4D18.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtctccaggggacagtgccaccctctcctgcagggccagtcagagtgttagtagcttcttagcctggtaccaacagaaacctggccaggctcccaggctcctcatctatgatgcatccaacagggccactggcactcccagccaggttcagtggcagtgggtctgtgacagaccttcactctcaaccatcagcacgcctagacgtcctagaaacgtattctgactagtttattactgtcagcaggcgtagcaacgtgtaccttctactaccgtttcgggacggtacgggaccgaaagggtggaagtacgtaacgaaaccggtaacgtcggttacggacctggacccacctacgttcgttcgttacc

SEQ ID NO: 73537 - DNA, 585 bp, Homo sapiens
  misc_feature: GYAE6OF01EFVHJ.49.46.E02.1.454.CMB.1.raw
  modified_base (341)..(341): a, c, t, g, unknown or other
  misc_feature (341)..(341): n is a, c, g, or t
  modified_base (433)..(433): a, c, t, g, unknown or other
  misc_feature (433)..(433): n is a, c, g, or t
  modified_base (573)..(573): a, c, t, g, unknown or other
  misc_feature (573)..(573): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaaccaacagaaacctggccaggctcccaggctcctcatctatgatgcactaccgaacacgggccaacgtggacactccccagcccnggtttacaggtcggcaggtcggggtctggtacgacgagtacttcactcctacaacctatcaaggtccaacgtcctagacgcctaggaaactntttctacgtctaagttttaattacctgtcagtcagtcgtacgactaacgttcgacccttcgtactacgttcggacggtaaggaccgtaaagggtggaagtacgtaacgaaacggtacttgggacgtctcggaccaacctnttccgtgttacc

SEQ ID NO: 73538 - DNA, 576 bp, Homo sapiens
  misc_feature: GYAE6OF01CQFY8.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagagtgttagtagcttcttagcctggtaccaacagaacctggaccaggctccaggcctcctcatctatgatgcatccaacagggcctacgtggctactcccagccaggttccaggtcggactagggtcgggtctggtagacgagtcttctacgtcctacactatcacgtacagcctaagcgcctagaacgtattcgagtctagttttactcgtgttcagtcagtaccgtagactaacgttcggccttacgtctacggttcgggacggaaggtaacccgaggggttagacgttaacgaccgtaaacgtcgtggtaggacctcggaccacgtacttcgttcgtttacc

SEQ ID NO: 73539 - DNA, 563 bp, Homo sapiens
  misc_feature: GYAE6OF01AHPW9.49.46.E02.1.454.CMB.1.raw
  modified_base (549)..(549): a, c, t, g, unknown or other
  misc_feature (549)..(549): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccacgtggcatcccagccaggttcagtggcaggtgggtctgtgacagacttcactctcaccatcagcagcctagacgcctagaagtattcgtagcttagttttaatacgtgtcagtacaggtcgtacgactaacgtcggtacccttctccgtaacgtttccgggacgggtacgggaccgtaaggggtacggaaggtacgtaaccgaaacgtacgttggtcgggactcgaccaacctnttccgttgttaccc

SEQ ID NO: 73540 - DNA, 565 bp, Homo sapiens
  misc_feature: GYAE6OF01B4C99.49.46.E02.1.454.CMB.1.raw
  modified_base (552)..(552): a, c, t, g, unknown or other
  misc_feature (552)..(552): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgcccaccctctcctgcagggccagtcagagtgttagtagcttcttagcctggtaccaacagaaacctggccaggcctcccgaggcctcctcatctatgatgcactccaacgagggccacgtggccagtccccagcctaggttcaggtggcaggtgggtctggtgacagtacttcactctcaccatcagcagcctagacgcgtagaagtcttctgtactaggtttattacgttgtactacgcgtagacgtagactacgtcggtcctctcgtacgttcgggacggtacgggacgtagggtggaacgacgtaacgaaacggtacgttcgggtacgtcgtcgacctaccgtnttccgtcgttccg

SEQ ID NO: 73541 - DNA, 797 bp, Homo sapiens
  misc_feature: GYAE6OF01EDGG2.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaattgtgttgacacagtctccggccaccctgtctttgtctccgaggggacagtcgccaccctctcctgcagggccagtcagagtgttagtagcttcttagcctcggtaaccaacacgaaacctggccaggcctcccgaggtcctcctcactctatgatgctactccgaacgcgggaccacgtcggactactcccagcctaggttcaggtggaccgtaggttcggggtacttggtacgtaaccgtaacggttacccttaccgtaacctttcccgtaccccgtaaaccctacgttacccgaacggtacccgtaaccgggtacccgttaacggtaacccggttacccgttaaagggtaaaccggttacttttacggtaccggttaaccgtttaaggttttttaaccttaccggttacgttaaccgtacggttaccgtaacgggtacggttaacgtaacccgttaaccggtccggttacccctttaccgttcccggtttaaccggtttaccgggggaacggtaaacccggggtaaccggtaacgggtacggggtaaacgttaaccggttaaaccggaaaaccggttacgggtacggttaccggtacccggtaccggtacctaacccgttacggttcccttcggtttaccccg

SEQ ID NO: 73542 - DNA, 720 bp, Homo sapiens
  misc_feature: GYAE6OF01EJHJ1.49.46.E02.1.454.CMB.1.raw
  modified_base (220)..(220): a, c, t, g, unknown or other
  misc_feature (220)..(220): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacccttgtctttgtctccgaggggacagtcgcccaccctctccngcacgggccagtcagtagtgttagtagtcttcttagcctaggtaaccaatacgaaacctggaccaaggcctcccgaggcctcctcattctatggatgacctactacccgaaacgacgggcccacgtcggacctactccccgagccctaagggttccaggtcggactagggttcgggtacttcggagaccgtacggtaccttctaaccttccgtaccaaccctattacccgagtacctacgacccttaggaccgtcccgtaagtaaacggtactttacgtacgtacgtttaacgtttaactttacgtgttaccgtaggtaccgtaggtaccggttaagaacccgtaacgttccgggtaccctttaccgttaccgtaaccggttttcgggaccgggtaaacggggtaacccgtaagggtacggaacggtacgttaaccggaaaacggtaccggtgggtaaccgtcgtaccggtaccaaaccggttctttccgtcgtttaccc

SEQ ID NO: 73543 - DNA, 548 bp, Homo sapiens
  misc_feature: GYAE6OF01CL4GB.49.46.E02.1.454.CMB.1.raw
  modified_base (400)..(400): a, c, t, g, unknown or other
  misc_feature (400)..(400): n is a, c, g, or t
tcagagtcgagagacacgaccggtgctcgatttagactcatctacagggaaaggggtaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcatccaacgagggccacgtgcatcccagccaggttcagtgcaggtgggtctgtgacagactttcactctcaccatcagcagcctagacgcctagaagtnttcgtgtctagttttatacgtgtacagcagcgtagactacgtcggcctctcgtacgtttcggacggacggtaccgaagggtcggaagtacgtaccgaaaacggtacgttggtcggtacctcggacctaccgtattccgttcggttacc

SEQ ID NO: 73544 - DNA, 528 bp, Homo sapiens
  misc_feature: GYAE6OF01EYTY1.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagctttctagcctggtaccaacagaaacctggccaggctcccaggctcctcatctatgatgcatccaacagggccactggcatcccagccaggttcagtggcagtgggtctgtgacagacttcactctcaccatcagcagcctagagccctagaagtattctgctagtttattactgtcagtcagcgtagactaactggcctctctacgtttcgggcggagggaccgaagggtggagtactacgaaacgtaccgtggtcggcttacgccaaccctcgttcgtcgttacc

SEQ ID NO: 73545 - DNA, 660 bp, Homo sapiens
  misc_feature: GYAE6OF01BZ7M5.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccagggacagtgccaccctctcctgcagggccagtcagagtgttagtagcttcttagcctggtaccaaacagaaacctggccaggcctcccaggcctcctcatctatgatgcatccaacgagggccactggcactcccagccagttcagtcggcagtggtctgtgacagtacttcactctacaccatccagcacgacctagcgcctagaagtacttctagtacttaagttttacttacgtcgtcgacgctaacgtcgttaacgacctaacgttccgggtacccttcgttacccgtaacggttttaccggggaccggggtaacgggtaacccgtaaagggggttaccggaaacggtaaccgttaaacccggaaaaccgggttaaaccgttacggggttaccggggtaacccgttaccgggaccccgttaaaccccgtaacggttttacccgtttccgggttttaaccccg

SEQ ID NO: 73546 - DNA, 624 bp, Homo sapiens
  misc_feature: GYAE6OF01E5GE6.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtgcttcttagcctggtaccaacagaaacctggccaggctcccaggctcctcatctatgatgcatccaacagggccactggcactcccagccagttcagtggcagtgggtctgtgacagtactcactctcaccatcagcacgcctagacgcccgtagaagtacttctgtcttaaggttttattaccgtgttaccgaagccgtaagtccggtaagaccgtaaaccgtggtacccttccgtaccttaccggttttccggggaccgggtaacggggtaaccgtaaacggggtagggaacggtaacgttaaacccggaaaacggttaaaccgttcgggttacggtacccgttacggacccgtaaccctaacgtttcccgttcgtttacccg

SEQ ID NO: 73547 - DNA, 654 bp, Homo sapiens
  misc_feature: GYAE6OF01CK9ZD.49.46.E02.1.454.CMB.1.raw
  modified_base (290)..(290): a, c, t, g, unknown or other
  misc_feature (290)..(290): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgagggacagtgccaccctctcctgcagggccagtcagagtgttagtagcttcttagcctggtaccaacagaaacctggccaggcctccaggcctccncattctatgatgcatccaacgacggccactggcactcccagcctaggttcaggtcgcgtaggtcggtactgtagacacgtacttcacctcctacacctatcgagcacgtacctagacgtccgtagaaacgtattcgtacgtacttaagttttacttaccgtgttaccacggtactacgggtcgttaacgtaccgtaaccgttccgggtaccctttaccgttaccgttaaccgggttttcccgggggaaccggggtaaaccggggtacccggtaaaggggtcggtaacgaaccgttaacgaaaaaccggtacggttcggttacggaccgttacgtaaccccacgttacgttccgttgtttaaccc

SEQ ID NO: 73548 - DNA, 568 bp, Homo sapiens
  misc_feature: GYAE6OF01BVYN4.49.46.E02.1.454.CMB.1.raw
  modified_base (361)..(361): a, c, t, g, unknown or other
  misc_feature (361)..(361): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggcctcctcatctatgatgcatccaacgagggccacgtggcactcccagcccagttcagtggcagtgggtctgtgacngactcactctcacatcagcagcctagacgcctagaacgtcttcgtagtactagtttatactgtacagcagcgtagaccgtaactcggtccttacgtcgtaccgtttcgggacggtaacgggaccgtagggtacggaacgtaacgtacgaaaaccggtacgttacgggtacggtacgtacggaccaacctacgttccgttggttaccc

SEQ ID NO: 73549 - DNA, 606 bp, Homo sapiens
  misc_feature: GYAE6OF01A7KAN.49.46.E02.1.454.CMB.1.raw
  modified_base (230)..(231): a, c, t, g, unknown or other
  misc_feature (230)..(231): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccgccacctgtcttgctccagggacagtgcccacctctcctgcaggccagtcagagtgtanncttctagcctgacaanagaactgcagctccagctccnatctanggtncatccacaggccagtgtacnccagcctaggtcaggtgacaggtggtccgngggacagtcgtcacgtcacgaccattcgagtccgagtccctacgcgtacgtcgtacgtaagttacgtttagtacgttaagtttattacgttagttacgtacgtacgtaacgttaagttaacgtttaacgttacggttacgtttaccggtttttcggacccggtacgggtaaccgtaacggtacgttacggtaacgtacgtaccggaacgtaccgtaacggttcggtacggcgtacgaccgacctagttacctcgttacttctacgttccgttaccccg

SEQ ID NO: 73550 - DNA, 656 bp, Homo sapiens
  misc_feature: GYAE6OF01CYVH9.49.46.E02.1.454.CMB.1.raw
  modified_base (505)..(505): a, c, t, g, unknown or other
  misc_feature (505)..(505): n is a, c, g, or t
tcagagtcgagagacacgaccggtgctcgatttagactcatctacaggggaaaggggggaggaactgctcagttaggacccagagggaaccatggaagccccagctcagcttctcttcctcctgctactctggctccagataccaccgagaaattgtgttgacacagtctccggccaccctgtctttgtctccgaggggacagtgcccaccctctcctgcagggccagtcagagtgttagtagtcttcttaagcctaggtaaccaaacaagaaaccctggaccaggcctacccaggcctcctcatctatgatgcatccaaacagggcccaacgtggacactaccccgagccgtaggttccaggtcggcgtaggtcggggttctggtggaacctaggtaccttttcgaaccttcctaccaaacccaattaccaacggccaacggacccttaaggacgaccctaaggtaacgtaactttcgtagtaccttaaggttttacttaacgngttaccgagtacgagtacgtagaactaaccgttcggccttacgtacctacggtttcgggaccgggaagggaaccgtaaacgggtaggaagtaaccgtaagaaaccggtacgttggtacgggtactaccggaacacctatccgttgttaccc

SEQ ID NO: 73551 - DNA, 646 bp, Homo sapiens
  misc_feature: GYAE6OF01BQ425.49.46.E02.1.454.CMB.1.raw
  modified_base (234)..(234): a, c, t, g, unknown or other
  misc_feature (234)..(234): n is a, c, g, or t
  modified_base (323)..(323): a, c, t, g, unknown or other
  misc_feature (323)..(323): n is a, c, g, or t
  modified_base (402)..(402): a, c, t, g, unknown or other
  misc_feature (402)..(402): n is a, c, g, or t
  modified_base (621)..(621): a, c, t, g, unknown or other
  misc_feature (621)..(621): n is a, c, g, or t
  modified_base (632)..(632): a, c, t, g, unknown or other
  misc_feature (632)..(632): n is a, c, g, or t
tcagagtcgagagacacgaccggtgctcgatttagactcatctacagggaaagggggaggaactgctcagttaggacccagagggaaccatggaagcccagctcagccttctcttcctcctgctactctggctcccagataccaccggagaaattgtgttgacacagtctccggccacccttgtctttgtctccgaggggacagtgcccaccctctcctgcagggccagtcagngttgttagagtcttcttagcctaggtaaccaagaacgaaacctggaccaggcctccgaggctcctcatctatgatcgctactccaacgnggcccagtcggcactcccacggccgtaaggttcagtcggacgtaggtgggtctggtacgtacgtacgtactccacttcncctaacctatcgaacgccaagtaccctaggtaccgtccgttaagaaacgttctttcgtacggtaactttaagttttaacgtacgtttcgtaacacgggtactacgggacgttaacgctaacgtcgtccctacgtccgttacggttaccgggaccgggtaacggtaacccgtagggttaaggaccgtagtaaaccggtaacgtacgtggttacgcgtacnccgtaaacgtnttccggtgttaccg

SEQ ID NO: 73552 - DNA, 576 bp, Homo sapiens
  misc_feature: GYAE6OF01E4YV7.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatcatgatgcatccaacgacgggccacgtggcactcccgagcctaggttcagtggcaggtggtctgtgacagtacttcactctcaccatcagcacgctagacgtcctagaagtacttcgtgacttagtttacttacgtgtcagacgagtacgtacgacctaaccgtcgggtcccttacgtacgttaccgtttcggggacgggtacggggaccgtaaagggtcggaagtaactaccgaaaacggtacgtcggtaggcctacgaccaaccctcgttcgtcgttaccc

SEQ ID NO: 73553 - DNA, 673 bp, Homo sapiens
  misc_feature: GYAE6OF01DHSH4.49.46.E02.1.454.CMB.1.raw
  modified_base (261)..(261): a, c, t, g, unknown or other
  misc_feature (261)..(261): n is a, c, g, or t
  modified_base (355)..(355): a, c, t, g, unknown or other
  misc_feature (355)..(355): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagctttcttagcctggtaccaanagaaacctggccaggctcccaggctctcatctatgatgcatccaagacgggccacgtggcactcccagccaggttcagtcggcaggtggtctgngacagtacttcactctacactatcagcagccctaaggacgtaccttaggaacgtattactcgtacttagttttaacttacgtgttacctagccgtaggtcgtaacgtaccgtaaacgttccggggtacccctttccgttaccgttaacccgggtttttcggggaccgggggtaaaacggggtaaccccggtaaaaggggggttcgggtaaacgggtaaaccttaaaccgggaaaaaccggttaaaccggttacgggttaacgggtccgttaccggtaacccgtaaccccgttacgttcccgttttcggtttaaccccc

SEQ ID NO: 73554 - DNA, 760 bp, Homo sapiens
  misc_feature: GYAE6OF01D7PWF.49.46.E02.1.454.CMB.1.raw
  modified_base (134)..(134): a, c, t, g, unknown or other
  misc_feature (134)..(134): n is a, c, g, or t
  modified_base (211)..(211): a, c, t, g, unknown or other
  misc_feature (211)..(211): n is a, c, g, or t
  modified_base (340)..(340): a, c, t, g, unknown or other
  misc_feature (340)..(340): n is a, c, g, or t
tcagagtcgagagacacgaccggtgctcgatttagactcatctacagggaaagggggaggaactgctcagttaggacccagaggaaccatggaagcccagctcagcttctcttcctcctgctactctggctccngataccaccggagaattgtgttgacacagtctccggccaccctgtctttgtctccgagggacagtcgccctaccctntacctgccagggtccagtcagacgttgttagagcttcttagccgttaggaacctaaacgacgaaaaccttcggaccgaggtaccctcccgaaggcctcctcaatccgttatcgattgcacttccaaacngggccagtcggcacctcccgaagtccaaggttccaaggtccgacgtaggttggtccttggtcgaacgtaagtcttccacgtctacacccgtataccagggtccaacgtacccgtacgtacgacccgttacgtaacggtaactttccgttagtaccgttaacgtttttaacgtttaacccgtttaggtttaccgtaacggttaaccgtacggttacccggttaacgggtaacccgtaaaccgtttccggggtacccctttaccgtttacccgttaacccggtttttacccgggaccgggtaaaccggggtaacccggttaaacgggggtaaccggttaacgggtaacgttaacccgtaaaacggtaaccgtacggttacggtacgtacggtaccaaaccgtccgttacgtaccggtttccg

SEQ ID NO: 73555 - DNA, 574 bp, Homo sapiens
  misc_feature: GYAE6OF01BOZ9T.49.46.E02.1.454.CMB.1.raw
  modified_base (415)..(415): a, c, t, g, unknown or other
  misc_feature (415)..(415): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggcctcctcatctatgatgcactaccaacgacgggccacgtggccactcccagcccgtaaggtttccaggtcggcgtagggttggtctggtcgacgtagtacttcactctacaccatcagcacgcctagacncctagagtnttcngcttagtttactactgtacagcaggtcgtaagccgtaacgtcgtcccttctaccgttacgttcgggaccgggtaggtacccgaagggtcggaagtacgtacgaaacggtacgtcggtggcctacggaccacgtcttcgttgttccg

SEQ ID NO: 73556 - DNA, 602 bp, Homo sapiens
  misc_feature: GYAE6OF01B3P4T.49.46.E02.1.454.CMB.1.raw
  modified_base (259)..(259): a, c, t, g, unknown or other
  misc_feature (259)..(259): n is a, c, g, or t
  modified_base (310)..(310): a, c, t, g, unknown or other
  misc_feature (310)..(310): n is a, c, g, or t
  modified_base (416)..(416): a, c, t, g, unknown or other
  misc_feature (416)..(416): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggcaccctgtctttgtctccagggacagtgccaccctctcctgcagggccagtcagagtgttagtagcttcttagcctggtaccaanagaaacctggccaggcctcccaggcctcctcatctatgatgcatccaacgnggccagtggcactcccagccaggttcaggtggcaggtgggtctggtgacagtacttcacttctcaccatcagcacgacctagacgtcctagaaacgtcgtttacgngtccttaaggttttacttaacgttcgtacctagtactaacgggtcgttaacgaaccgtaacgttcgggtcccttacgtacctaccggtttcgggaaccgggtaacgggaacccgtagggtacggaagtacgtaacgaaacggtaacgtggtacggacttcgacctaacctactccgttggttaccc

SEQ ID NO: 73557 - DNA, 663 bp, Homo sapiens
  misc_feature: GYAE6OF01C2YQN.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgcccaccctctcctgcagggccagtcagagtgttagtagctttcttagcctggtaccaacgagaaaccgtggaccaggcctcccgaggcctcctcatactatgatgcaactccaacgacgggaccacgtgggcctaacgtccccagtcccgtaggtttaccgaggtcggactagggttgggtcttggtacggaacagtaccttacaccttctaccaaccatacagaccaacgccgtaagacggaccttagaagtactttacgtgtacttacggttttacttacgtaggtacctagtcgaagtcgtaagaccgtaacgtcgggtacccttaccgttaccgttaacccggtttcggggaccggtaaccggggaacctaaggggttcggaagtaaccgtaacgaaaacggttacgtcgggtaggaccgtacggaaccctacgtacttccggtttcttacccg

SEQ ID NO: 73558 - DNA, 654 bp, Homo sapiens
  misc_feature: GYAE6OF01AX66Y.49.46.E02.1.454.CMB.1.raw
  modified_base (290)..(290): a, c, t, g, unknown or other
  misc_feature (290)..(290): n is a, c, g, or t
  modified_base (443)..(443): a, c, t, g, unknown or other
  misc_feature (443)..(443): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtctccaggggacagtgccacctctcctgcagggccagtcagagtgttagtagcttcttagcctggtaaccaacagaacctggccaggcctccgaggcctcctnatctatgatgacactccaacgagggcccaacgtcggacactcccagcctaggttcaggtggctaggttcgggtctgtacggacaggtaccttcactcctacacactacacgcaacggcccgttaagacgtaccgtaggaacgtactttaccgngtaccttaaggttttacttaccgtaggttaccaggtaccgtaacggtacggttacgaccgtaaccttcggggtacccttcgttaccgttacggttccggggaacggaacgggtaaccgtaagggtaccggaacgtaagttaacccggaaacggttacggttacgggtcgttaccgtacgtacccgtaacctacgtttctccgggtttaccc

SEQ ID NO: 73559 - DNA, 827 bp, Homo sapiens
  misc_feature: GYAE6OF01DKSQ2.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaattgtgttgacacagtctccggccaccctgtctttgtctccgagggacagtcgcccaccctctcctgccgacgggccaggtccaaggagttgttagtacgcctttctagccgttaggtaacccaacgaacgaaaccctggacccagggcctccccgaaggtcctcccgttacacttcctagtcgtaactggacctaagtacccgaaacgacgggcccaacgttcgggacctaccgttccccgaacgtcccgtaacgggttccaaggttcggaccgtagggttcggggttacttaggtacgaaccgtaacggtaccctttacgaaccctttccgtaccctaaaccgtacgttacccgaacgggtaccgtaacggtaccccgtttaaaggaccggttaacccgttagggtaaaacgttaccgttttacgtaaccgggttactttaaacgggttttttaaccttaaccgttacgggttaccctaaggtacccggaaggttaccggtaacgtaaccgtaaaccgttcgggtaccccttacgttaccgttaccggtttcgggaccgggtaaacgggacccgtaaggggttacggaacgtaacgtaaacccggaaaacggttcgtacgggttacgaccgttaccggtacctaacccgttaagttcccggttcgtttaacccg

SEQ ID NO: 73560 - DNA, 692 bp, Homo sapiens
  misc_feature: GYAE6OF01CTW0E.49.46.E02.1.454.CMB.1.raw
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccaggggacagtgcccacctctcctgcagggccagtcagagtgttagtagcttcttagcctggtaccaacagaaacctggccaggcctcccgaggcctcctcatctatgatgcatccaacgacgggcccacgtcggcactccccgaagccgtagggttccaggttcggctaggttcggggtctggtgacgtaggtacctttcacttccnccaaccatacngccacgtccctaaggacgcctagaacgtactttcgtagtacttaaggttttacttaccgttggttaccaaggtacctaagggtcgttaaccgaccgtaaaccgttccgggtaccctttcgttaccgttacccgggttttccggggaaccggggtaacggggtaacccgtaaagggggttccgggtaaacggtaaccgttaaccggtaaaaaccgggtacgttcggggttaccgggtaccgttacgggaaccctacccgtacgtttcccgtacggttttaccc

SEQ ID NO: 73561 - DNA, 576 bp, Homo sapiens
  misc_feature: GYAE6OF01D8XVI.49.46.E02.1.454.CMB.1.raw
  modified_base (360)..(360): a, c, t, g, unknown or other
  misc_feature (360)..(360): n is a, c, g, or t
  modified_base (363)..(363): a, c, t, g, unknown or other
  misc_feature (363)..(363): n is a, c, g, or t
  modified_base (393)..(393): a, c, t, g, unknown or other
  misc_feature (393)..(393): n is a, c, g, or t
  modified_base (446)..(446): a, c, t, g, unknown or other
  misc_feature (446)..(446): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccgggagaaattgtgttgacacagtctccggccaccctgtctttgtctccgaggggacagtgcccaccctctcctgcagggccagtcagagtgttagtagcttcttagcctggtaaccaacaagaaacctggaccaggcctacccaggctcctcatcatgatgcatccgaacaggccacgtggccatcccagcctaggttcagtggcagtggctgnacngactcactctacacatcacgcagcctaagngacctagaacgtattcgtagtactaagtttactactgtacagacgtagcgtanacgtacgtcggtacctcttcgtaccgttacgggacgggtaacggaccgtaagggaggtaacgtacgtaaacgaaacggtacggttacgtggaccgtacggaccctaaccgttacttcgttcgttaacccg

SEQ ID NO: 73562 - DNA, 800 bp, Homo sapiens
  misc_feature: GYAE6OF01DADJ9.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtcctccggccaccctgtctttgcctcgagggcagtcgccctacctctcgtgcgacgggccagtcagagttgttaagacgtctttacgttacgccttacggtaaccaaacgaacgaaaaccgtcggaccacggtccctaccgaggtcctcctacacttctataggtatacgactaactaccgaaacgacgggaccaacggtcggacacctcccgaacggcctaaggtttccgaaggtcggacgtagggttcggggttactggtacgaacgtacggttaccttacaccttcctaaccacctaagtaccgaacgacgaccgtaccgtaacggacgtaccgtaaggtaaacgtactttacgtacggtaacttttaacggttttaacttaaccgtcgttaaccgacggtaccgtaacggtacggttaaaccgtaaccgtaaccggttaccgggttaccccttacccggttaccggtttaacccgggttttaccggggggaaccgggtaaaccggggtaaaccggtaaacgggttaacgggaacggttaaaaccggtaaacccgtaaaaaccgggttgttaccgggtacggtaaccgttaccgaacccgtaaccgtaaccgtttcgttccggtttaccc

SEQ ID NO: 73563 - DNA, 541 bp, Homo sapiens
  misc_feature: GYAE6OF01CJ9UR.49.46.E02.1.454.CMB.1.raw
  modified_base (382)..(382): a, c, t, g, unknown or other
  misc_feature (382)..(382): n is a, c, g, or t
  modified_base (537)..(537): a, c, t, g, unknown or other
  misc_feature (537)..(537): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccgaggcctcctcatctatgatgcatccaacgagggccacgtggccatccccagccaggttcaggtcggcaggtgggtctggtcgacagacctttcacttcncaccatcagcacgcctagacgccgtagaagtattctgtactagttttattacttgtcagcagtcgtacgactacgtcgtcctctctacgttcggcggaggacgaggtggacgtacgtacaaacgtacgtcggtagtcgtacgacgactactcgtntccg

SEQ ID NO: 73564 - DNA, 676 bp, Homo sapiens
  misc_feature: GYAE6OF01DKGZM.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccacccttctcctgcagggccagtcagagtgttagtagctttcttagcctaggtaccaaacgaagaaaccgtggacccagggccctcccgaggtccctcctacattctatcggatcgacactaccaaacgacgggcccacgtcggaccactccccaggcctaaggttccaggtcggaccgtagggttcgggtctggtacgacgtacgtactttcacttcaccgaccatcacgcctacgaccgtaggacgtccttaaggaagttacttcgtagtacgttaagtttttaactaccgtgtaccgagtacgtacgtacgtaacgtaccgtaacgtccgggtacccttcgtaccgttacggtttccggggacgggtaacggaccggtagggtagggaacgtaaccgtaagtaaaaccggcgttcgggtacggacccttacggaccctaaccgtcgttcggttccgtttaacccg

SEQ ID NO: 73565 - DNA, 713 bp, Homo sapiens
  misc_feature: GYAE6OF01C815J.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccacctgtctttgtctccgagggacagtcgcccaccctctccgtgcgacgggccagtcagtagtgttagtagtcttcttagcctggtaaccaacgaagaaacctggaccaggcctacccgaggcctcctcatctatgatcgactactacccaaacgacgggcccacgtcggacctactacccgacgcccgtaagggttccaaggtcggggactaggggtttcgggtactggtacgaaccgtacggtacctttaccgaccttcctaccaaccctacgttacgacgaccgtacgtaccgtaacgacgtaccgtaggtaacgtacttcgtagtaccgtttaagtttacttacgtgtaccgtagacgtacgtacggtaacgtaccgtaacgttccgggtacccttaccgtttaccggttaacccgggtttaccggggaacggggtaaccggtaaccgggtaaaggggtacggaaacgtaacgttaaaccgaaacggtacgtacgggttacggacgttccgaccctactgttcccgttgttaccc

SEQ ID NO: 73566 - DNA, 732 bp, Homo sapiens
  misc_feature: GYAE6OF01D10IP.49.46.E02.1.454.CMB.1.raw
  modified_base (426)..(426): a, c, t, g, unknown or other
  misc_feature (426)..(426): n is a, c, g, or t
  modified_base (717)..(717): a, c, t, g, unknown or other
  misc_feature (717)..(717): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtcctccgagggacagtcgcccacccttctcctggcacgggccagtcgagtagtgttagtagtcttactacgcctaggtaaccaaacgacgtaaaccgtggacccgaggtccctacccgaaggtcctcctactattcctatggtactcgactactaccaacggacggcccaacgtggacctaccgtcccgacgtaccgtaggttcgacgggttcgacggtacggttgggtacttcgganaccgtaggtaccttacgacctactacaacccttagaccgtacgaccgaccgtaccgtaggaccgtactaacggtaacgtcgttgttaacgtaacgtttacgtttaacttttaaccgcggttacgacggtaccgtaacgtacggttaacgacctaccggtttacgggtaccccttacgtacgggtttacccgggttacggggaaaccgggtaacgggtaaccggtaaacgggaggttaaccggaacgttaccgaaaccggttggcggttacgggacttcggactaacccgtnttacgtccgtttacc

SEQ ID NO: 73567 - DNA, 645 bp, Homo sapiens
  misc_feature: GYAE6OF01D684K.49.46.E02.1.454.CMB.1.raw
  modified_base (309)..(309): a, c, t, g, unknown or other
  misc_feature (309)..(309): n is a, c, g, or t
  modified_base (368)..(368): a, c, t, g, unknown or other
  misc_feature (368)..(368): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccatggcatcccagccaggttcagtggcaggtgggtctggtgacagacttcactcncaccatcagcagccctaagacgtccctagaaacgtactttcgtcgtacttaaggtttttaacttaacgttggttaccaaggtccgtaaggtaccggttaacggaccctaaaccggttcgggtacccctttaccgttacccgttaaccggttttccggggaccgggtaacggggaacccgtaaaggggttagggaaacggtaacgtaaccgaaaaccggtaccgttagggttcgggaccgttacggaccgtaaccctacgttcccgttcggtttaccc

SEQ ID NO: 73568 - DNA, 699 bp, Homo sapiens
  misc_feature: GYAE6OF01D442Z.49.46.E02.1.454.CMB.1.raw
  modified_base (151)..(151): a, c, t, g, unknown or other
  misc_feature (151)..(151): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccgganaaattgtgttgacacagtctccggccacctgtcttgtctccagggaccagtgccaccctctccgtgccagggccagtcagtagtgttagtagcttcttagcctggtaccaacagaaacctggccaggcctccacggctcctcgactctatggatcgacactccaacagggccacgtggcactcccagccgaggttcagtcggcaggtcggtctgtgactaaggaccttcacgttctacaccgtatcacgtcacggaccctagacgtcccgtagaaacgtattcgtaggactttaagttttaacttcgttggtacctaaggtactacgtacggttaacgtaccgtaaccgttagggtccccttacggttacccgttaacggttccggggtaaccgggaaccggggttaaccggtaaaccgggttagggggaacccgttaaaaccggttaaacccggaaaaaccggggttaaacccgttagggggttaccggtaaacccgtttcccgggaaacctaacccgttaacgtttcccgttaacggttttccccg

SEQ ID NO: 73569 - DNA, 653 bp, Homo sapiens
  misc_feature: GYAE6OF01DHGFQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagagtgttagtagctttctagcctaggtaccaacagaaacctggaccacggcctcccgaggcctcctcactctatgatgcatccaacgcgggccactggacacgtcccagccgaggttcaggtggcaggtggtctgtacgactacgtaccttcactccgtacacctataccgagtaccaacgtcctaaggacgtacccgttagaaacgttactttcgtacgtacgtttaagttttaacttacgtcgttaccaaggtcgtaaggtcgtaacgaccgtaaccgttcgggtcccttaccttccgtaaccgggttttccggggaccgggtaaccgggaaaccgtaaggggttacgggaacgtacgtaaaccgaaacggtaaccgttgggtaccgacgtacgacctacccgttattccgttcgttccc

SEQ ID NO: 73570 - DNA, 694 bp, Homo sapiens
  misc_feature: GYAE6OF01B332H.49.46.E02.1.454.CMB.1.raw
  modified_base (261)..(261): a, c, t, g, unknown or other
  misc_feature (261)..(261): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagcttctagcctggtaccaanagaaacctggccaggcctcccaggcctcctcatctatgatgcatccaacgacgggccacgtggcactccccagccaggttcagtcggcaggtgggtctgtgacagacttcactctcaccatcagcacgcctagacgccctaggaaacgtactttcgtacggtacttaaggtttttaacttaaccgttggtaccgtaaggtccgtaacgggtccggttaaacgtaccctaaaccggttcggggtacccctttaccgttaccggttaacccggtttttacccgggggaccggggtaaacgggggtaaccccgtaaaagggggttacggggaaaacgtacgttaaacccgggaaaaaccgggtaaccgtttaggggttacggggtacccttacgggaaccccaacccgttaacgttcccgttacggttttaccccg

SEQ ID NO: 73571 - DNA, 664 bp, Homo sapiens
  misc_feature: GYAE6OF01EGG82.49.46.E02.1.454.CMB.1.raw
  modified_base (328)..(328): a, c, t, g, unknown or other
  misc_feature (328)..(328): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccacggagaattgtgttgacacagtctccggccacctgtcttgtctccgaggggcagtcgcccacctctcctgcagggtccagtcagagtgttagtagtcttcgttagccttaggtaaccaacgagaaacctggacccaggtcctcccgaggccttcctacatctagtgactgacacgtacccaacgngggaccctagtggacctactcccgagaccgtaggttcaggtggctaggtgggtctggtacgactagtaccttcgacgtctaccaaccatccacgacgacgtcctaagacgtacctagtaacgtacttacgtacgtacgttaagttttaacttacgttacgtacgtacgacgtacggtacgtaacgaccgtaaccgtcgggtacccttacgttaccgttacgggtttaccgggaccgggtaacgggaaaccggtagggtaacgggtaacgtaacgtaaccggaaaccggtaggtcggtacggtaccgtacgaccctacgttactcgttcggttaccc

SEQ ID NO: 73572 - DNA, 697 bp, Homo sapiens
  misc_feature: GYAE6OF01D7BVP.49.46.E02.1.454.CMB.1.raw
  modified_base (262)..(262): a, c, t, g, unknown or other
  misc_feature (262)..(262): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagcttcttagcctggtaccaanagaaacctggaccaggctcccaggcctcctcatctatgatgcataccaacgacgggccacgtcggacactcccagccgtaaggttccaggtcggcgtaggtcgggtctggtcgacagtacttcactctcaccatcagcacgccgtaagacgtccgttaggaaacgttactttcgtcggttacctttaaggttttttaacttaaccgttcggttacgtaacggtacccgtaagggtaccgttaacgtacccgtaaaccggttcgggtacccctttccgttaccgtacccggttttaccgggggaaccgggtaaccggggtaaacccgtaaagggggtccggaaacggtaacgttaaacccggaaaaacggttacggttacgggtacgggtacccgtacggaaccctaacccggttacttcccggttagtttacccc

SEQ ID NO: 73573 - DNA, 575 bp, Homo sapiens
  misc_feature: GYAE6OF01B28GQ.49.46.E02.1.454.CMB.1.raw
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (558)..(558): a, c, t, g, unknown or other
  misc_feature (558)..(558): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagctttcttagcctggtaccaacagaaacctggccaggcctcccaggtcctcctcatctatgatgcatccaacgcggccactggcactcccagcctaggttcaggtcggctaggtgggtctggtgacagtacttcacttctacacctatacgagtcacgcctaggacncctaggaatcttcgntacgttagttttactacgtgtacagtcagtcgtagactacggtgtacctctctaccggttcggcgggtaacgggtaccgaagggtaggaacgtacgtaacgaaacggtacgttggtacggacgtcggacctaccncgtttccgtgtttaccc

SEQ ID NO: 73574 - DNA, 661 bp, Homo sapiens
  misc_feature: GYAE6OF01EYJK1.49.46.E02.1.454.CMB.1.raw
tcagagtcgagagacacgaccggtgctcgattttagactcatctacaggggaaagggggaggaactgctcagttaggacccagagggaaccatggaagccccagctcagcttctcttcctcctgctactctggctcccagactaccaccggagaaattgtgttgacacagtctccggccaccctgtctttgtctccagggacagtcgccacctctcctgcagggccagtcagagtgttagtagtcttcttagcctggtaaccaacacgaaacctggccaggcctcccgaggctcctcatctatcgtatgactagtacccaaacgcgggaccacttcgggactacgtccccgaggtcccgtaagggtttaccgtaacgttcggacgtaacggttcggggtaccttggtcgaacgtacgtaccttcaccgtctaccacctatccaagtcagtccctagacgtacctagaaagtcttcgtagacttagttttacttacgtcgtcgaacgtacaggtcgtaacgacctaacggtcgtcctttacgccttaaccggttcggggaccgtaacgggtaccgtaagggttggaacgtacgttaacccgaaaacggtccgttagggtaccggaccttacggacccgttaacctcgttccgttgtaccccg

SEQ ID NO: 73575 - DNA, 751 bp, Homo sapiens
  misc_feature: GYAE6OF01EHUL1.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagtaaattgtgttgacacagtctccggccaccctgttctttgtctccgaggggacagtcgccacctctcctgcgacgggccagtcgagtagttgttaagtagtctttacttacggccgttagggtaaacccaaaacgtaacgaaaaccgttcgggaaccctacgggtaccctacccgaacgggtcccttaccctcgaacttacctagtggtaatcggacctaacgtacccgaaacggacgggacctaacgtcggacctaccgtccccaggacccgtaggtttacgaggttcggacgtagggttcgggtctggtacgacgtaacggtacttaccaccgttacctacaacgtactccgaacgccgacggtacctaagggacctaccgtagaaagttacttcgtacgttacgtttaagttttaacgttacgtcgttacgacgtacgtaacggtacgtaacgaccttaacggtccgtaccctttacgttaccgtaccgggtttacggggaccgggtaacggaccggtaagggtaggaaccggtaactaaccggaaacggtcgtgggtacgacctacggaccctaacgttacgttcgttcgttaacccg

SEQ ID NO: 73576 - DNA, 632 bp, Homo sapiens
  misc_feature: GYAE6OF01DAQCI.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctccgtgcgacgggccagtcaggagttgttagtagtctttcttagccgttacggtaccaacgaagaaacccgtcggacccacggccctacccgacggccttacctcattctatcgtatcgacactaccgaacgcgggaccacgtcggacactccccgagtccgaaggttcgagtggactagggtcggtctgacgacacggtacttcactcctacaccagtcagcacgcctaagacgtactagaacgtcttcgagtacttagtttactacgttgtacgaagcgtacgtacgtaacgacttaccggtgtcccttacgttccgttacgttacgggacgggaacggtcgaaagggtgaacggtaacaacggtaaacgcgttggacgtaccgtagaaccacgtaatttccgaggtttacccc

SEQ ID NO: 73577 - DNA, 598 bp, Homo sapiens
  misc_feature: GYAE6OF01CGEA6.49.46.E02.1.454.CMB.1.raw
  modified_base (363)..(363): a, c, t, g, unknown or other
  misc_feature (363)..(363): n is a, c, g, or t
  modified_base (412)..(412): a, c, t, g, unknown or other
  misc_feature (412)..(412): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccaggggacagtcgccaccctctcctgccagggccagtcagagtgttagtagcttcttagcccttggtaccaacagaaacctggccatcgctcccagcctctcatctatgatgcatccaagcgggccactggcactcccagcccaggttcagtggcaggtgggtctggtgacngtacttcactctacaccatcagcagcctagacgcctagaagtactttcngtactagtttactacgtcgttacagtcaaggtccgttaaggacctaacgtcggtaccctttcgtaccgttacggtttccggggaccgggtaacgggacccgtaaaggggttcggaacgtaacgtaaccggaaaacggtaccgtgggttaccggaccttacggaccgtaacccgtagttcgtaccgg

SEQ ID NO: 73578 - DNA, 671 bp, Homo sapiens
  misc_feature: GYAE6OF01BNQNA.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctcccagactaccaccggagaaattgtgttgacacagtctccggccaccctgtctttgtctccgaggggacagtcgccaccctctcctgcagggccagtcagagttgttagtagtcttcttagcctaggtaccaacgaacgaaaccgtggaccaggcctacccgaggtcctcctcatctatgatgacactaccaacgcgggccacgtcggaccactcccagccgtaggttcgaggtcggacgtaggtgggtctggtagacagtaccttcgactcctacaccgtataccacgacacgtacctaaggaccgtacctaaggaaacgttcttccgtagtaccgtttaagtttttactacgttgtaccaggtacacggtacgtaacgtaccctaacggttccggtacccttacgttaccgttacgggttccgggaaccggggtaaacgggtaacccgtaaggggtacggaaacggtacgtaaacccgaaacggtacgttgggtacgaccgttacggacctaaccgttcgttccgtcgttacccg

SEQ ID NO: 73579 - DNA, 821 bp, Homo sapiens
  misc_feature: GYAE6OF01B8MKF.49.46.E02.1.454.CMB.1.raw
  modified_base (154)..(154): a, c, t, g, unknown or other
  misc_feature (154)..(154): n is a, c, g, or t
tcagagtcgagagacacgaccggtgctcgatttagactcatctacagggaaaggggaggaactggctcagttaggacccagagggaaccatggaagccccagcgtcagtccttctcttcctcctgctactctggcctcccagataccaccgganaaattggtgttgacacagtctccggtccacccttgtctttgtactccgagggaccagtgccacccgtctcctgcgaggccagtcgagagtgtagtagcttgtacgcctggacctaacagaacctggaccaggctccgagtctcgtcatctatgatgctatccaacgacggcccaacgtcggaccacgtacccgacggtccgtagggtttcgaggtacggtacgtaagggttcgggtactaggtagaccgtaaggtaccgtttaccgtaaccgtttaccgtaccttaacccgtaattcccgaacggttaccgaaccggtacccgttaacggggaaccgtaccccgttaaggtaaacccgttaaactttccgttaccgggtaactttaacgggttttttaaaccctttaaaccggtacccgtttaccgaaacgttccgggttaaacggttcgggtttaaccgtaaacccggttaacggttaccgggtaccccgtttaccgttaaccccggttaaccgggttttaccgggggaacccggggtaacggggtaaacccgtaacgggggttcggtaaaccgtaccgttaaaccggtaaaacggttaccggttcggggtacggacccgttaggtaaccccggtaaccgttacggttccgttacggtttacccgg

SEQ ID NO: 73580 - DNA, 750 bp, Homo sapiens
  misc_feature: GYAE6OF01BQ5HM.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggaagaaattgtgttgacacagtcctccggcccacctgtcttgtctccgagggacagtcgcccaccctctcctgcgagggccagtcagtagttgttagtagtcttcttagccgttaggtaaccaacgaaggtaaacccgtggaccgacggtccctacccgaggtccctcctactattccgtaatggactcgactactacccgaacgacggaccacgtcggaccacgtccccgagtacccgtaggttccaggtcggaccgtagggttggggttactggtaggaaccgtaacggttaccttactaccttaccctacctaaaccgtacgttaccgaacgtaccgaccgtacccgtaagtccggtaacccgttaggaaaccgttactttaccgagttaaccgttttaagttttaacgttccgtaaggttccgtaagggtctaaccgggttcgtaaccgacgttaaccgtccgggttaccctttaccgttaccgttacccggttccggggaaccggtaaccggggtaacgtaacggggtacggaacgtaagtaacccgtaaacggtagtcgggtagacccgttagacgtaccgtattcgttccgttacc

SEQ ID NO: 73581 - DNA, 784 bp, Homo sapiens
  misc_feature: GYAE6OF01B76BW.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtgcccacctctcctgcagggccagtcagagtgttagtagtcttcttagccgtaggtaaccaaacgaacgaaacctcggaccaacggcctacccgaggtcctacctcatctagtgattacgcaactaccgaaacgtacgggacctacgtcggaccaacgtccccgagtaccgtaaggtttccaggttcgggacgtagggttcgggttcgtaggtacgtaacgtaacggtacctttcaactttcctaccaacctactaccgaacgacgaacggtacccgttaaaggaccggttaacccgttaggtaaaacgttacgtttaccgttacggaaccgtttttaaaggtttttaaccttaccgtacgggttaccaacggtccgtaaacgggtacggttaacggaacccgtaacgttcccgggtacccttaccgttaccgtttaaccgggtttaccggggaaccggggtaacgggtaaaaccccgtaagggggttaacggtaaacgtaaccgtaaacccggtaaaacggtacggttacgggtaccggacgttacggacctaaccggttacttcggttccgttaacccg

SEQ ID NO: 73582 - DNA, 641 bp, Homo sapiens
  misc_feature: GYAE6OF01ASQ8C.49.46.E02.1.454.CMB.1.raw
  modified_base (376)..(376): a, c, t, g, unknown or other
  misc_feature (376)..(376): n is a, c, g, or t
  modified_base (429)..(429): a, c, t, g, unknown or other
  misc_feature (429)..(429): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcgagggccagtcagtagttgttagtagctttcttagcctaggtaaccaacagaaacctggcccaggcctcccgaggcctcctcatctagtgatgcactacccaacgcggccagtcggaccactccgagccgtaggttcaggtggctaggtcggtcngtacacgtagtacttcactctaccacatcgagcacgccagacgctagaacgtnttccgtagtacttaagtttactaccgtgtacgtacgacgtacggtacgtaacgtaccgtaaccgtccggtacccttaccggtcccgttaacgggtttacccgggaccgggtaacggtaaccggtaggtaccgggtaacgtacgtaaacccgtaacgggtaccgttggtaacgttccgtaacggtaccctaagttccgttccgttgttacccc

SEQ ID NO: 73583 - DNA, 545 bp, Homo sapiens
  misc_feature: GYAE6OF01A0HHK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcactccaacagggcccacgtggacactcccagccctaggttcaggtggcaggtgggtctgtgacagtacttcactctcacatcagcagcctagacgcctagaacgtattcgtgactagttttatacgtgtacagcagcgtaagactaacgtggtacctctctacgttcgggacggtagggacctaagggtggaacgtacgtacaaacggtacgtggtagccgtagccaactatccgtgttacccg

SEQ ID NO: 73584 - DNA, 625 bp, Homo sapiens
  misc_feature: GYAE6OF01BS7QV.49.46.E02.1.454.CMB.1.raw
  modified_base (316)..(316): a, c, t, g, unknown or other
  misc_feature (316)..(316): n is a, c, g, or t
  modified_base (385)..(385): a, c, t, g, unknown or other
  misc_feature (385)..(385): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagcttctagcctggtaccaacagaaacctggaccaggcctcccgaggcctcctcatctatgatcgcactccaacgngggccacgtggaccactcccagccaggttcaggtggcaggtggtctgtgacagtacttcactctcaccntacagcacacctagacgcctagaagtacttctagtctaagttttattacgtcgtacgacgtcgagtacgtacgactaacgtcggtacccttcgttaccgttaccggtttacgggaccgggtaacgggtaaccgtaaggggttacggaaacggtaaccgttaacggaaaaccggtacgttacgggtacgggtaccgttacggaacccgaacccgttacgttacccgttcggtttaaccccg

SEQ ID NO: 73585 - DNA, 796 bp, Homo sapiens
  misc_feature: GYAE6OF01EDRNK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagttgttagtagctttcttagccttggtaaccaacagaaacctggccaggcctcccaggctcctcatctatgatgctactaccgaacgacgggcccaacgtcggccacgtccccgaggtccctagggtttaccaaggtcgggtacctagggttggggtcttggtgaaccgtacggtaaccttcctaccttcctacctaacccgtaattccgaaacggtaccgtaacggtacccgtaacgggtaccggtacccgttaacggtaaacgttacgtttccgttacggtaccgtttaaacggttttttaacttaaccgtttaggttaccgtaaggtaccgtaacggtaccggttaacggtaccgttaaacccggttcggtacccctttaccgttacccgtttaaccggttttaccgggggaaccggggttaacggggtaacccgggttaaaaggggttaccggggtaaacggttaacgtaaaccggtaaaaacccggttaccggttagggtaccgggtaccgtaacggtacccgtaacccgttacgtttacccggttcgttttaaccccg

SEQ ID NO: 73586 - DNA, 814 bp, Homo sapiens
  misc_feature: GYAE6OF01C05IK.49.46.E02.1.454.CMB.1.raw
  modified_base (307)..(307): a, c, t, g, unknown or other
  misc_feature (307)..(307): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtcctccggccacctgtctttgtctccgaggggacagtcgccaccctctccgtgcgagggccagtcagagttgttagtagtcttctagcctaggtaccaaacgagaaacctggaccgaggcctacccgaggtcctaccgtnactctatgatcgactactaccgaacgcggccacgtcggactacgtcccgaacgtccgtaacggttccaaggtcggtacgtagggttcggggtaccttgggtaacgtacgtacggtacccttttaccaccgttccctaccaaccgtacttaccgaacggtacccgaacggtcccgtaacggaccgttacccgttaaggtaaacgttactttcccgaggtaacgtttaacggtttttactaaccggttcgtaacgtacggtacgtaaccggtaccggttaagtacccgtaacggttccgggtacccttaccggttaccgtttaacccgggttacgggggaaccgggtaaccggggttaaaccggaaacggggttacgggtaaaccggttaaacccgtaaaacccgggtaaaacccgggttaacgggttacgggttaacccgggttaccgttaacccgggtaaacccccgtaaccgtttttacgttccccggtttacggttttaaccccg

SEQ ID NO: 73587 - DNA, 541 bp, Homo sapiens
  misc_feature: GYAE6OF01B0T9G.49.46.E02.1.454.CMB.1.raw
  modified_base (407)..(407): a, c, t, g, unknown or other
  misc_feature (407)..(407): n is a, c, g, or t
tcagagtcgagagacacgaccggtgctcgatttagactcatctacaggggaaagggggaggaactgactcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagtagtgttagtagcttcttagcctggtaccaacagaaacctggccaggctcccaggctcctcatctatgatgcatccgaacgagggccacgtcggccactcccagccgagttcagtcggcaggtggtctgtgacagcttcactctacaccatcagcacgactagactcctagaatnttctgctagtttactactgtacagcgagcgtagacctaacgtcggtcctcgtactacgtttcgggacggtacgggacctaagggtgagtactacgaaacgtcgtcgtggactcggaccactacgtcgtcgttcc

SEQ ID NO: 73588 - DNA, 559 bp, Homo sapiens
  misc_feature: GYAE6OF01B0KZD.49.46.E02.1.454.CMB.1.raw
  modified_base (291)..(291): a, c, t, g, unknown or other
  misc_feature (291)..(291): n is a, c, g, or t
  modified_base (400)..(400): a, c, t, g, unknown or other
  misc_feature (400)..(400): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctnatctatgatgcatccaacagggccactggcatcccagccaggttcagtggcaggtgggtctgtgacagtacttcactctcaccatcagcagcctagacgcctagaagtnttctgacttagttttactacgtgtcagcagtacgtagacaacgtcggtcctcgttctacgtttcgggacgggtaacggaccgaagggtacggacgtaacgtacgaaaccggtacgtaggtacggtcgtacggacctaaccgtacgttcgttcggttacc

SEQ ID NO: 73589 - DNA, 594 bp, Homo sapiens
  misc_feature: GYAE6OF01CM677.49.46.E02.1.454.CMB.1.raw
  modified_base (254)..(254): a, c, t, g, unknown or other
  misc_feature (254)..(254): n is a, c, g, or t
tcagagtcgagagacacgaccggtgctcgatttagactcatctacagggaaagggggaggaactgctcagttaggacccagagggaaccatggaagcccagctcagcttctcttcctcctgctactctggctccagataccacggagaaattgtgttgacacagtctccggcaccctgtctttgtctcgagggacagtgccacctctctgcagggccagtcagagtgttagtagcttcttagcctggtaccaanagaaacctggccaggctccaggcctcctcatctatgatgacactccaaacgagggcccaacgtcggcactccccgagcccgtaggttccagtggctaggtgggtctgtgacagtacttcactctcaccatcagcagctagacgcctagaacgtattcgagtacttagtttaacttaccgtgttaacacgacctagggtctaacgaccgtaacgtccgtccttaccttacgtaccgtttcgggaccgggtaagggtaaccctaaggggtcgaaacggtactaaccggaaaacggtcgtgggtacggtacttacggaacctaccgaacttccgtgttacccg

SEQ ID NO: 73590 - DNA, 723 bp, Homo sapiens
  misc_feature: GYAE6OF01DA7RQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcagggccagtcagagtgttagtagctttcttagcctggtaccaacagaaacctggccaggctcccaggcctcctcactctatgtatcgcaatcccaacgacgggccacgtggcactccccagcccgtaggttcaggtcggacagggttgggtctggtacgacacggtacctttacacttaccgtaccaacctactaccgagaaccgacggacccgttaaagggaccgtacccgttaaggaaacgttaagttttccgtacggttaccgtttaagtttttactttaaccgttgtaccgttaacggcgtacgtccggttaagaacccgttaaccggttcgggtaccccttccgttaccctttaaccgggttttccggggaaccggggtaacgggtaaccgtaaacggggtacgggtaaacgtaacgtaaaccggaaaacggtaccggttacgggtacgggtacccttacggaaaccctcctaaacgttccgtttcggtttaacccg

SEQ ID NO: 73591 - DNA, 552 bp, Homo sapiens
  misc_feature: GYAE6OF01AJ61U.49.46.E02.1.454.CMB.1.raw
  modified_base (403)..(403): a, c, t, g, unknown or other
  misc_feature (403)..(403): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcactcccagccaggttcaggtcggcaggtgggtctgtcgacagacttcactctcaccatcagcagcctagacgcctagaacgtnttcgtgctagttttatacgtgtcagcagtcgtagcctaacgtggccttcgtctacgtttcgggacggtacgggaccgtaagggtcggaagtactaccgaaaacggtcgttcggtacggccgtacgaccctaaccgtcttcgtcgttacc

SEQ ID NO: 73592 - DNA, 562 bp, Homo sapiens
  misc_feature: GYAE6OF01BPV6Y.49.46.E02.1.454.CMB.1.raw
  modified_base (446)..(446): a, c, t, g, unknown or other
  misc_feature (446)..(446): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagctttcgttagccttggtaccaaacgagaaacctggccaggctcccaggctcctcatctatgatgcactaccaacgacgggccactggcactcccagccaggttcaggtggcaggtgggtctgtgacgagtacttcactctcaccatcacgtcacgtcctagacgccgtagaactacttctagtacttagtttactcttgtacngcagtcgtacgactacgtcggtccttctctacgttcgggacggtaacggacgtaggtacggaagacgtacggaaaccgtcgacggtagtacgtcgacctacgtatccgttgttccc

SEQ ID NO: 73593 - DNA, 651 bp, Homo sapiens
  misc_feature: GYAE6OF01D1B36.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgcccaccctctcctgcagggccagtcagagtgttagtagcttcttagcctaggtaccaacagaaacctggccaggcctcccgaggcctcctcatctatgatgcactacccaacgacgggccacgtcggacacgtcccagccgtaggttcaggtcggcgtaggttgggtctggtacgacgtacgtacttcacctccgtaccacctatcgacgccgacgacccgtagacgtacctagtaacgtctttcgtgtacttagttttacttacgttcgtacgacgtacgtacggtacggtaacgacccgtaacgtccggtcccttaccgttaccgttaccgggtttccgggaccggggtaacggtaaccgtaggggtacggtaacgtaacgtaaccggaaacggtacgtcgggtacgtccgtacgtaccgaaccgttgttccgtcgtttacccg

SEQ ID NO: 73594 - DNA, 521 bp, Homo sapiens
  misc_feature: GYAE6OF01EGMXB.49.46.E02.1.454.CMB.1.raw
  modified_base (514)..(514): a, c, t, g, unknown or other
  misc_feature (514)..(514): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttctagcctggtaccaacagaaacctggccaggcctcccaggctcctcatctatgatgcactccaacgagggcccactggcatcccagccaggttcagtggcagtgggtctgtgacagacttcactctcaccatcagcagcctagacgcctagaagattctgtactagttttatacgtgtcagcagcgtagcgaactcggtcctctcgtacgttcggcggtacggaccgaaggtcggagtacgtacaaacgtacgtgtacggctcgacaccntctgtcc

SEQ ID NO: 73595 - DNA, 673 bp, Homo sapiens
  misc_feature: GYAE6OF01DZPWD.49.46.E02.1.454.CMB.1.raw
  modified_base (308)..(308): a, c, t, g, unknown or other
  misc_feature (308)..(308): n is a, c, g, or t
  modified_base (500)..(500): a, c, t, g, unknown or other
  misc_feature (500)..(500): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccacggagaaattgtgttgacacagtctccggccaccttgtcctttgtctccaggggacagtcgcccacctctcctgcacgggtccagtcagagttgttacgtgcctttctagccttaggtaaccaacaagaaacctcggaccagggcctcccgaaggtcctcctanacttacctaatggtaatgaccacgttaccaacgagggcccacgtcggacctactcccgagcccgtaacggttcaggtggacgaggttggggtcctgggttacaacgtaggtacctttacaccttctaccaaccgtactacgacgccaacgtccctaagctactagaagtctcgtagcttagtttacttacgngttaccagtaccgagtcgtaacggtacctaacggttccgtccctttcgttacccgtaccgttttaccggggaccgggtaacgggtaacccggtaaggggtaccgaacggtaactaaacggaaaccggtaacgttggtaccgggattacggacctaacgtgtactcggttaccc

SEQ ID NO: 73596 - DNA, 599 bp, Homo sapiens
  misc_feature: GYAE6OF01B9KC6.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggcctcctcatctatgatgcactccaacgacgggccacgtggccactcccagcctaggttcagtcggctaggtggtctggtgacacgtacttcactcctcaaccatacagccacgcctaagacgtacctagaaagtcgtttctacgacgtttaagttttacttacgtgttacgagtacgtaggtccgttaacgaccgtacgttcgggtcccttaccttccgtacggtttccgggacgggtacgggtaaccgtaagggtaggagtaaccgtaacgaaacggtacgtggtcgacgtgaccaccgtattccgtcgttac

SEQ ID NO: 73597 - DNA, 816 bp, Homo sapiens
  misc_feature: GYAE6OF01DHOOG.49.46.E02.1.454.CMB.1.raw
tcagagtcgagagacacgaccggtgctcgatttagactcatctacaggggaaaggggaggaactgctcagttaggacccagagggaacccatggaagccccagctcagcttctcttcctcctggcctacgtcctggctccagatacccaccggaagaaacttcgtgttgacacagtcctcccggccaccctgtactttgctccagggacagtcgccaccgtctcctgccacgggaccagtcgaagtaagttgttagtagtcgttcttacgcctcggtaccaacgaagaaaccctcggaccacggcctcccaggtcctcctcactactaatgatcgaccagtaccaaacgtacgggacccacgttcggtccaacgttccccgagtaccccgaaggtttccgaacggtcggtaccgtaagggttccggggttaccctacggttcggaaacctacggtaaccctttccgaaccctttccgtaaccgtaacccgtaacgttacccgaacggtaccgtaacgtacccgtaaggaaccggtacccgtaagtaaacgttaacgtttaccgtacgtacgttaagtttttaacgttacgttggttacgtacggtacgtacggttacggtaacggaccgtaaacgtccgggtcccttaccgttacccggttaccggttttacgggaaccgggtaaccgggtaaacccggtaaacggggttacgggtaaaccggtaaccgttaaccggtaaaacccggttaccggttacggttacccgggtacccttaccggtaacccgtacccgttacgttccgttcggtttaccc

SEQ ID NO: 73598 - DNA, 609 bp, Homo sapiens
  misc_feature: GYAE6OF01C9L5V.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggaccaggcctcccgaggctcctcatctatgatgcatccaacacggccagtggcactcccagccaaggttcaggtggctaggtggtctgtgagtacgtacttcactctacactactccgagtaccacggtccctaagacgtacccgtagtaaacgtaactttccgtagtaccttaagtttttacttaacgttcggttacaacgtcgaacgtcgtaacgtacaaccgttcgtcctaccttcgtaccggtttcgggacgggtaacgggaccaggggttacgagtaacgtaaccgaaacggtcgtacggtggaccttcgaccttaccgtatcgttcgttaccg

SEQ ID NO: 73599 - DNA, 736 bp, Homo sapiens
  misc_feature: GYAE6OF01DAWDT.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcttgtctccgaggggacagtcgccacctctctgcagggccagtcagagtgttagtagtcttctagcctacggtacaacagaaaccgtggaccaggcctccgaggtcctcctcatctatgatgacactaccaaacgacggccacgtcggacacgtcccagtcccgtaggtttccgaggtggaccgtagggttcgggttcgtggtacgaacgtacggtacctttaccgtaacttccctacaacccgtatacccgagccgaacggtaccttaaggaccgttaccctaggtaaacgttactttccgtaggtacctttaacggttttattaacccgttgggtaaccacgggtaccgtaaggttcccggtaaagtacccgtaacccgttccgggttacccttacccgttccgtttaaaccgggtttccgggggaccggggtaaaccggtacccggtaaaaggggttcggaaacgtaaccgttaaacccgggaaaccggttaggttcggtacggtcccgtaaccgtaacccgtacccgtacggtttccgtcggttacccc

SEQ ID NO: 73600 - DNA, 612 bp, Homo sapiens
  misc_feature: GYAE6OF01BFQE8.49.46.E02.1.454.CMB.1.raw
  modified_base (202)..(202): a, c, t, g, unknown or other
  misc_feature (202)..(202): n is a, c, g, or t
  modified_base (324)..(324): a, c, t, g, unknown or other
  misc_feature (324)..(324): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaangccacctctcctgcagggccagtcagaatgtgcagctacttagcctggtaccagtcaagaacctggaccaggcctcccgagtcctcctcattctttagactcgcactcccgcgtagggcctntacgacactcccgagcccgtaggttccaggtcgacgtaggtggggttcggacaggtacttcgacgtctacgacctagtcgagcgacgtacctagacgtcctagtaagtatttcgacttagtttactacgttctactaacgacgtacgtaccaagtacggtacttaccgtacgtttccgacccgttaggacctaggtaacgtggtaaacttacgtaacgaaaccggtcgtaggtacggtcctacgacctaacccgtgttaccgtacggtttcttccgtactttaccccg

SEQ ID NO: 73601 - DNA, 680 bp, Homo sapiens
  misc_feature: GYAE6OF01ATUTK.49.46.E02.1.454.CMB.1.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagcttcttagcctggtaccaacagaaacctggccaggctcccaggctcctnatctatgatgcatccaacgnggccacgtggacactccccgagcccgtagggtttccgaggtcgggactaggggttggggttcctggttacggaactacggtacctttaccgaccttcctaccaacccgtatccaacgcctacgtacccgttaggaccgtccgttagaaagttacttacgtgtacttaagtttttaacttacgttagtccgaacgtcgtaacgtacggttacgacgtaaccgtcggtccccttaccgttccgttaccggtttaccggggaccgggtaaggggtaccctaaaggggtacggtaacgtaacgtaaccgaaaaccggttacggtcggttacgggaccgttcgaacccgtaccgtacttccgttgtttaccccg

SEQ ID NO: 73602 - DNA, 663 bp, Homo sapiens
  misc_feature: GYAE6OF01EG5MO.49.46.E02.1.454.CMB.1.raw
  modified_base (644)..(644): a, c, t, g, unknown or other
  misc_feature (644)..(644): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagtctttcttagccttggtaaccaacaacgaaacctggaccaggcctcccaggcctcctcatctatgatcgcactaccgaacgacgggccacgtcggcactcccagaccctaggttcaggtggcaggtgggtctggtgacacgtactcacctctaccacctatcgacgcagtaccgtagacgtccgtaagaaacgtactttcgtagtactttaagttttaacttactcgtacagtactacggacgtaacgacgtaaccgttcgggtacccttaccgttacgttaccggtttaccggggacgggtaaacggggaaccctaaagggggttacggaaggtaaaccgttaaccggaaaaaccggtacggttacgggtacgggtacccgttacggacctaaacccgttnttcccggttcgtttacccg

SEQ ID NO: 73603 - DNA, 591 bp, Homo sapiens
  misc_feature: GYAE6OF01ASOD2.49.46.E02.1.454.CMB.1.raw
  modified_base (294)..(294): a, c, t, g, unknown or other
  misc_feature (294)..(294): n is a, c, g, or t
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
  modified_base (412)..(412): a, c, t, g, unknown or other
  misc_feature (412)..(412): n is a, c, g, or t
tcagagtcgagagacacgaccggtgctcgatttagactcatctacagggaaagggggaggaactgctcagttatgacccagagggaaccatggaagccccagctcagcttctcttcctcccgctactctggctcccagataccaccggagaaattgtgttgacacagtctccggccaccctgtctttgtcctccgaggggacagtgcccaccctctcctgcagggccagtcagtgtgttagtagctttctagtcctggtaccaacagaaaccgtggccagcctcccaggctccnatccgtatgatgcactccaacgacggccactggcatccccagcctaggttcgaggtgcgagttgggtctgtagccaagtcttccactctccacagtcancancctagacgctagaatntctgtctattttactctgtacgacgctagtcggaatcgtaaccttcgggtcccttagttacccgtccggtttaccgggacgggtaacgggaccgtaagggtaacggtagtaaccgtaacgaaaacggtaccgttgggccggaacttccggacaacccctaagtttccgtgtttaacccc

SEQ ID NO: 73604 - DNA, 712 bp, Homo sapiens
  misc_feature: GYAE6OF01CG4GF.49.46.E02.1.454.CMB.1.raw
  modified_base (698)..(698): a, c, t, g, unknown or other
  misc_feature (698)..(698): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagtaaattgtgttgacacagtcctccggccaccctgtctttgtctccgaggggacagtcgcccacctctcctgcagggccagtcagtagtgttagtagtcttacttacgcctaggtaaccaaacgaacgtaaaccgtggaccgacggtccctacccgaggtccctaccctctaacttcctaagtcgtaactcgacctaactaccaaaccggacggccctaaggtcggacctaacctccccgaagtcccgtaggtttccgagggttcggacgtagggttgggtctggtacgaacgtacgtacttccgtaactcccgtactaacccgtataccgatccgaacgtaccgtaaggacctaccgttaaaggtaacgttacgtttcgtacggtaacgttttaaacgttttaacttaccggttcgttaccaacggacgtaacgggtacgtaacgaccgtaacggtccgtacctacgttcgttaccggtacgggacgggaacggtacgaagggtagaacgtacgaagtaaacggcgtgggtaatccgtacgacctaacnctttcgtgttaccc

SEQ ID NO: 73605 - DNA, 568 bp, Homo sapiens
  misc_feature: GYAE6OF01B19UD.49.46.E02.1.454.CMB.1.raw
  modified_base (556)..(556): a, c, t, g, unknown or other
  misc_feature (556)..(556): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcatccaacacgggccacgtggcactccccagccaggttcagtggcgagtgggtctgtgacagtacttcactctacaccatcagcagcctaggacgtccctagaaagtattcctgtcttaagtttattacgtgtcagcagcgtagactaacgtcggtacctcgttaccttaccgtttccgggacgggacgggaaccgtaagggtagggaacgtacgtacgaaaacggtacgttggtcgggctacggcccaaccctnttctcggttacc

SEQ ID NO: 73606 - DNA, 594 bp, Homo sapiens
  misc_feature: GYAE6OF01DBJW6.49.46.E02.1.454.CMB.1.raw
  modified_base (374)..(374): a, c, t, g, unknown or other
  misc_feature (374)..(374): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcgagggccagtcagtagtgttagtagcttcttagcctggtaccaacagaaacctggccaggctcccaggcctcctcatctatgatgcatccaagagggccacgtggcactcccgagccaggttcagtggcaggtggtctggtgacagacttcactcncaccatcagcacgcctaagacgtcctagaacgtattcgtagtcttaagttttacttaccgtgttccaagtcgtagtacgtaacgacctaaccgttggcccttctaccgtttacggtttcgggacgggtaacgggtaaccgaggggttacggaagtaaccgtaacgaaaacggtacgtcgggtagaccgtcgaacctacccgtaattccgttaggtttccc

SEQ ID NO: 73607 - DNA, 595 bp, Homo sapiens
  misc_feature: GYAE6OF01CW8M1.49.46.E02.1.454.CMB.1.raw
  modified_base (261)..(261): a, c, t, g, unknown or other
  misc_feature (261)..(261): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagtagtgttagtagctttctagcctggtaccaanagaacctggccaggctccaggctcctcatcgtatgatgacactaccaacgacgggcccacgtcggaccaactccccgaagtccgaacgggtttccaaggtcggctagggttcggtcgtagtacgacagacctttcgactctcaacgtatacagcacgcccttaggacgtccctaggaacgtaactttcgtgtacttagttttactacgtgtctagctagggctaacgcaacgttcggcttcgtcttaccggttcggacgggaacggtaccgaaggggtgacgtaaacgtacgaaacggtctaggtcgactcggactacctaattcgttcgttcc

SEQ ID NO: 73608 - DNA, 695 bp, Homo sapiens
  misc_feature: GYAE6OF01C64V0.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagatacccaccggagaaattgtgttgacacagtctcccggccaccctgtctttgtctccgaggggacagtcgcccaccctctcctgcagggccagtcagagtgttagtagcttctagccttaggtaccaaacagaaacctggaccaggcctacccgaaggtcctcctcgtatctagtgatcgcctaatcccaaacgcgggccctacgtcggaccacgtccccgagtcccgtaaggtttcgaggtcggacgtagggttcgggtctggtagaacctaagtaccttcgacctttccgtaaccacctaacgtcaaggcctacggtacctaagacgtaccctaggtaacgtacttcgttacggtactttaagttttaaccttcgtaggttaccaagccgttaaggcgttaaccggacctaacgtccggtacccttccgttaccgtaccgggtttagggacccgggtaacggggaaccgtaacggggtagaacggtacctaaaccggtaaacgtaccggttgtacggtaccctcggaaccctccgtacttccgttgtttaacccc

SEQ ID NO: 73609 - DNA, 634 bp, Homo sapiens
  misc_feature: GYAE6OF01DBOO4.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctgggtaccaacaagaaacctggaccaggcctcccgaggcctcctcatctatggatgcatccaacaggccagtcggacactcccagccaggttccagtcggctaggtggtctggtgactagacttcactctcacatcagtcagctgctagtctagtaagttatttgacttagttttattacgtagttcgagtctaagttaacttaacgttcgggtcccgggtaccgtacccggtacgtaccggtttccggggacgggtaacggggtaaccgaagggttacgggaacggtaacgtaaccggtaaacggaaaccggttgggtaacgggtcccgttacggtaacccctaaccgttaagttcccgtttcggttccgtttaaccccg

SEQ ID NO: 73610 - DNA, 631 bp, Homo sapiens
  misc_feature: GYAE6OF01B5IXN.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctaggtaccaacacgaaacctggccaaggcctcccgaggcctcctcacttctatgatgacataccaacgtacgggccacgtggcctactccccagcccgtaggttcaggtggctagggtcgggtctgtacgacgacgtacttcgacctcgtacaccgtattccgaacgtccaacgtacccgtaaggacgtacccgtaggaaacgttattccgtagtacttaagttttaactacgttcgtactaagcctaggtacgtacgacgtacgttcgccttcgtaccgttcgtttcgggacgggtaacgggaccgtaaagggtggaaacggtctaacggaaacgtaccggtggtacggacgtacgacccaacgtctcgttgttacccg

SEQ ID NO: 73611 - DNA, 581 bp, Homo sapiens
  misc_feature: GYAE6OF01BFMR1.49.46.E02.1.454.CMB.1.raw
  modified_base (453)..(453): a, c, t, g, unknown or other
  misc_feature (453)..(453): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaacctggccaggctccaggctcctcatctatgatgcatcccaaacgacgggccaacgtggcactccccagcccaggtttcaggtggacaggtcgggtctggtcgacagtacttcactctccacatacagcagcctaggagtcctagtaagtactttcagtcttaagttttattactgtccagcagcgtanacctaacgtcgtcccttctcgttaccgtttacggcgggtacgggacccgtaagggtcggaagtaacgtaccgaaaacggtacgttaggtcggtacttacggacctaacctacttccgtggtttacccg

SEQ ID NO: 73612 - DNA, 544 bp, Homo sapiens
  misc_feature: GYAE6OF01D5D5D.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttctagcctggtaccaacagaaacctggccaggcctcccaggcctcctcatctatgatgcatccaacgacgggccacgtggcactcccagcccgtaggttcagtcggcaggtgggtctgtgacagtacttcactctcaccatcagcacgcctagacgtcctagaacgtattctgtctagttttatactgtacagcagcgtacgactacgtcggtccttcttctacgttcggacggaggaccgagggtgacgtacgtaaccaaacggtcgtaggtcgacgtcgacctacctgttcctgttacc

SEQ ID NO: 73613 - DNA, 724 bp, Homo sapiens
  misc_feature: GYAE6OF01B2TNV.49.46.E02.1.454.CMB.1.raw
  modified_base (200)..(200): a, c, t, g, unknown or other
  misc_feature (200)..(200): n is a, c, g, or t
tcagagtcgagagacacgaccggtgctcgatttagactcatctacagggaaagggggaggaactgctcagttaggacccagagggaaccatggaacgccccagctcagcttctcttcctcctgctactctggcctccagataccaccggagaaattgtgttgacacagtctccggccacctgtcttgtctccgagggacngtcgccctaccctctcctgcgaggccagtcagtagttgttagtagtctttcgtacgccgtaggtaaccaaacacgtaaaccgtggaccaggcctcccgaggtccctacctacatctagtgtatcgacactaccaacgacggcctacgtcgaccactcccgacgtccgtaggttcgaggtcggacgtagggtcggtcgttagtacgacgtaacgtaccttactaccttcctaccgacctactacgacgtccgacgtaccgttaaggccgtaccgtaaggaacttacgtttaccgtgttaacgttaggttttaacttacgtacgttacgaaggtacaacggtaccgttaacgtaccctaaccggttccggtcccttaccggttaccgttacccgggtttacgggaaccgggttaaacgggtaaccgtaacggggtaggaaacgtaaccggtaaacggaaaacggttccggttacgggacggtacccgtacgacccgttaaaccgttcgtttccgtcgtttaacccg

SEQ ID NO: 73614 - DNA, 796 bp, Homo sapiens
  misc_feature: GYAE6OF01C0TUM.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagactaccaccggagaaattgtgttgacacagtctccggccacctgtctttgctccgaggggacagtcgccaccctctccgtgcagggccagtcagagtgttagagtcttcttagccgtaggtaccaagtacgaaaccgtgaccgaggcctcccgaggtcctcctcaacgttcctatggtactcgaccaacgtacccaaacgacgggacccacgtcggaccactcccgacgccgtaggtttacgagtcggcgtaggttcgggttctagtcgaacgtacgtacctttaccacctttactaccgtaacctagttaccgaacgaccgtaaccgtccgttaaacgacggtacccgttaaaggtaaacgggtttactttaccgtacgggtaacctttaagtttttaaaccggtttaccgacggtttaccgtaaacggtacgtaaacgggttcggtaaaccgtaaccggttaaacccgttcggggtaccccctttaccggttaccccgggttttaacgggtttacccgggggaaccgggttaaaccgggggttaaacccggaaagggggttaccggtaacgtaaaccgtaaaccgtaaaccggttaacggttcgggttaaccgcgtaccgtaacccgtaccttaacggttcccgttacggtttaccc

SEQ ID NO: 73615 - DNA, 692 bp, Homo sapiens
  misc_feature: GYAE6OF01EVS7K.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacccttgtctttgtctccgaggggacagtcgcccaccctctcctgcgagggccagtcagtagttgttagtacgtctttcttagcctggtaaccaacgaacgaaaccgtggccaaggcctacccgaggcctcctcactctactgatgactactaccgaacgacgggccacgtcggcctacgtcccgacgccgtacggttcgaaaggtcggacgtagggtcgggttcgttaggtacggtacgtacggtacctttcgtaccttaccgttaccaccgtactaccgaacgtaccgtaccgaccgtaacgacgtacccgtagtaacgttacttcgtacgtactttaggttttaacttacgttacgtcgacgtacgacgtacgtacgtacgtaacccgtgtacccttacgttccgttaaccggttcggggtaaccgggacgggtaaccggtaagggtacggtaacggtactaacggtaaaccgtagtcggtacggtcctacgacctacgtcttgtccttaccg

SEQ ID NO: 73616 - DNA, 737 bp, Homo sapiens
  misc_feature: GYAE6OF01AOJA6.49.46.E02.1.454.CMB.1.raw
  modified_base (311)..(311): a, c, t, g, unknown or other
  misc_feature (311)..(311): n is a, c, g, or t
tcagagtcgagagacacgaccggtgctcgatttagactcatctacagggaaagggggaggaactgctcagttaggacccagagggaaccatggaagccccagctcagcttctcttcctcctgctactctcggctcccagactaccaccggagaattgtgttgacacagtctccggccaccctgtctttgtctccgaggggacagtcgcccacctctcctgcagggccagtcagagtgttaagtacgtcttctagcctggtaaccaaacgacgaaaccctggaccacgggccttaccccgaggcccttaccnctattacctatggactggcctaattacccgaaaccggtacggggccctaacggtcggaccctaaccgtcccctaagggcccctaagggtttccaacggttcgggaccgtaagggttcgggtctaggtacgaacgtacggtacctttaccgaaccttccgttaccgaacctagtacccgaacggcctaccggaccctaggaccgtacccgtagtaacgtcttcggtacgtctttaagtttactacgtgtacgtacggacgtagggactacgaccttaacggccgtttaccctcgttaaccgtccggttaacgggaccgggaaccgggtaagtaacgggggacgtaaccgtaaggtaacccgaaaacgggtcgttacgggtaccggtaccgtacggtacccctaaagttccgttaccgttgttaaccc

SEQ ID NO: 73617 - DNA, 672 bp, Homo sapiens
  misc_feature: GYAE6OF01D10S8.49.46.E02.1.454.CMB.1.raw
  modified_base (217)..(217): a, c, t, g, unknown or other
  misc_feature (217)..(217): n is a, c, g, or t
  modified_base (663)..(663): a, c, t, g, unknown or other
  misc_feature (663)..(663): n is a, c, g, or t
tcagagtcgagagacacgaccggtgctcgatttagactcatctacagggaaagggggaggaactgctcagttaggacccagagggaaccatggaacgccccagctcagcttctcttcctcctgctactctcggcctcccagactacccgaccggaagaaattgtgttgacacagtcctccggccacccttgttctttgtcctccgaggggacagtcncccacccttctcctgcgacgggccagtcagtgttgttagtgtcttctacgccttacggtaaccaacgtacgaaaccgtcggaccacggccctacccgacggtcccttcctacactttactagtacggtactcgacctaacttacccgaaacggccggggtaccctacgcggacctaccgtcccaacggtccgtaggttcgaggtcggacgtagggttgggtctggtacgacgttacgtaccttacgtaccgtaccttacaaccctataccggaactcggaacgtacccgtaggtacgccgttaaggaacttcgttcgtacgttactttagttttactacgtcgtacacgcgtacgacgtacgacctacgtcgtacccttcgtacgtccggtgggaccggagacgtaggtcgagactaggaacttgcgacggctacggactatcttntacctttcg

SEQ ID NO: 73618 - DNA, 678 bp, Homo sapiens
  misc_feature: GYAE6OF01DNSJC.49.46.E02.1.454.CMB.1.raw
  modified_base (664)..(664): a, c, t, g, unknown or other
  misc_feature (664)..(664): n is a, c, g, or t
tcagagtcgagagacacgaccggtgctcgatttagactcatctacagggaaagggggaggaactgctcagttaggaccagagggaaccatggaagccccagctcagtcttctcttcctcctgctactctggctccagataccacggagtaattgtgttgacacagtctccggcctacctgttctttgtctaccggaggggacagtcgccctaccctcttccaggcgacgggccagtcaggtagttgttaggtatcttacgttacgccgtacggtaaccaacgagtaaacccgtcggccgaacgggtcctacccgacggtccttaccgtactacttcgtatggtaactcgacctaacctaccgaaccggacgggtcccaacgtcgggacctacgtcccgacggtaccgtacggttcgaggtcggactagggtgggttcagtacgaacgcgtactcactcctacgactctacgaccgctacggactaacgtacgtacgtaacggtaagtacttcgtcggtactttaacggttttactacgttgtacctaggactacggtacgtacgaacttacgcgtccttacgttacgtcggttacgggacggtaacggtacgaagggtcgaaagtacgtaacggaacgtcggttcgacgtccgttacacctacncgttccgtcttacg

SEQ ID NO: 73619 - DNA, 715 bp, Homo sapiens
  misc_feature: GYAE6OF01CO5FX.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccacctctcctgcagggccagtcagagtgttagtagcttcttagcctggtaccaacagaaacctggccaggctccgaggcctcctcatctatgatgacatccaacgacgggcccacgtcggccacgtccccagtccctagggtttcaggtcggcgtagggttcgggttctaggtcgaacgtaacggtacctttaccaccgttcctaccctaacctattaccgaacggaccctaacggtacccttaacgggacggtacccttaagggtaaacgttactttaccgtaggtactttaaacggttttttaacttaccgttcgttaccgaaggtccgaagggtccgttaacgaccgtaaccgttccgggtaccctttaccgttaccgtttaaccgggtttcccgggggaacgggtaaaccggggtaacccggtaaaggggtcgggaaacgtaaccgtaagaaaacccggttacgtcgggtacggtacgtacggacctaacacgtttccgttgttacc

SEQ ID NO: 73620 - DNA, 672 bp, Homo sapiens
  misc_feature: GYAE6OF01CC1BY.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgttctttgtctccgagggacagtgcccacctctcctcgcagggccagtcagagtgttagtagcttcttacgccgtaggtaccaacaacgaaaccgtggaccaggcctcccgacggtcctcctcatctaatgatgcatacccgaacgacgggccacgtgcacgtcccagcctaggtcaggtggcgtaggtcggtgtgtacgacgtagtaccttactaccgtactaccaacctataccgacgacgacgtaccgtagaacgtccgtaaggtataacgttcgtagtactttaagttttacttacgttcgttacgacgtacgaacggtcggtaaacgtacctaacgttcgggtacccttaccgttaccgttaaccgggtttccggggaaccggggtaacgggtaaacccggtagggtacgggaaacgtaacgttaaaccgaaacggttacgtggggtaccgtaccgtgtacccgaacctcgttacgtccggttaac

SEQ ID NO: 73621 - DNA, 717 bp, Homo sapiens
  misc_feature: GYAE6OF01BXUW7.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattggtgttgacacagtcctcccggccacccttgtctttgtcctccgaggggacagtcgcccaccctctccgtgcgagggccagtcagtagttgttagtagtcttcttacgccgtaggtaaccaaacgacgaaacctggccagggcctcccgaggtcctcctcacttctatggactcgacactccgaacgcgggacccacgtcggaccacgtccccgaaggtcccgtaaggttccgaaggttcgggaccgttaggggtcgggttcgttggtacgaaccgtaacggttaccttccgtaaaccgttcccttccgaaaccctaagtcccgaagaccgtacggtaacccgtaacggtacgtacccggttaaggtaaacgttactttccgtacgtaccgtttaacgtttttacgtaaccgtttggtaccgtacggtaccgtaggtaccgtaacgtacgtaccgtcggttaccctcgttaccgtacggtttccgggacgggtaacgggacgtagggtaggacgtaacgtacgaaacggtcgtacggtgactcgacacctagttcgtggtacc

SEQ ID NO: 73622 - DNA, 740 bp, Homo sapiens
  misc_feature: GYAE6OF01CI4SQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcagggccagtcagtagtgttagtagtcttcttacgcctaggtaccaacagaaacctggaccaggcctcccgaggtcctccgtcatctatgatgaccatcccgaaacgtacgggccctacgtcggacctacgtacccgagtccgtaggttcaaggtcggcgtagggttcgggttacgtggtacggtaacctacgtacctttcgaccttaccgtacccaaccctagtaccgacgtaccgaaccgtacccgtaaggaccgttacccgtaaggtaacgttaccgtttacgtagtaccgttttaaggtttttaacttaccggtgttaccgacggtcgaacgtcgtaacgtacgtaaccggttcgtacccgtttacgtaccggttaccggttacggggaccgggtacgggtaaacccggtaaggggtacggtaaacggtaaccgttaaccggaaaaccggttacggttacgggtaccgggtactaccggacccgttaacctacggttttccgttacggttaccccg

SEQ ID NO: 73623 - DNA, 663 bp, Homo sapiens
  misc_feature: GYAE6OF01BF9BN.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagtaaattgtgttgacacagtcctccggccaccctgtctttcgtcctccgaggggactaggtcgcccaccctctcctggaccgacgggccagtcgaggtagttgttagtacgtcttacttagccgttacggtacctaaacgacgtaaaccgtcggacccaggtccctacccgaggtcccttacctctatctatgactcgacactaccgacggaccggcctacgtcggacctaccgtacccgacgtaccgtaggttacacgggtcggacgtggtcgggtcgtggacgacgtacgtaccttaccgacttctaccacgtactaccgactaccgacgtactaacggctacggtaagtaacgttcttagaccgttgtttaactttacgacgttcgacgacgtagtaaccgtgtaacacgtacgccgttacctcgtacgttacggtcgggaacggtacgaacgtcgggagacgtacaacggtaacggctcggtcgacctgacctactacgtcgtcttacc

SEQ ID NO: 73624 - DNA, 744 bp, Homo sapiens
  misc_feature: GYAE6OF01CWBG0.49.46.E02.1.454.CMB.1.raw
  modified_base (709)..(709): a, c, t, g, unknown or other
  misc_feature (709)..(709): n is a, c, g, or t
  modified_base (735)..(735): a, c, t, g, unknown or other
  misc_feature (735)..(735): n is a, c, g, or t
tcagagtcgagagacacgaccggtgctcgatttagactcatctacagggaaagggggaggaactgctcagttaggacccagagggaaccatggaacgccccagctcagcttctcttcctcctgctactctggcctccagactaccaccggagtaaattgtgttgacacagtctccggcctacctgtcttgtctccgagggacagtcgccctacctctccgtgcgacgggccagtacaggtagttgttagtagtcttcgttacgccgttacggtaaccaaacgaacgtaaacccgtcggcccgtaacgggtccctaccgtaacggtccttacctactagtacctagtaggtaactcgacctaactacccgaaacgaccggtaccaacggtcgacaccgtacccgaggtacctaagggttccaagggtcggaacgttcggggtcgggtacgttacggtacgaccttaacggtactttaccacctttaccgacctaacctaacgtcgaacggcctaacggtaccggtttaacggacgttacccgtaggaaaccgttaacgtttccggttaaggtaccctttaaggtttttaactaccggtagtaccgaggtacaacgggtacgtacgaacgtacgttcgtaccttgtacgtccggttagggaccggtaagtaaccggaggtagaaggtacgaaaccgtaacggtcggtacgnggtccctaaggaccctaagtccgttnaccgttccg

SEQ ID NO: 73625 - DNA, 886 bp, Homo sapiens
  misc_feature: GYAE6OF01DO62C.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagactaccaccggagaaattgtgttgacacagtctccggccacctgtctttgtcctccgagggacagtcgccaccctctcctgcacgggccaggtcagtagttcgttagtagtcttactttagcccgttaggtaaccccaaacgaaacgaaaacccgttcgggaccctaacgggccctacccgacggtccttacccttaccacttccgttagtgtaacgttacgcctaaccgttacccgaaaccgaaccggggacccctaacgttaccgggacctaaccggttacccccaacggccccgtaaagggtttccgaagggttcggaaccgtagggttcggggttacgttggtacgtaacgacgttaccgttacctacctcctaccaaccacttacgaccggaccacgtacccgttaaggacgtacccgtaaggtaaacgttacgttaccgttcggtaaccgtttaggtttttaacctttaacgttacgttacccgtaacggtaccgttacgggtaaccggttaaccgtaaccgtaaacccgttccgggtacccctttaccggtttaaccccgttacccgggttttacccggggaaccgggggttaaacgggtaaccccgggtaaagggggttaaccgggtaaacggtaaccgttaaacccgggaaaaaccggttaacggttacggggtaacccgggtttaccgtaacccggtaccctaaaccccgttaacgtttccgtttacccggtttaaccc

SEQ ID NO: 73626 - DNA, 718 bp, Homo sapiens
  misc_feature: GYAE6OF01BAWN8.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgcccacctctcctgcacgggccagtcagagtgttagtagtcttcttagcctaggtaccaaacgacgaaacctggaccaggcctaccgaggcctcctacatctatgatcgacactaccaacgcgggaccaacgtcggactacctcccgacgtaccgtaggtttccgaaggttcgggacgtaggggttcgggttcctggttacgaacgtacgttaccgtttaccaccgttccttaccaacctacgttaccgaacgtacgtacggtaccgtaacggtaaccgtacccgtaacgtaacgttaacgttaccgttacgttacgtttacgtttaacttacgttcgtaaaaacgtcgtacgtacgtaccggtaacgtacgtacgtaccgtaccgttaccgttaccgttaccggttaccgggtaccgggtaaccgggtaacggtaacgggtacggtaacggtacgtaacgtaacggtaacgtacggtacggtacgtacgacgtaccgtacgtcgtcgttaccg

SEQ ID NO: 73627 - DNA, 583 bp, Homo sapiens
  misc_feature: GYAE6OF01DQ3HH.49.46.E02.1.454.CMB.1.raw
  modified_base (260)..(260): a, c, t, g, unknown or other
  misc_feature (260)..(260): n is a, c, g, or t
  modified_base (456)..(456): a, c, t, g, unknown or other
  misc_feature (456)..(456): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcttagcctggtaccaanagaaacctggccaggctcccaggctcctcatctatgatgcatccaacgagggccacgtggcactcccagccaggttcagtgcaggtgggtctgtgacagtcttcactcctcacctatacagcaacgccctaaggactcctagaacgtattcgtgtacttagttttacttacgtgttccgaagtcacggtcggtaanaccgtaacgtccggtccttacgttcgtaaccggtttcgggcgggaacgggtaccgtaagggtcggaagtaacgtaacgaaacgtacgtaggtcgggtaccttcggaactacctattcgtgttaaccc

SEQ ID NO: 73628 - DNA, 554 bp, Homo sapiens
  misc_feature: GYAE6OF01COGQF.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatccccagccaggttcagtcggcagtgggtctgtgactagactttcacgtctacgacctatcacgctacgcctagacgacctagaagtattctgactagtttattacgtgtcagcagcgtagacaacgtcgtcctctctacgtttcggacggtacgggtaccgaggtacggagtacgtacgaaacggtacgtacggtcggacgttacggacctaccgtacttcgtcgttacccg

SEQ ID NO: 73629 - DNA, 737 bp, Homo sapiens
  misc_feature: GYAE6OF01AEFYD.49.46.E02.1.454.CMB.1.raw
  modified_base (231)..(231): a, c, t, g, unknown or other
  misc_feature (231)..(231): n is a, c, g, or t
  modified_base (694)..(694): a, c, t, g, unknown or other
  misc_feature (694)..(694): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagaattgtgttgacacagtctccggccaccctgtcttgctccgagggacagtcgcccaccctctcctgcaggccagtcaggngtgttagtagtcttctacgccgtacggtaaccaacgacgaaacctcggaccgacggtccctacccgaggcccttcctacctattcctaagtcgaactcgaccgtacctacccgaacgtaccggggaccctacgtcgggaccctaccgtaccccacggtccctaacgggttccgaagggtccggtacggtaggggttcggggttactaggttaccgaacttaaccggtccttacgtcctacctccgtaaaccctgtaccgaacgtacgtaccgtacccgtaacggaccgtaccgtagtaaacgttctttacggtacttaccgtttaagtttacgtttacgacgtcgtaacgtacggtacgtaccgtagaccgttacccgttcgtaccccgttcgttacccggtaacgggttccgggaacgggaccggtaccggtagggacggtaactaaccggtaactaacggnttacggaacggtcctacggtacccatcgttccgtacggttccc

SEQ ID NO: 73630 - DNA, 682 bp, Homo sapiens
  misc_feature: GYAE6OF01CYTEF.49.46.E02.1.454.CMB.1.raw
  modified_base (221)..(221): a, c, t, g, unknown or other
  misc_feature (221)..(221): n is a, c, g, or t
  modified_base (420)..(420): a, c, t, g, unknown or other
  misc_feature (420)..(420): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctcccggccaccctgttctttgtctccgaggggacagtcgcccacctctccngcaggccagtcagagttgttagtacgtcttcttagcctaggtaccaacagaaaccgtcggaccacggcctacccgaggcctcctacatctatcgatcgacactaccgaagcggaccctacgtgacctactcccgagtccgtaggttcaggtcggacgtagggttcgggttcgtacggtacgaacgtacgtaccttaccnccttactaccgaacctacgtacgactacgtacgtacccgtaggaccgtaccgtaagtaacgttactttcgtacgtactttaagttttaactacgtgtaaccaggtacgtacgtacgtaacgtacctaaccggttcggccctttacgtacgttaccgggttcgggacggggtaaccgtagggtacgggtgaacgtaacgtaaccgtaaacggttacggtacgggtacgtcgtaccgactaccgttacgtctttcggttaaccc

SEQ ID NO: 73631 - DNA, 708 bp, Homo sapiens
  misc_feature: GYAE6OF01CFW7Z.49.46.E02.1.454.CMB.1.raw
tcagagtcgagagacacgaccggtgctcgatttagactcatctacaggggaaagggggaggaactgctcagttaggacccagagggaaccatggaagccccagcctcagtccttctccttcctcctgccttactcgtcggcctcccgaagactacccgacgggaagtaaagtttggtgttacgaaccacgtacggttcccgtcccggtccctacccttggtttccttttcggtaccctacccgggaaggggggtaacctaggtccgaccccctaccccttcgtccgtggaccggacgggccaggtacaggtagttagttacggtacgtcctttacgttacggccgttacggaaacccaaacgaacgtaaaccctcggaccgacggtccctacccgacgtccctcctatactctagtcgtatcgacctaactaccgaaacgtcgggccctacgtcggacctaccgtcccgacgtcctacgggtgtacggtcggacgtggttcggtctggacgactacgtcctcaccttcacacatcgacgctacgtacgtacgacgtccgtaagacgtcttacgtacgtactttagtttactcgtactacgcgtacagtcagtactacgtcgtcctacgtcgttcggttacggacggtacggacgtagggagtacgaactacgaacttggcgtaggctacgactactatccgttagtcc

SEQ ID NO: 73632 - DNA, 558 bp, Homo sapiens
  misc_feature: GYAE6OF01A22BF.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggcctcctcatctatgatgcatccaacaggccacgtggcatcccagcctaggttcaggtggcaggtgggtctggtgacagtactcactctcaccatcagcacgcctagacgtcctagaagtacttctgtacttagtttacgtacttgtcagtcgagtcgtacgctaacgtcggtccttctcgtaccttcgggacggtacggaccgaaagggtcggaagtacgtacgaaacggtacgtggtaggtccgtacgaccgaaccagttccgtcgttaccc

SEQ ID NO: 73633 - DNA, 610 bp, Homo sapiens
  misc_feature: GYAE6OF01APDB7.49.46.E02.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (232)..(232): a, c, t, g, unknown or other
  misc_feature (232)..(232): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacngtcgcccacctcncctgcagggccagtcagngtgttagtagcttcttagcctggtaccaacagaaacctggaccaggcctcccaggcctcctcatcctatgatgcatccgaacaggcacgtggccactcccacgtccaggttcacgtggcgtaggtgggtctgtcgactacggacttcaccgtctccaccgatcgaacgcgacgcctaaggcgaccgtagaagtacgttctacgtacttaagttttacttacgtgtacctaggtactaggtacgtacgaacctacgtccgtaccctcgttaccgtacgtttcgggcggtaaccgggtacgaggtacggtacgtactaacccggtaaacggacgtaggttacggccgtacgtacccgtagtccttcgttcgtttaccccg

SEQ ID NO: 73634 - DNA, 629 bp, Homo sapiens
  misc_feature: GYAE6OF01CP49J.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagctttcttagcctggtaccaacgagaaacctggccaggcctcccgaggcctcctcatctatgatcgcactaccaacgcgggcccagtcggccactcccgaagcctagggttcaggttcggctagggtcgggtctggtacgacaggtaccttcacctctaccacctatcgagcaacgccgtaaggacgccttaggaaacttatttccaggtacttaaggttttacttacgtgtcctaggctagggacgtacgaccgaacgttcgtccttcgtacctacgggtttccgggacgggtaacgggaccgaaaggggtcggaaacgtacgtaaccgaaaacggtaacgtcgggtacggtaccgtacggaccctacgtacttccgttacgttccc

SEQ ID NO: 73635 - DNA, 628 bp, Homo sapiens
  misc_feature: GYAE6OF01B3ESZ.49.46.E02.1.454.CMB.1.raw
  modified_base (340)..(340): a, c, t, g, unknown or other
  misc_feature (340)..(340): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaacctggccaggctcccaggctcctcatctatgatgcatccaacacgggccactcggcactcccagccaggttcagnggcagtggtctgtgacagacttcacttctacacatcagcacgcctagacgcctagaagtatttcgtagtacttagttttaacttacgttggtactagactaagttaagttaacgtcgggttccccgggtaccttacccgggtaccttacccggttttccggggacggggtaacggggtaacccgtaaggggtcgggaaacgtacgttaaccggtaaaaccgtaacggttggtaccgggtacctacggtaccctaacccgtaagtttcccgttggttaccctttacccg

SEQ ID NO: 73636 - DNA, 598 bp, Homo sapiens
  misc_feature: GYAE6OF01CEW3X.49.46.E02.1.454.CMB.1.raw
  modified_base (434)..(434): a, c, t, g, unknown or other
  misc_feature (434)..(434): n is a, c, g, or t
  modified_base (585)..(585): a, c, t, g, unknown or other
  misc_feature (585)..(585): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcagggccagtcagagtgttagtagcttcttagcctggtaccaacagaaacctggccaggcctcccgaggcctcctcatctatgatgcatccaaacgcgggcccacgtggccatccccgagccctaggttcaggtcggctagggtgggttctggtacgactagtacctttcaccttcctaccaccatcacgcacgcctagacgtcctagaacgtnttcagtacttaagttttataccgtgtacagcgaagtcgtaagacctacgtcggtcccttcgtccgtaccgtttcggggaccggtacgggaccgaaaggggtggaacgactaacgaaacggtacgtcgggtacggtcgtacggacctacctnttccgtgttaccg

SEQ ID NO: 73637 - DNA, 728 bp, Homo sapiens
  misc_feature: GYAE6OF01CBIOY.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctccagataccaccggagaaattgtgttgacacagtctccggccacctgtctttgtctccgagggacagtcgcccacctctcctgcgagggccagtcagagtgttagtagtcttcttacgccgtaggtaaccaaacgagtaaaccgtggacctaggcctccgaaggtccttccctacattcctatggtaactcgactacgtaccgaaacgacgggaccctagtcggacctaacgtccccgaaggtcccgtaaggttccgaaggttcggacgtaaggttcggggtactaggtacgaacgtacggtaccttcacgttcctacaaacccgtatacgacgacgtacgacctaagacgtaccgtaagacgtaattcgtacgtacgtttaggttttaactaccgttaggtactaacgacgtaaggtacgttacgaactaaccgttccgggtaccccttgaccgtttaaccgggttcggggaaccggtaaccggggtaaccgtaaaggggtacggaacgtaaaccgttaaccggaaaaggttacccgtgggtaacggtcctaaccggtaaccctaacgttaacctttcggtacgtttaacccg

SEQ ID NO: 73638 - DNA, 735 bp, Homo sapiens
  misc_feature: GYAE6OF01BP0TN.49.46.E02.1.454.CMB.1.raw
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (361)..(361): a, c, t, g, unknown or other
  misc_feature (361)..(361): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagccttnttagcctggtaccaanagaaacctggccaggctcccaggctcctcactctaatgatgcataccaactagggaccacgtggcactcccagcctaggttcagtggcagtggtctgngacgagtacttcactctcaaccatcagcacgccgtaagacgacccttagaaacgtactttcgtacgacttaaaggttttaacttacgttacggttacaacggtactaacgggtaccggttaacggtaacctaaaccggtttccgggacccttttacccgtaaccgtttaacccggggttttaccggggaacccgggggttaaaccgggggtaaaccccggtaaaaggggggttaccggggtaaaacggtaaacccgtttaaaccgggaaaaaacccgggttaaaccgttacggggttaacggggtaccccttttacggggaaaccccccggttaaaccctaaacggtttcccgtttacgggttttaaacccccg

SEQ ID NO: 73639 - DNA, 694 bp, Homo sapiens
  misc_feature: GYAE6OF01DU20I.49.46.E02.1.454.CMB.1.raw
  modified_base (358)..(358): a, c, t, g, unknown or other
  misc_feature (358)..(358): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccacctctcctgcagggccagtcagagttgttagtagcttcttagcctggtaccaaacagaaacctggacccaggctcccaggctcctcatctatgatgcatccaacgaggcccatcggacactcccagccaggttcagtgcagtggtctgtnacagtacttcactctaccaactactcgaacgtcgacgacccttaggactccgttaagaaatacgtttctaggtaccttaggtttttaactttacgtaggtttaccaggttacgagtacggtaacgtacctaaaccggtttcgggtaccccttccgttaccgttaaccgggtttttacccggggaccggggtaaacccggggtaaaccggtaaaacgggggttacggggtaaacggtaaaccggttaaaccggaaaaacccgggtttaacgttacgggtacgggtaccgtttacggaaccccgttaacctaacgtttcccgttgggttttaaacccc

SEQ ID NO: 73640 - DNA, 646 bp, Homo sapiens
  misc_feature: GYAE6OF01DBVY3.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctccgtgcagggccagtcagagtgttagtagcttcttagcctggtaccaacagaaacctggccaggctccaggctcctcatctatgatgacactccgaacgacgggccacgtcggccaactcccgaagccgtaaggttcaggtcggctaggttcgggtctgtcgtaacacggtactttcaccgttctaccacctacgtcaacgccgtaacgtccctaacgacgtcccgttaagaacgttacttcgtacgtacttaacgttttacgttaccgtcgttacgcggtacgacgtcggtaacgactaacgtccggtccgtactaccgttacggtttaccgggacgggtaacgggtaaccggtagggtacggtaacgtaacgtacgtaaaacgtcgttaggtcggaccgtacgaccgaccttacgtcgttcggttacc

SEQ ID NO: 73641 - DNA, 748 bp, Homo sapiens
  misc_feature: GYAE6OF01AOO8X.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagaaattgtgttgacacagtcctccgcctacctgtctttgtcctccgagggacagtcgcccaccctctcctgcgtacgggcacgtcagtagtgttagtacgtctttctagccttggtaaccaacgagtaaaccctgggacccacggcctacccgaggtccctcctactactcttagtcgagtcgcactaccgaacgacggcctacgtacggcctactcccacggtaccgtagttccgaggtcggacgaggttcgggtctggtcgaccgtaaggttacctaccgtctcccgtacctaccgtatcgtaacgaccgtaccgtaccggtacgtaacgtcccgtagtaaacgtaccgtttacttccgggtactttaacggttttaactttaccgttcggtaaccttacggggtaccttagggtaccgttagggtaccctaaccggttcggtcccctttaccggtacctttccgggtaccgggtaccgggtaaccggggaaaccgttacggggttcggaaaccgtacggtaacccgtaaaacggtcgttacccggggaagtccgttaccgaccgtaacccggttctttacccgttgttaaccccg

SEQ ID NO: 73642 - DNA, 654 bp, Homo sapiens
  misc_feature: GYAE6OF01DU4MR.49.46.E02.1.454.CMB.1.raw
  modified_base (644)..(644): a, c, t, g, unknown or other
  misc_feature (644)..(644): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccgaccggagaaattgtgttgacacagtctccggccaccctgtcttgtctccgaggggacagtcgcccaccctctcctgcgacgggccagtcgagtagttgttagtagtctttctagcctggtaaccaacagaaacctggaccaggcctcccgaggcctcctcatctatgtatcgactactacccgaacggacggggaccctaacggtcggacctaaccgttacccccgaagtaccccgtaaggggtttaccaggggtcggtacgtaggggtttcgggtaccgttaggtacgaccgtaacggtacctttaccgacctttaccctacccgtaacctaacgttaccaagtacccgtaaccgtacccggtaagaccgtaccgttaagaacgttattcgtagtactttagtttactcgtgtacagtcagtcgtaagcctaacgtcgtcctctctacggtcggaggacggacaggtgagtacgtacgaaggctggtcgactcgacacngtctgttacc

SEQ ID NO: 73643 - DNA, 648 bp, Homo sapiens
  misc_feature: GYAE6OF01C3NJ4.49.46.E02.1.454.CMB.1.raw
  modified_base (401)..(401): a, c, t, g, unknown or other
  misc_feature (401)..(401): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgttctttgtctccgaggggacagtcgcccaccctctcctgcagggccagtcagtagtgttagtagtcttcttagcctaggtaccaacgagaaacctcggaccaggcctcccaggcctcctcatactatgatgctaataccaacgacgggacccacgtggccactcccgagccgtaacggttcaggtcgcgtaggtcgggtctgtcgacgtagtacttacncttcaccaacatacgagcaacgcctaaggactactagaacgtacttcgtgtacttaagtttacttacgtcgtacgtacggactaggtacgtaacgtaccgtaaccgttccgggtacccttccgttaccgttaccgggtttccggacggggtaaccgggtaacggacggggttagaacggtaaacgtaccggaaaacggtcgtacggttacggccgtacgacccgtacctacgttcgttcgttaaccc

SEQ ID NO: 73644 - DNA, 586 bp, Homo sapiens
  misc_feature: GYAE6OF01EOZCP.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagtcttcttagcctggtaaccaacagaaacctggccaggcctcccaggctcctcatctatgatgcatccaacagggcccacgtggcactcccagccaggttcagtggcaggtgggtctgtgacagtacttcactctcaccatcagcacgcctagacgcctagaagtacttctgactagtttattactgtcagcagtcgtagactaacgtcggtcctcgtctacggtttaccgggacgggtaacgggaacccgtaaagggtcgggtaacgtaacgtaacggaaaaccggtaacgttacgggtacggaccgttacggaccctaacccgtacgttcccgttgtttacccg

SEQ ID NO: 73645 - DNA, 657 bp, Homo sapiens
  misc_feature: GYAE6OF01B8HYC.49.46.E02.1.454.CMB.1.raw
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (418)..(418): a, c, t, g, unknown or other
  misc_feature (418)..(418): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagcttctagcctggtaccaacagaaacctggccaggctcccaggctcctnatctangatgcatccaacgngggccacgtggcactcccagcctaggttcaggtggctaggtggtctggtgacagtaccttcactcctacacctatcagcagtacctaggactaccgtaggaaacgtntttccgtagtacttaaggttttaacttacgtacgttacacgtcgtaacgtacggttaacgacctaaccggtccgggtcccttacgttacccgttaccgttttaccggggaaccgggtacggggtaaccggtaaaggggttacgggtaaacgtaacgtaacccggtaaaaacggttaccggtcgggttaacggtccggttacggacccctaaccgttacgtttccgttcggtttaacccg

SEQ ID NO: 73646 - DNA, 679 bp, Homo sapiens
  misc_feature: GYAE6OF01BDEY6.49.46.E02.1.454.CMB.1.raw
  modified_base (294)..(294): a, c, t, g, unknown or other
  misc_feature (294)..(294): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccgaggggacagtcgcccaccctctcctgcagggccagtcagagtgttagtagctttctagcctggtaccaacagaacctggccaggcctcccgaggcctcctnatctatgtatcgcactccgaacgacgggccacgtggacactccccgaagccctaaggttcaggtcggactagggttcggtctgtcgacgagtacctttcactccctacgaccctataccgaacgtccgtaacggtacccgtaagaccggtacccgtaaggtaaaccgttacgtttaccgtacgtaccgttttaaagttttacgttaccggttcgtaaccgacgtaacggtaacggtcccggttaagaccctaaccggttcccggtaccctttccgtacgttaccgggttaccgggaaccgggacgggaaccgtagggtcggaaacgtactaaccgaaacggtactcgggtacgccgttcggaactaccgtgttacgtcgttaccg

SEQ ID NO: 73647 - DNA, 688 bp, Homo sapiens
  misc_feature: GYAE6OF01A59Q5.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagaaattgtgttgacacagtctccggccaccctgtcttgtctccgaggggacagtgcccaccctctccgtgcagggccagtcagtagtgttagtagtcttcttagcctaggtaccaacaacgaaacctggaccaggtcctacccgagtcctcctactagtcctatgattgactactaccgaaccgcggccacgtcggactaccgtccccagaccccgtaggtttacccgagttaccgggcgtaagggttcgggtctaggtacgacccgtaagtacccttactaccgtcctaccgtaacctatacgactacgacgtaccgtacgtacgtaccgtaggtaattacgttcgttacgtacgttacgtttaacttacgtagttacgtacgtccgtacgtacgtacgtaccgtacgtccggttaccctcgttaccgtaccggtttaccggacgggtaccgggtaacgtacgggtagtacggtactaaacggtaaccgtaacggtaggtaccggtactacgtaccgtactacgtcgttcgttaccg

SEQ ID NO: 73648 - DNA, 675 bp, Homo sapiens
  misc_feature: GYAE6OF01CFXQS.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctgctccagataccaccggagaaattgtgttgacacagtctccggccaccctgttctttgtctccgaggggacagtgcccacctctcctgcagggccagtcagtagtgttagtagctttcttagcctaggtaccaacgacgaaaccgtggaccgacggcctcccaggcctcctcatctatgatgcatccaacgacgggacccacgtggaccactccccgagccgtaggttccaggtgacgtaggttgggtctggtacgaccgagtacttctacctctactaccactcgacgtcacggtacctagactaccgtaagtaagtactttacgtcgttaacgttagttttaacgtttacgtcggttacctaggtacgtaacggttcgtaacggaccttaacgtccggtacccttccgttaccgttacgggttccgggaaccgggttacggggaaaccgttaggggtaccggtaaaggtaccgtaaaccggtaaaaccggtagttccgggtattaccggtacgaaccctacgttacgtttcgtccggtttaccc

SEQ ID NO: 73649 - DNA, 626 bp, Homo sapiens
  misc_feature: GYAE6OF01D5UKY.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctccctgctactctggctcccagataccaccggagaaattgtgttgacacagtctccggccaccctgtctttgtctccaggggacagtgccacctctcctgcagggccagtcagagtgttagtagcttcttagcctggtaccaacagaaacctggaccaggctcccaggcctcctcatctatgatgcataccaacagggccacgtggcacgtcccagcctaaggttcaggtggcgaggtcggtctggtgactagaccttcactctcaacctatcagcacgacccgtagacgacctagtaagtactttcgtacgtacttaacgtttttaactacgttcgtacgtagacctagggtacgttaagaccgttaaccgttccggtacccttaccgtttaccgtaccggttttcggggaaccggggttaacggggaaaccctaggggtacgaacgtaacgtaaccgaaacggtaccgtaggtcggacgttcgacccgtactacgttcgtcgttacc

SEQ ID NO: 73650 - DNA, 602 bp, Homo sapiens
  misc_feature: GYAE6OF01D9PSK.49.46.E02.1.454.CMB.1.raw
  modified_base (570)..(570): a, c, t, g, unknown or other
  misc_feature (570)..(570): n is a, c, g, or t
  modified_base (595)..(595): a, c, t, g, unknown or other
  misc_feature (595)..(595): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcagggccagtcagtagtgttagtagtcttcttagcctaggtaaccaacagaaacctggccaggcctcccgaggtcctacctcacttctatgatgacataccaacgcgggccacgtcggctaactcccgagccgtaggttcagtggcgtaggtcgggtctgtcgacgtaacgtctcactctaccactatcagcacgcctaagcgtacctagaatacttgtacgtacttaaggttttactacgtggtcagcgtaggtcgtaacgtcctaacgtcggtaccttcgtacgttaccggttcgggacggtacgggaaccgtagggcggaagtaaccgtaacgaacggtacgtcggngactcgaacctaccgtattccgttnttacccg

SEQ ID NO: 73651 - DNA, 648 bp, Homo sapiens
  misc_feature: GYAE6OF01EHU6R.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtcctccgaccaccctgtctttgtctccgaggggacagtcgcccaccctctcctgcgagggccagtcagtagtgttagtagtcttctagcctaggtaaccaacacgaaacctggcccaggccctcccgaggtcctcctcattctatgtatgccactaccgaacgacgggcctacgtcggactacctcccgagtcccgtagggttcaggtggcgtagggttcgggtctggtacgacgtacgtaccttcactcctaccaccatcgacgtccacgtaccctagaccgtaccgtagaacgtacttcgagtactttacgtttattaccgtgtcagtacgaggtacgtacgactacgtcgtaccttctaccgttacggttccgggaccggtaagggtacccgtaaggggtacggaacgtaacgtaacggaaacgtaccggttggtacggtaccgttacggacctaaccctacgttccgttcgttaccc

SEQ ID NO: 73652 - DNA, 730 bp, Homo sapiens
  misc_feature: GYAE6OF01C6RVG.49.46.E02.1.454.CMB.1.raw
  modified_base (234)..(234): a, c, t, g, unknown or other
  misc_feature (234)..(234): n is a, c, g, or t
tcagagtcgagagacacgaccggtgctcgatttagactcatctacaggggaaaggggggaggaactgctcagttaggacccagagggaaccatggaagccccagctcagcttctcttcctcctgctactctggcctcccagactacccgaccggagtaaattgtgttgacacagtcctccggccacccttgttctttgtcctccgaggggactaggtcgccctaccctctccgngcgacgggccagtcaggtagtgttagtgtcttctagcctcggtaaccaacgacgaaaccgtcggccaggtccctccgacggtcctccctctattcctattgatcgaccactaccgaacgacgggcctaacgtcggactaccgtcccgaagtccgtagggtttccagggttcggcggttaaggggtcgggttcgtaggtacgtactacggttaccttcgaccttccctacaaccctagtaccgacgacgtaaccgtcctaagggctacccgtaaaggaacttcgttactggttaacttacgttttactacgtgtacacgtacggacgtacgttacgaatacccggttcgtaccccgtttctcggttaccgggttacggggacccggggtaacgggtaaccggtaaggggtacggtaacgtaaacggtaaacccgtaaaggttccgggagggttccgtacgccgtaaccaccggttcttcggtttacgtttacccccg

SEQ ID NO: 73653 - DNA, 585 bp, Homo sapiens
  misc_feature: GYAE6OF01CNA7F.49.46.E02.1.454.CMB.1.raw
  modified_base (303)..(303): a, c, t, g, unknown or other
  misc_feature (303)..(303): n is a, c, g, or t
  modified_base (416)..(416): a, c, t, g, unknown or other
  misc_feature (416)..(416): n is a, c, g, or t
  modified_base (559)..(559): a, c, t, g, unknown or other
  misc_feature (559)..(559): n is a, c, g, or t
  modified_base (565)..(565): a, c, t, g, unknown or other
  misc_feature (565)..(565): n is a, c, g, or t
  modified_base (582)..(582): a, c, t, g, unknown or other
  misc_feature (582)..(582): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaattgtgttgacacagtctccggccacctgtctttgtctccgaggggacagtcgccaccctctcctgcagggccagtcagagttgttagtagtctttctacgcctacggtaccaacgaagaaacctggaccacggcctacccgaggtcctcctntactactatgatgactactaccgaacgacggccacgtggactactcccgagcgtacggttcagtcgcgagggttggtctggtacgacgtacgtaccttcactctaccaacctntacgacgcctacgtaccgtaagacgtctaagaactagttctaggttcttaagttttactaccgtgttacgacgtcaaggtcgtacgactacgtcgtctctcgtcggtacggacggtagacgtaggtgactaagaccgaaggtntcggcncgtacactactatcgtnttc

SEQ ID NO: 73654 - DNA, 755 bp, Homo sapiens
  misc_feature: GYAE6OF01A8CZB.49.46.E02.1.454.CMB.1.raw
  modified_base (715)..(715): a, c, t, g, unknown or other
  misc_feature (715)..(715): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagaaattgtgttgacacagtctccggccaccctgtctttgtctccgaggggacagtcgcccaccgtctccgtgcgagggccagtccgagtagtgttagtagtcttctacgccgtaggtaaccaaacgaacgtaaacccgtggacccgaaggtcccttacccgaaggtccttccgtactaactccgttaatcggatcgacctacgtacccgaaacgacgggcctaacggcggacctacgtaccccacggtcccgtaaaggttcagggtcggactagggtcggttcgtgtacggactacggtacctttcaccgttctaccgtaaactctacgacgtaccgaacggtccgtaagtaccggtaccttaagggtaaacttcgtttaccgttacggaacctttaagtttttaaccgtaaacctttcggaactaacggtttacaacgggttaccgggttaacaccgttaaacccggtcggttaccccttaccgttaccggttaccggttacggggtacccgggaacggttaaacggtacgggtacgaaggtaactaccggaaacgttacgggngtacccgaggtaccacgtacgtcgttggtcccgtttaccg

SEQ ID NO: 73655 - DNA, 806 bp, Homo sapiens
  misc_feature: GYAE6OF01BSO6Z.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaattgtgttgacacagtctccggccaccctgtctttgtctccgaggggacagtcgcccaccctctcctgcagggccagtcagtagttgttagtagtcttcttacgcctaggtaaccaacgacgtaaacctggccacggtcctaccccgaggtccctccctactacttaccgtatacggtattcgacctaacgttaccccgaaacggtacggggtaccctacggttacgggaccctaccttacccccgacggtcccgtaacgggtttccaacgggtcggggacgtacggggttcggggttcctaggttacggaaccgtacggtttaacccttccgtaacccgttacccttaaccgaaacccgtaacttaccggaacggtaccgtaaccggtacccgtaacggtaccggtaaccgttaacggtaaacgttactttccgtacggtacctttaaacggtttttaacttacgttcggtacgaccgtcgtaacgtcgttaacgtaccctaacggttccgtacccgttacttacccggttaccgggttcggggtaaccgggtacgggtaaaccgtacgggtacggtaaacgtaacgttaaccggaaacggtacggtacggtccggtacgttaccgacctaaccgtcgttccgttcgttacccg

SEQ ID NO: 73656 - DNA, 693 bp, Homo sapiens
  misc_feature: GYAE6OF01CYCYY.49.46.E02.1.454.CMB.1.raw
  modified_base (198)..(198): a, c, t, g, unknown or other
  misc_feature (198)..(198): n is a, c, g, or t
  modified_base (521)..(521): a, c, t, g, unknown or other
  misc_feature (521)..(521): n is a, c, g, or t
  modified_base (578)..(578): a, c, t, g, unknown or other
  misc_feature (578)..(578): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtcctccggccacctgtcttgctccagggacngtgccacctctcctgcacgggccagtcagagttgttagtagctttctagcctaggtaccaaacgagaaacctgaccaggctccgaggctcctcatctatgatgactactaccaaacgacgggcccaacgtcggaccactccccgagtccgtaggttccaaggttcggccgtaagggttcggttcgtggtacgaaacgtacggtaacctttcgaacttccgtaccaaacctataccgaagcccgtaaacgtcccgttaaggaccgtaccgtttagaaaaccggttacttttaccgacggttacttacgttttaaacgtttaacncgggtttaccaacggtacctaagggcccgttaaagaccgtaaccggtcgtacccgtnttaccgtaccggtttcggaacgggtaacggtaacctaagggtaggaactacgtaaaccgtaacgaacgtttcgggacgaccgttcgaaccctaaccgaatttccggtattacccg

SEQ ID NO: 73657 - DNA, 638 bp, Homo sapiens
  misc_feature: GYAE6OF01C1W8I.49.46.E02.1.454.CMB.1.raw
  modified_base (295)..(295): a, c, t, g, unknown or other
  misc_feature (295)..(295): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacccttgtctttgtctccaggggacagtcgcccaccctctcctgcagggccagtcagagtgttagtagcttcttagcctaggtaccaacagaaacctggccaggcctcccaggctcctnatctatgatgcatccaacgcggacccagtcggcaacgtccccaagccctaggttccaggtcggacgtagggtcgggtcttggtagacaacggtacctttcgacctactccgaaccagtccacgtacctacgtacccgtaagaccggccgttaagaacgttacttccgtagtcttaaggttttacttaccgtgttcgaacagacggtacgtaacgactaaccggttggtccttccttacgtaccggtttcgggacgggacgggtaacgaaaggggtgaacgtaacgtaccgaaaacgtacggttcggtggtaccgagtaccctaacgtacgttcgtcgttaccg

SEQ ID NO: 73658 - DNA, 852 bp, Homo sapiens
  misc_feature: GYAE6OF01EU6BR.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctcgcgacgggccagtcagtagtgttagtagtcttcttacgccgttaggtaacccaaacgaacgaaaacccgttcggacccgaaggcccttacccccgaagggtcccttacccgttacaacgtttacccgttaagttacggtaactcggacctaaccgtttaaccccgaaaaccggtaaccgggggtacccctaaccgttccggggacctaacccgtacccccgaacgggtaccccgttaacggggtttacgacgggttcgggaccgtaggggtttcgggtacgttaggtacgtaaccgtaggttaaccttcgtaacctttcctacccgaacctacgttaccgaacgtcgtaaccgtaccgtaaggaccgtaccgtagtaacgttacgtttccgtaagttacctttaaggttttactacggttcgtacgtacgtaccggtagaccggttaaccgaccgttaaccgtcccgggtaccttaccgttaccgttacccggtttacggggaacgggtaaaccgggtaacggtaacggggttacggaacggttaaccgtaaaccggtaaacggttaccggtagggtacccgggtactaacccggtaccgttaactaccgtttcccgtcgggtttaaacccc

SEQ ID NO: 73659 - DNA, 672 bp, Homo sapiens
  misc_feature: GYAE6OF01B0DFQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctccagataccaccggagaaattgtgttgacacagtctccggccaccctgtctttgtctccgaggggacagtcgccaccctctcctgcagggccagtcagagtgttagtagctttctacgcctaggtaaccaacgaacgtaaaccgtcggaccaggcctcccgaggtcctcctcattctatgatgacactaccaacgcgggccacgtggacctacgtcccacgccgtaggttccaggtcgacgtgggtcggtacgtggtacgactacgtaccttcaccttcacctacctatcacgtacaccgtacgtagacgtcctaaggaaacgttcttcgtagtactttaagttttactacgtcgtacgagtactacggtacgtacgaccgtacgttccgtaccttcgttaccgttccgggttaccggggacgggtaaccgggtaaccgtaaagggggtcggaacgtaacgtaaaccggaaaaccggttcggtagggttccggacccgtacggtaacccttacctgtttacccgttcgtttaaccccg

SEQ ID NO: 73660 - DNA, 755 bp, Homo sapiens
  misc_feature: GYAE6OF01BZ6Z7.49.46.E02.1.454.CMB.1.raw
  modified_base (212)..(212): a, c, t, g, unknown or other
  misc_feature (212)..(212): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggcctccagataccaccggagtaattgtgttgacacagtctccggccacctgtcttgtctccgagggacagtcgccacctcncgtgcgacgggccaggtcagagttgttagagtcttctagcctaggtaccaacaggaaacctggaccgaggcctccgaggcctccgtacattcctagtgtatcggacaacgtacccgaacggacgggccctaacgtggacctacgtaccccaggtacccgtaggtttccaaggttcgggacgtagggtcggggttatggtacgacgtacgttacctactaccgtctacctaacccaggttaccacgggcctaacggtaccgttaaggacgtaccccgtaaggaaacgttcgtttaccggtagtaacctttaagggttttaaccttacggtactacccggtaagtacgtaaccggtttacgggtaaacctaccgtaaccgggttcccgttacccgtaccgttcccgttaaccggggttaccgggaaccggggttaaaccgggtaccggtaagggttaacggaacggtaaccttaaaccgggaaacgttcccggttaaggtaccggcctttaacgacccttacgaaccgtttcgtaggtttacccc

SEQ ID NO: 73661 - DNA, 598 bp, Homo sapiens
  misc_feature: GYAE6OF01D5EAI.49.46.E02.1.454.CMB.1.raw
  modified_base (293)..(293): a, c, t, g, unknown or other
  misc_feature (293)..(293): n is a, c, g, or t
  modified_base (388)..(388): a, c, t, g, unknown or other
  misc_feature (388)..(388): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagtagtgttagtagcttctagcctggtaccaacagaaacctggccaggcctcccgaggctcctnactctatgtatgcatcccaacgacgggccacgtggaccacgtcccagcctaggttcaggtggctaggtggtctgtgacagtcttcactctcaacntcagcacgtcctaagcgacccgtagaacgtattccgtagtaccgttagttttaactacgttgtactagaccgtaggtacgtaagacctaagtcggtactactcgttctaccggttcgggaccgggtaaggaccgtaaagggtcggtaagtaaccgtaacgaaaccggtacggtggtacggtcgtacgtaccctacgtcgttcgttaccgg

SEQ ID NO: 73662 - DNA, 734 bp, Homo sapiens
  misc_feature: GYAE6OF01D9KQJ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccacggagaattgtgttgacacagtctccggccaccctgttctttgtcctaccgaggggacagtcgccctacccttctccgtgcgagggccagtcagtagtgttagtagtcttcgtacgccgtaggtaaccaacgacgtaaaccgtcggaccacggtccctacccgaggtccctaccgtactattctagtgtactcgactactaccgaacggacgggtaccacgtcggacctaccgtcccgacggtacccgtaaggttccgaaggtcggtacggtagggttcgggttctaggtacgtaacgtaacggttaccttactacgttccctaccaaccgtataccgacgtacctacggtaccgtacggacgtacgtagtaacgtactttcgtacgttactttacgtttaactacgttcacggtactacggtaggtaccgtaacgaccgtaccggttccgtacccgttacttacccggttaccgggttaccggggacgggtaaccgggtaacggtacgggttaacggaacgtaaccgtaaacggaaacggttcggttcggacggtcccgtacgaccgtacttcgttcgtactttacccg

SEQ ID NO: 73663 - DNA, 652 bp, Homo sapiens
  misc_feature: GYAE6OF01ALIJ7.49.46.E02.1.454.CMB.1.raw
  modified_base (233)..(233): a, c, t, g, unknown or other
  misc_feature (233)..(233): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgcccaccctctcctgcagggccagtcagngtgttagagctttcttagcctggtaccaacagaaacctggccaggcctcccgaggcctcctcatctatgatcgcactccaacgacgggcccacgtcggcactccccagcccgtaggttcacggtcggcgtaggttcgggtctgtggaccagtacctttcaccttcctaccacctactcgacgccgacgtcccgtaaggaccgtcccgtaaggtaacgtactttcgtacgtaccgtttagttttaactttacctggtacaacgtcgtacgtacgtacgtactaccgtcggtacctccgttaccgtaccggtttcgggacgggtaccgggaccggtagggtacggaacgacgttaccgaaaaccggtccgttagggtccggtacgtaccggtacccaaccttcgttcccgttcgtttaccc

SEQ ID NO: 73664 - DNA, 615 bp, Homo sapiens
  misc_feature: GYAE6OF01DT5NU.49.46.E02.1.454.CMB.1.raw
  modified_base (397)..(397): a, c, t, g, unknown or other
  misc_feature (397)..(397): n is a, c, g, or t
  modified_base (457)..(457): a, c, t, g, unknown or other
  misc_feature (457)..(457): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagctttcttagcctggtaccaacgagaaacctggccaggcctcccaggcctcctcatctatgatgcatccaacgcgggccactggcactccccagcctaggttccaggtcggcaggttcggggtctggtgacgtagacctttcacctctacaacctntaccagcacgcctaagacgtccgtagaacgtacttctagtacttaagtttatttaccgtntacgtagacgtagtcgtaagacctaacgttcgggtacccttctccgttaacggtttccgggacgggtaacggtaccgtaagggtcggaacgtacgtaaccgaaacggtacgttacgggtacggtaccgtcggaacctaccgtcttcgttccgttaccg

SEQ ID NO: 73665 - DNA, 582 bp, Homo sapiens
  misc_feature: GYAE6OF01A9YUK.49.46.E02.1.454.CMB.1.raw
  modified_base (401)..(401): a, c, t, g, unknown or other
  misc_feature (401)..(401): n is a, c, g, or t
  modified_base (417)..(417): a, c, t, g, unknown or other
  misc_feature (417)..(417): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggcagtgccaccctctcctgcagggccagtcagagtgttagtagcttcttagcctggtaccaacagaaacctggccaggctcccaggcctcctcatctatgatgcatccaaacgcgggccacgtcggcactccccgagccctaggttcaggtggcaggtgggtctgtgacagtacttcacgtctcacctatcagcagcctaagcncctagaacgtattcgngtactagttttacttacgttgcaagtcaagtctaggcctaagtcgtcccttacgtccttacggtttccggacgggtacggggaaccctaggggtacggtaaggtactaaccgaaaacggtacttcgggtacggtactaccggactaaccgtcttacgtgttaccc

SEQ ID NO: 73666 - DNA, 779 bp, Homo sapiens
  misc_feature: GYAE6OF01DH0LT.49.46.E02.1.454.CMB.1.raw
  modified_base (489)..(489): a, c, t, g, unknown or other
  misc_feature (489)..(489): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctgctccagataccacggagaattgtgttgacacagtctccggcctacctgttctttgtcctccgaggggacagtcgcccaccctctcctgacgacggccagtcgagtagtgttagtacgtctttacgttacgccgtacggtaaccaaacgaacgtaacccgtcggacccaacgggtcccttacccgaaggttcccttaccttactaacttccttagtcggtaacttcggacctaaaccttacccgaaacggaccgggccctaacggtcgggaccctaacctacccgacggtacccggttaggttcgacgggttcggacgtacgggttcggtcctaggtacgaacgtacgttaccttaccnccttacgtaccaccgtatacccgaggaccgtacgtaccgtaacgtaccgtaaccgttaaggtaacgttaacgtttcgtaacgttaccttttaaggttttaccttacgtagttaacgacggtacgaccggtacgttaaccgaccgttacgtaccgttcccgttaccgttacggttacccgggttacgggaccgggtaacgggaaccggtaacgggtagggaaacgtaacgttaaccgaaacggttcgttacgggctaccggtcgaactacgttcgtacgtttcgttacccg

SEQ ID NO: 73667 - DNA, 710 bp, Homo sapiens
  misc_feature: GYAE6OF01CTDCL.49.46.E02.1.454.CMB.1.raw
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (298)..(298): a, c, t, g, unknown or other
  misc_feature (298)..(298): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccacctctccgtncgagggccagtcagagtgttagtancttctagcctaggtaccaacagaaacctggacacggctcccgaggcctaccgnattctagtcgatcgacactaccaacgacggcccagtcggcctactacccgaacgccgtaaggttcaggttcggactaggttcgggtctaggttcaaccgtaagtccgtttacaccttcgtaaccacgtataccgcgtacaaccggtcctaaggacgtacccgtaaggtaacgttaacttaccgtagtacgtttaagtttacgttacgtgtaccgtaacgacgtacgttaccgaaacggttaccttaaacggttcccggttacccttacccgttccggtaacccggtttcgggaaccggggtaaacgggtaaccgtaagggggtaacggtacggtaaacggttaaccaaacgggttaccgtacggttccggaacgttaccgtacccgaccttacggttccctttcggttaccc

SEQ ID NO: 73668 - DNA, 848 bp, Homo sapiens
  misc_feature: GYAE6OF01BGMBD.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagtaattgtgttgacacacgtctccgccacctgtctttcgtctccgaggggactagtcgcccaccctctcctgcacggccagtcagtagtgttagtagtcttcttagccgtaggtaaccaatacgaaaccgtcggaccaggtcctacccgaggtcctcctactaacttcgtatagtatcggtacacctacccgaacgacgggaccctaacgtcgggactaccgtccccgacggtaccctaggtttccgaaggtcggtaccgtaggggttcgggttattcggtacgtaacgtacggttaacctttaccggtaccttaccctaccgtaacctacttaccgaaccgtccgaaccgttacccgtaggaccgttaccgtaacggtaaacgtttccgttaccgtaacggttcccttttaaaggtttttaccctttaaacggttccgttaaccgtaccgggtaacgtaccgttaaccggggttaactaacccgttaaccccgggtcgttacccctttcggttaaaccccgtttaccggggttcccgggaacgggggttaaacccggaacccggtttacggggaaaccgggttaaccgtaacccgggttaaaccggtaaaacccgggttacggttacggggtacccgtttaaccggtaccccgaaccttaccccgggtacttttccggttaaacccgtttaccccgg

SEQ ID NO: 73669 - DNA, 611 bp, Homo sapiens
  misc_feature: GYAE6OF01EK64P.49.46.E02.1.454.CMB.1.raw
  modified_base (317)..(317): a, c, t, g, unknown or other
  misc_feature (317)..(317): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagtcttcttagcctggtaaccaacagaaacctggccaggcctcccaggcctcctcatctatgatgacataccaacgngggcccacgtcggcacgtccccagcccgtaaggttcaggtggcgtaggtgggtctgtgacgtagtaccttcactctacacctatcgagcacgccgtagactccgtagaagtacttcgtagtacttaagttttaacttacgtgtacacgtacgtaggtaccgtacgacctaacgtcggtacccttcttaccgtacgtttccggggacggaacggggaaccgtaggggtacggtaacggtaacgtacgaaacggtacgttggtacggtctacggaccaaccttattccgtcgttcc

SEQ ID NO: 73670 - DNA, 729 bp, Homo sapiens
  misc_feature: GYAE6OF01EQDD5.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagtagtgttagtagtcttcttagcctaggtaaccaacgagtaaacctggacccaggcctcccgaggtcctcctcatctatgatgcataccaacgcgggaccacgtcgggaccactcccgaacgtcccgtaagggttcaaggtcggacgtaggttcgggtctaggtcgacgtaggtaccttcaccgtctacaacctagttaccacgtacaacgtacccgtaagtaccggtacccgttaaggtaaacgtacgttaccgttacggtacgtttaagttttaacgttaccgtaggttacctaaggacctacgggtaaccgttacggtacctaaaccggttccggttacccttccgttacgttaacccggtttccggggaacccgggaacggggttaaaccggaacggggttaaggaacggtaaccgtaaccggtaaaacggtaccggttagggtaccggtaccgtacgtacccgtaaacccgttacttccgttcggtttacccc

SEQ ID NO: 73671 - DNA, 653 bp, Homo sapiens
  misc_feature: GYAE6OF01A3UDP.49.46.E02.1.454.CMB.1.raw
  modified_base (262)..(262): a, c, t, g, unknown or other
  misc_feature (262)..(262): n is a, c, g, or t
  modified_base (391)..(391): a, c, t, g, unknown or other
  misc_feature (391)..(391): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggcaccctgtctttgtctccgagggacagtcgccaccctctcctgcgacggccagtcagagtgttagtagcttctagcctggtacaacanaaacctgccaggcctcccaggcctctcatctatgatgcatccaacgtggccacgtggacactacccgagccctaggttcacgtcggctaggtgggtactgtgactaggtactccgactcctcaccgtancagtccaacgtcctaagacgccgtagtaacgtaacttcgtacggacttaacggttttaaactcgttggtacccgtaggactacgggtactacgaacccttaccggtacgggtccccttacgttcccgtaaccggttttcccggggacgggttaaccgggaaccggtaaacgggtcggtaacggtacgtaaacccgtaaacggtaccgttaagggtcggttaacccgtacggacgtaaacccgtacttcgttacggttaaccc

SEQ ID NO: 73672 - DNA, 816 bp, Homo sapiens
  misc_feature: GYAE6OF01CMVO4.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacgagaaacctggcaggcctccaggcctcctcatctatgatgcatccgaacgacgggcccacgtggaccacgtccccaagtcccgaagggtttccgagggttcgggaccgtaggggttcggggttaccgttggtagaaccgtaacgtacctttaccgacccttccttaccaaccctaattaccgacgaccgtaaaccggtacccgtaacggtacggtaccccgttaagggtaaacgtacttttaccggacggttactttaaaccggttttttaaacgtttaccgtttacgggtaacctaacgggttacgtaaccggggttaccgttaaaccggtaaccgtaaccccgggtttccgggtcccccgtttaactttaccccggttaccggggtttttacccgggggacccggggtaaaccgggggtaacccggttaaagggggtaggttaaaccggaaaccgtttaacccggaaaaccgggttaaacgttaccgggggttcggaacccgtttaccggtaaaccctaaccggttaaccttttccggttaccggtttacccc

SEQ ID NO: 73673 - DNA, 757 bp, Homo sapiens
  misc_feature: GYAE6OF01C7O9P.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtcgcccaccctctcctgcagggccagtcagagtgttagtagcttctagcctggtaaccaacgagaaacctggaccacggcctcccaggcctcctcactctatgatcgctactaccaacgacggccacgtcggcactcccgagccgaggttcaggtgcgtagggttcgggtctgtacgaactacggtaccttacgaccttctaccaacctactacgacgtccgtaacgccgtaagacgtcccgtaagtaacgtacgtttcgtacgttacgttaacgtttttacgtttaaccgtcgtaccgtaacggtaccgtaacgggttaaccggttaacggtacccctaaaccgggtttcccggttaccccttaccgtttcccggtttaaccccgggtttccggggggaaccggggtaaaccggggttaaacccggtaaaggggggttaccggtaaacgggtaacgttaaaaccccgggtaaaaacgtaaccggggttttacgggtacggtcccggttaaccggaacccttaacccgtaacgtttccgttaccgggtttacccc

SEQ ID NO: 73674 - DNA, 689 bp, Homo sapiens
  misc_feature: GYAE6OF01B222N.49.46.E02.1.454.CMB.1.raw
  modified_base (418)..(418): a, c, t, g, unknown or other
  misc_feature (418)..(418): n is a, c, g, or t
tcagagtcgagagacacgaccggtgctcgatttagactcatctacaggggaaagggggaggaactgctcagttaggacccagagggaaccatggaagcccagctcagcttctcttcctctgctactctggctccagactaccaccggtagaaattgtgttcgacacgagtcctccggaccaccctgtctttgtcctccgaggggacagtcgcccacctctcctgcgacggccagtcagagttcgttagtagtcttcgttagccgtaggtaaccaaagaacggtaaaccgtggaccctaagggtccctacccggaggtccttacctcacttcgtaattcggacttcgcaacttacccaaacgcgggtaccacgtcggacacgtcccgagtccgtaggtcaggtcggcgtaggtcggtcnggtacacgacgtctacaccgtcaccacactcacgacgtacgacgtagaccgtcgtagaagtacttcgtagtacttagtttacttacgtacgtacacgtgacgtacgtaacgacttaccggtcgtaccctacgttaccgtacgggtttaccgggaccggtaaacgggtacgtaagggtacggtaacgtaaccggtaaccggaaaacgttcgggtaccggttaccggttaccgtaccggtacctaacccgttacgttcccgtttcgttacccg

SEQ ID NO: 73675 - DNA, 819 bp, Homo sapiens
  misc_feature: GYAE6OF01ARABY.49.46.E02.1.454.CMB.1.raw
  modified_base (265)..(265): a, c, t, g, unknown or other
  misc_feature (265)..(265): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcagggccagtcagagttgttagtagtcttctagcctggtaccaanacgaacctggccaggcctccacggtcctcctcatctatcgatcgcactaccgaacgacgggacctacgtcggactacctccccgaggcccgtaacggtttccgacggttcgggccgtagggttcggggtttacctggttacggaacgtaacggttacctttacgtaacccgttccctacctaacccgtaacttacccgaacgtacccgtaaccgtacccgtaaggaaccggtaccgttaggtaaacggttactttcgttacgtacgtttaacgttttaacgtttaccgttacgttacgaacgttaccgacggtaccgggttaaccggaaccgttacccggttacccgggttacccttacccggttttacccgttaacccggggtttcccggggtaaccgggggtaacccggggttaaccgggtaaacgggggtttaaccgggaaacgggtaaccggtaaaacccgggtaaaaaccggtaaccgggtttacggttaaccggggtaccgtaaccgggtaacccttaaccgtacgtttcccgttacggtttaccccg

SEQ ID NO: 73676 - DNA, 671 bp, Homo sapiens
  misc_feature: GYAE6OF01CK2NK.49.46.E02.1.454.CMB.1.raw
  modified_base (550)..(550): a, c, t, g, unknown or other
  misc_feature (550)..(550): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagaaattgtgttgacacagtctccggccaccctgtctttgtctccgaggggacagtcgcccaccctctcctgcgacgggccagtcagagttgttagtagctttcttagccttacggtaaccaaacacgaaaccgtggacccacggcctccgaggcctcctactatcttatgatcgcctactaccaacgcgggacctacgtcggacctactcccgacgtccgtaagggtttcacgggtcggacgtaggggttcggggttctaggtacgacgtacgtaaccttccaacttcctaccacctaagtcgaacgcgtaacgacgtaacgtaccgtaccgttaagtaaacgttcgttcctaggtacctttaagttttacttacgtgttacgacgatacggacggttanaccgacgtcgtccttacctcgtaaccgggttcgggaacggtacggacggtaaaggtcggaagacgtaacggtaaacaaggttgaccggtcgtacgtacccaacgtacgttcttcggttacc

SEQ ID NO: 73677 - DNA, 858 bp, Homo sapiens
  misc_feature: GYAE6OF01A70DV.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagatacccaccggagaaattgtgttgacacagtcctccggccaccctgtcttgtctccgagggacagtcgcccaccctctcctgcaggccagtcagtagtgttagtagtcttcgtagcctaggtaccaacgacgtaaccgtcggaccgtaaggccctccgaggtcctcctctactctaagtgatcgactactaccgaacgcggaccacgtcggtaccaccgtccccgagtaccgtaggttccgaggttcggcgtaaggttcgggttactggtacgaaccgtacgttaccgttccgtaaccttaccgtacccgtaacgtacgtaccgaacggtacccgtaacgggtaccccttaaaggggacccttacccgggttaaacggttaacggttaaccgtttccggtttaacggtacccgtttttaaacggttttaacgttttaacccggttcggtaaacccgtacgggttaaccgtaacgggtaacccgttaccgggttaacccgttaacccggttcccgggttaaccccttacccgtttacccggttaacccggggtttaccggggaacccggggtttaaaaccgggaaaccccgggttaaggggtttaacgaaaccggttaacgtaaacccgggtaaacggtaacccgggttggggttacccgaccggttaaccggtaacccggtaccgtttaaacccggttcggttaaccggtttaaccccc

SEQ ID NO: 73678 - DNA, 557 bp, Homo sapiens
  misc_feature: GYAE6OF01BJ8YF.49.46.E02.1.454.CMB.1.raw
  modified_base (261)..(261): a, c, t, g, unknown or other
  misc_feature (261)..(261): n is a, c, g, or t
  modified_base (390)..(390): a, c, t, g, unknown or other
  misc_feature (390)..(390): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaaacctggccaggcctcccaggctcctcatctatgatgcatccaacagggccaactggccatcccagccaggttcagtggcagtgggtctgtgacagtacttcactctcactatcagcagcctagcncctagaagtattctgctagtttatactgtcagtcagcgtagactaacgtggtcctctcgtacgtttcgggacggtaacgggtaaccgaagggtggaacgtacgttaaccgaaaaccggtactgggtacggaccgttacggaccctaaccctattccgttgttacccc

SEQ ID NO: 73679 - DNA, 755 bp, Homo sapiens
  misc_feature: GYAE6OF01AL2Z6.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaattgtgttgacacagtcctccggccaccctgttcttcgtctccgagggacagtcgccctaccctctccgtgccgagggccagtcagtagttgttagtagtcttacgttacgccgttacggtaaccaaacgaacgtaaacccgtcggaccgacggtccctacccgtaacggcccttccgtacctataccgttatacggaactcgacctaactacccgaaacgtacgggtcccaacggtcggacctacgtaccccgagtacccgtacggttacacgggtcggactaggggttcggtctcggtacaacgtagttcccttactaccctactacccactacgtaccgacgtccgtaacgaccgttacgacgtaccgttaagaaccgtatttaccgtacgtacgtttaacgttttagttaacgttcgtacgtacgttaccggtacgtacggtaactaccgtaccgtccgtaccttacgtaccggtttaccggtccgggtaaccgggtaacgggtaccgggttaaacgggtacggtaacgtaaacctaaccgggtaaaccgtaggtacggtcggtacaccgttacccgaactcgtttacgttcgttacccg

SEQ ID NO: 73680 - DNA, 736 bp, Homo sapiens
  misc_feature: GYAE6OF01BTKAN.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacactagtctccggccaccctgtctttgtcctccgaggggacagtcgccctaccctctcctgcgacgggccagtcagagtgttagtagtccttcttagcctaggtaacccaacacgaaaccgtggacccaggcctacccgaggcctcctcaactctagtgatcgccactacccaaacggcgggacccacgtggaccaccgtcccacggtaccgacggtttcgaaggtgggccgtaggttcggggtcttaggtacgaaccgtaggttaccttacaccgtttccctacctaaccctattcccgaacgtaccgacgtacccgtaacggacccgtacggtaagtaacgttacttaccgtagttaccgtttaagttttaacgttaccgttagtcccgacgtacgtacggtaccggtaacgtacctaaccgggttccggtacccttccgttacggttacccgggtttccgggaccggggtaaccgggtaccggtaaggggttaacggaggtaaccgtaaaccggaaacggttacggtcggtacggaccgtacgacccgtaacctcgttgttccggttaccc

SEQ ID NO: 73681 - DNA, 781 bp, Homo sapiens
  misc_feature: GYAE6OF01AB5B3.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtctccgagggacagtcgccacctctctgcagggccagtcagagtgttagtagtcttactagcctaggtaccaacgacgtaaacctcgggaccaggccctacccggaggtcctacctacacttctagtgtactcggacctacgtacccaaacgtcggggaccctacggtcggacctacgtaccccgagtacccgtaggttaccgaggttcgggccgttagggtcgggtctaggtacgaaccgacggttaccttaccaccgttcctaccgaacccttagtaccgaacgacccgtacgtacccttaagggtacctacccggttaaggaaaacggtttcctttaccggtagttaaccgttttaacggtttttaacgtacccgtttacgaccgtaacgtccgtaacgggttaaccccgtagaaccccgttaacggttaccgtccccgtttacgtaccgttttacccggggtttccggggaacggggtaaccccgggtaaggtaacggggtacggtaacggttaaccaaaccgggttaaacggtacgtcggggttacctaccgggtactacccgtaacctacggttcctcggtttaaccc

SEQ ID NO: 73682 - DNA, 582 bp, Homo sapiens
  misc_feature: GYAE6OF01AI4FY.49.46.E02.1.454.CMB.1.raw
  modified_base (571)..(571): a, c, t, g, unknown or other
  misc_feature (571)..(571): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagtcttcttagcctggtaccaaacacgaaacctggccaggcctcccaggcctcctcatctaatgatgcatccaacgacgggccacgtggaccactccccgagccctaggttcaggtcggctaggtgggtctggtagacacgtacttcgacttctacacctatcacgcacgtctaggacgtcctagtaaagtcttcgtagtacttagttttaactacgtggtacagtcgagtcgtacgcctaacgtcgtacctactcgttacgttcgggacggtaacggaccagggtacggagacgtaaccgtaaacgcgtgggacgactcggacctacgtntcgttgttacc

SEQ ID NO: 73683 - DNA, 847 bp, Homo sapiens
  misc_feature: GYAE6OF01BLP9V.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagactaccaccggagtaaattgtgttgacacagtcctcccggccaccctgttctttgtcctcgaggggacagtcgccaccctctcctgccgagggccagtcaggtagttgttagtagtcctttcgtacgtccgtacggtaacccaacgaaccgtaaaccgtcggacccgaacgggtccctaccccggaggtcccttcctacgtacttcgtatggactcgacctaccgtacccgaacggaccgggtcctaacgtcggacctaccgtcccgaacggtcccgtaaggttccgaggtcggacgtaggggtcgggttactacggtaacgacgtaacgttaccttacccgtaccttaccgtacccctaaccgtacgttaccgaccgtaaccgtaccggttaacccgtaaccggtacccggtaaccggttaaggtaaacgtttacgtttaccgtaacggttaccgttttaaacgtttttaaccgttaacgtttacgtacgtacggtaccggtacggtaccggttaaccgtaaccgtaacccggttccggttacccgtttaccgttacccggttaccggggtttacccggggaaccggggttaaaccgggtaacgggttaaacggggtaggtaaacggtaaccgttaaaccggaaacggttaccggtacggtacggtaccgtacgaacccgttaaccgtcgttccgttacgttacccg

SEQ ID NO: 73684 - DNA, 855 bp, Homo sapiens
  misc_feature: GYAE6OF01B59XO.49.46.E02.1.454.CMB.1.raw
  modified_base (831)..(831): a, c, t, g, unknown or other
  misc_feature (831)..(831): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagactaccacggagtaaattgtgttgacacagtctcccggccacccttgttctttcgtcctccgaggggacagtcgcccacctctcctgcgagggccagtcgagtagttagttagtacgtctttacgttacgccgtacggtaaccaaacgaacggtaaaacccggtcggacccgaacgggtcccctacccggaacggtccctccctacctaacgtttacctaaggtgtaacgttccgactaaccgttacccgaaaccggaccggggacccctaaccggtcggaccctaacccgttcccccggaaccggtacccggttaacgggtttaccgtaacgggttccggggtacgttagggggttaccggggttacgttacgggtacgtaacggtaaccggttaccttacccgtaaccttccccgtaacctaacccgtaacttaccgaaccgaccgtaccggtaacccgtaaggacccggttacgtaacggtaaacgtttcgttacgtaggtttaacgtttaaggttttacctttacgtacgttacggtaaccggacgttaacggttaccgtaaacggacccggttaacgttccgggttacccttacggttacccgttaaccggggttcgggaaacggggtaaccgggtaaacggaggttacgggaactaccgtaaacgaaacgggtgttacggcgtacncgacctaattcgtcgttaggtccc

SEQ ID NO: 73685 - DNA, 789 bp, Homo sapiens
  misc_feature: GYAE6OF01EY1OB.49.46.E02.1.454.CMB.1.raw
  modified_base (232)..(232): a, c, t, g, unknown or other
  misc_feature (232)..(232): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccgaggggacagtcgccaccctctcctgcagggccagtcagngtgttagtagcttctagcctaggtaaccaaagaacgtaaaccgtcggaccaacgggccctacccgaggtcctacctcatctatcgatcgcactaccgaacgtacggacccacgtcggactaacgtcccgacgacccgtaaggttccagggtcggtacgtagggttcgggtacgtagacgtaaccgtacgttaccttacgacccttacacctaacccgttataccgagtaccgaacggtcctaaggaacgtacccgtaaggtaaaacggttcttacgtacggttacgtttaagtttttaacgtaaccgttcggtaaccgagggttaccacgggtaacgttacgtaacccgtaaacccggtttccgtaacccctttcggttaccctttaaccgggggtttacccggggaaccggggtaaacggggtaacccgttaaacgggggtaggtaaaaccgttaccgtaaaaaccgggtaaacccggttacggtttacgggacggttaacccgttaaacgggtccctaaaacccggggtttcttcggtttaccccggtttaaccg

SEQ ID NO: 73686 - DNA, 695 bp, Homo sapiens
  misc_feature: GYAE6OF01DOT3D.49.46.E02.1.454.CMB.1.raw
  modified_base (149)..(149): a, c, t, g, unknown or other
  misc_feature (149)..(149): n is a, c, g, or t
  modified_base (209)..(209): a, c, t, g, unknown or other
  misc_feature (209)..(209): n is a, c, g, or t
  modified_base (261)..(261): a, c, t, g, unknown or other
  misc_feature (261)..(261): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccgganaaattgtgttgacacagtctccggccaccctgtctttgtctcagggacagtcgccacctntcctgacagggccagtcagagtgttagagcttcttagcctaggtaaccaaanacgtaaaacctggaccaggtacctcccgaggctcctacattctaatgatgcaatacccgaagagggcccaacgttggctaacttcccaagcctaagggttcaggttggctaggtgggtactgtgacaggtcttcactctacgacccatccgagacgaagtcctaaggacgtacccgtagtaaaggtactttcttacggtacttaaggtttttaatttaaaccgttcgttacctaaggtacccgtaagtaccggtaaacgtacgtaaacccgttggtaccccttacttaccggttaaccggttttaccggggacgggttaaacgggtaacccgtaaagggttacggaacgggtaaacttaaccggaaaaccgttaaaccgttaggtacgggtacctacgggtaacccaaccgttaacgttgttccgtttaacccg

SEQ ID NO: 73687 - DNA, 550 bp, Homo sapiens
  misc_feature: GYAE6OF01CP8YP.49.46.E02.1.454.CMB.1.raw
  modified_base (370)..(370): a, c, t, g, unknown or other
  misc_feature (370)..(370): n is a, c, g, or t
  modified_base (398)..(398): a, c, t, g, unknown or other
  misc_feature (398)..(398): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagagtgttagtagcttcttagcctggtaccaacagaaacctggccaggctcccgaggctctcatctatgatgcatccaacacgggccacgtcggcactcccagccaggttcagtgcagtggtctgtgacagacttcactcncaccatcagcacgctagcgctagaagtnttctgactagtttatactgtcgagtcagtcgtagacaacgtcgcctcttctacgtttcgggacggtacgggtacgtaagggtacgaacgtacgtaaccgaaaacggtacgttcggtaacggctacggacctaaccgtactcgttcgttaccg

SEQ ID NO: 73688 - DNA, 820 bp, Homo sapiens
  misc_feature: GYAE6OF01CSNR5.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagatacccgaccggagtaaattgtgttgacacagtcctccggccacctgttctttgctccgaggggacagtcgccctaccctctccgtagcgacgggccaggtcaggtagttcgttagtacgtctttcttacgcctaggtaaccaacaacgtaaaccctggaccctacggtcctacccgaaggtcccttaccgtctaacttaccgttagtacggattcggaactaaccgtaaccaaaccggtaaccggcccgtaacgtcggacctaacccgttaccccgaacgcccgtaaggttccgagggttacggcgtagggtcgggttactaggttaccgaaacgtacggtaccttaccaaccgtttcaccgaaccctagtcccaagtacccacggttcccaagggacctacccgttaaggaacgtttacttcggttactactttaaggttttactacggactacgtaacggcgtaaacggttccggaacgtaccgttaaccggttcccggtaccgtttaaaccgtccggggtttaacccggttccgggggtaaaccggaacccgggggtaacgttaaacgggggtacggtaaacgtaaaccggtaaaacggtaaacccggtaaacggtttgggaaacccgttcgtaacccggtacccttaaccgtaaccgtttcgtttaacggttaccc

SEQ ID NO: 73689 - DNA, 601 bp, Homo sapiens
  misc_feature: GYAE6OF01BO3EG.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagagtgttagtagcttctagcctggtaccaacagaaacctggccaggcctcccaggtcctcctcatctatgatgcactccaacgacgggccacgtggccactcccagtcccgaggttccaggtcggcaggttgggtctggtgacagtacttcactctacaccatcagcacgtcctagacgtctagaagtacttcgtacgtacgttaagttttactacgttcgtacagtacgacgtacgtacgaccgtaacgtcggtacctacttccttaccgtaccggtttccgggacgggtaaacgggaccgtaagggtaggacgaacgtaaccgaaacggtacgtcggtacggtactacgaccaccttgttccgttccg

SEQ ID NO: 73690 - DNA, 631 bp, Homo sapiens
  misc_feature: GYAE6OF01CZ73O.49.46.E02.1.454.CMB.1.raw
  modified_base (201)..(201): a, c, t, g, unknown or other
  misc_feature (201)..(201): n is a, c, g, or t
  modified_base (314)..(314): a, c, t, g, unknown or other
  misc_feature (314)..(314): n is a, c, g, or t
  modified_base (370)..(370): a, c, t, g, unknown or other
  misc_feature (370)..(370): n is a, c, g, or t
  modified_base (623)..(623): a, c, t, g, unknown or other
  misc_feature (623)..(623): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacngtgccaccctctcctgcagggccagtcagagtgttagtagcttcttagcctaggtaccaacagaaacctggaccacggctcccaggcctcctcatctatgatgcatccaacgngggacccacgtggccactcccaagccaggttcagtggctaggtgggtatggtgacngtacttcactctacaccataccagacgacgtacctaggtacgacctggaaacgtctttaccgtgtacttaagtttttacttaccgtttacgtactaggtaccacggtcgtaaggtccctaacgtcgggtaccttcgtactaccgggtttacgggaccgggtacgggtaaccgtaaggggtacggaacgtaactaaccgaaaccggtaacgttaggtacggaccgtacgaacccgtaccctaagttcccggttntttacccg

SEQ ID NO: 73691 - DNA, 687 bp, Homo sapiens
  misc_feature: GYAE6OF01BMHKH.49.46.E02.1.454.CMB.1.raw
  modified_base (320)..(320): a, c, t, g, unknown or other
  misc_feature (320)..(320): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagaaattgtgttgacacagtctccggccaccctgtctttgtctccgaggggacagtcgcccaccctctcctgcgagggccagtcagagtgttagtagcttcttagcctaggtaccaacacgaaacctggccaggcctccgaggcctcctcatctatgtatgcatccaacgnggccagtcgactactcccgagccgtaggttcaggtcggacgtggtacgggtctggtacgacgtagtaccttacgtactccgtacacctatccgacgacctacgtacgtacggacgtaccgtaaggaacgttcttcgtagtacttagttttactacgtcgtacgaacgtcgtacgtacggtacaccgtaacggttccggtaccctttaccgttaccggttaccgggttaccggggaacgggtaaccgggtaacccggtaagggggttacggtaaacgggtaaccgttaaacccgaaaacgggttaccgttggggtaacccggtaccttaccggaacccttaacgtacgttcccgtttcggtttacccc

SEQ ID NO: 73692 - DNA, 722 bp, Homo sapiens
  misc_feature: GYAE6OF01B97P5.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctccagataccaccggagaattgtgttgacacagtctccggccacctgtctttgctccgaggggacagtcgccacctctctgcgagggccagtcagagtgttagtagtcttctagccgtaggtaccaagacgaaaccgtcggaccacgggtcctcccgacggtcctccgtacagtcctatggatgacacgtccgaacggacgggtaccacgtggacctactccccgagtccgagggttcagggtacggcgtaagggttcgggtactggtacgacgtacgtacgtttccaccgttacctaccgtaccaacgttaccgacgaccgtaaccgtaccgttaacggaccggtaaccgttaaggtaacgttacgtttacgttacggtacttttaacggtttttaacgttacgttacgtaccgacggttacggtacgtacggtaacgtaccgttaacggtccgtcccttacgtaccgtttaccgggttccgggaacggaaggggtacccgtaaaggggtacggaacgtaaacggtaacggttaaacggtcggttggtacggtcgtaccgaccttaacggttctccgtttcgttaccg

SEQ ID NO: 73693 - DNA, 836 bp, Homo sapiens
  misc_feature: GYAE6OF01C2SFP.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagactacccaccggaagtaaattgtgttgacacagtctccggccaccctgttctttgtctaccgaggggacagtcgcccaccctctcctgcgacgggccagtcagtagttgttagtacgtctttcttacggcccgttacggtaacccaaacgaacgtaaaacccgtcgggacccaacgggtccctaccccgacggtcccttacccttacattactaacgtgactcgacctactacccgaaaccggacgggccctacgtcggacctaacctacccgacggcccgtaagggtttccaagggtcggtcgtaagggtttcggggttacgttacggtacgtaacccgtaacggttaccctttaccaccttacccgtaccaaacccgtataccgacgacccgttaacgccccggtttaagaccggtacccgttaagtaaaccgttacgtttaccgtacggttaaccgtttaacggtttttaacttaccgtacgggttaccgaaggtacccgacgggttaaccgtaacgtacccgttaaaccggttcggcccttttaacttccccgggtttaacccgggttcggggaacccggggtaaggggtaaccccggtaaagggttaaggaaaccgttaacggtaaacccgtaaaacgggtcgttcgggttacgaccgttaacgaccgttactaccgttccgttcgtttccc

SEQ ID NO: 73694 - DNA, 851 bp, Homo sapiens
  misc_feature: GYAE6OF01DBM22.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggaagaaattgtgttgacacagtcctccggccaccctgtctttgtctcaggggacagtcgccacctctcctgcagggccaggtccagtaggtgttagtagtctttacttaggcccttagggtaacccaacgaagtaaaacccgtggacccgtaagggcctaccccgaagggtcctacccgtactaataccttaatggtaattcggacctaataccccgaaaggtaccgggggacccaacgttcgggacctaacgtcccccgaaacggtccccgtaaagggtttccgaagggtttccggaccggttaacgggtgggggttaacctggggtacggtaaacctacgggttaacctttcccgaccgtttaccaccgtaaaccctacgttaacgacgaacctaaccggtaacccgttaaggaccgtacccgtaaggtaaacgttaaccgttttacgtaccgtacggtttaacttttaaacgtttactacgggtaacccgtagtacctaacggggtaacgttaaccgacttaaccggttacgggttcccctacttacccggtttacgtttacccgggggaacgggtaaacccggggtaaattaaaccgggggaggtaaaccggtaaaactttaaccgggaaaaccggttaacgttacggggtcgaaccgttcggaaacccttaccggtaacttccggtttcgttaaccccg

SEQ ID NO: 73695 - DNA, 734 bp, Homo sapiens
  misc_feature: GYAE6OF01BST7X.49.46.E02.1.454.CMB.1.raw
  modified_base (433)..(433): a, c, t, g, unknown or other
  misc_feature (433)..(433): n is a, c, g, or t
  modified_base (556)..(556): a, c, t, g, unknown or other
  misc_feature (556)..(556): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgttctttgtctccgaggggacagtcgcccaccctctcctgcgagggccagtcgagagtgttagtacgtctttcttacgccgttacggtaaccaaccaacggaaacccgtcggacccgacgggccctacccgaggcccttcctctacttcctagtcgatcgaccactaccgaaccgacggggtcccacgtcgggaccctaacgtccccgaaggtaccctaagggttccagggtcggcgtagggttcggggtcncggttacgacgtaacgtacctctaccgtctaccgtacctactacgagaccaacggtacctaggacgtaccgttaagaaagttcttccgtacgttagtttaacgttttacgtaacgtccgtaanacgtacggtacggtacgtacgtactaccggtcgttaccttccgttaacgtacccggtttcgggaaccggggttacgggaaaccggtacgggtaacggtaacgtaaacggtaccgaaaacgggttacggtacgggtacgggacctttaccgccgtaaccgttcggtcttaccggttacg

SEQ ID NO: 73696 - DNA, 757 bp, Homo sapiens
  misc_feature: GYAE6OF01DO0ZM.49.46.E02.1.454.CMB.1.raw
  modified_base (600)..(600): a, c, t, g, unknown or other
  misc_feature (600)..(600): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctccagactaccgaccggaagtaaattgtgttagacacagtcctccgccacctgtcttgtcctcgagggtacagtcgccctacctctcgtgcgacggcctagtcagtagttagttacgtactctttacgttacgccgtacggtaaccaaacgaacggtaaaccgtcggacccgacggtccctaaccgcgtcctcctactacttcgtagtgtatacgtactaacgtacccgaacggaccggtaccctacgtccggacctaccgtaccccgacgtacccggttaggtaccgtagggtcggcgttaaggggtcgggttcctagggtaactaaccgtacgttacccttaccgtacccttctaaacccgtcctaacgtacgaccggtacctacggtaacctaacgggtaccgtaccgttaaggtaaacctttcgttactacgttacttttaaggtttaactcgtacgtaccgngtacgttacggacgtaccgacttacggtccttaccgttaccgtaccggtttacgggacgggaacggaaccgggttacggaaacggttagaaccggtaaccgttaaacgacggttcggtgtacggtcctacggacctagttcttacggtcttaacccg

SEQ ID NO: 73697 - DNA, 811 bp, Homo sapiens
  misc_feature: GYAE6OF01EKEAE.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctccagataccaccggagaaattgtgttgacacagtctccggccacctgtctttgtctccgaggggacagtcgcccaccctctcctgcacgggccagtcagtagtgttagtacgtctttacgttacgccttacggtaaccaaacgaacgtaaaaccgtcggacccaacgggtcccttacccgaacggtcctacccgttactacttaccttaagttacggtactacggtaccaaacgttaccccgaaaaccggaccgggggtacccaacggttccgggaccctacccgtaccccggtaacgtcccgtaacgggtttcgtaacgggttcggaccggttacggggttcggggttaccgttggtacggtaaccgtaacgggtacctttacccgaccgtttccctaaccgaccctacgtaccgacgtacccggaactacccggtagacccggtacctaaggtaacgtactttaccgtacgttacgtttaacgttttacgtaccgttcggtactacggtacgtacggtaccggtacgtaaccggtaacccgtcgtcccgttaccgttccgttaccgggttaccgggaacgggaacggtaaacggtaggtacggtaacgttacgaacccggttaaacgacggttacggcgtacgtaccggtacctaagtccttcggttcttacccg

SEQ ID NO: 73698 - DNA, 830 bp, Homo sapiens
  misc_feature: GYAE6OF01B49Z9.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtcctccggccaccctgttctttgcctccgaggggactagtcgccctaccctctccgtgccgacgggcccagtcaggtagttgttagtacgtcctttacttacggccgttacgggtaaaccaaaccgtaacggtaaaacccgttcgggacccgaacgggtcccttacccggaacgggtccccttaccgtactaactttccgtaagttaggtacgtacggacctaaccgttaccccgaaaacggacggggaccctaacggttccggaacccttaaccgtacccccggacggtacccggttaacgggtttaccgaacgggtttcgggaccggttaaggggtcggggtttaccgtagggtacgaaaccggtacgtaccttttaccgaccctttccgaccaacccgtagaccgacgtaccgacgtaccgtacgtacgtaccgtagtaacgtacgttcgtacgtacttaacgtttacgttacgtacgtacgacgtacgtacgtacggtagtaaccgtacgttccgtacccttaccgttacgttaccggttacgggaaccgggtaaccgggtaaccggaacgggttacggaacggtaacgtaaccgtaaaacggtcgttacgggtaacgtccggtaccgtaaccgtaaccgtcgtttccgtcgtttacccg

SEQ ID NO: 73699 - DNA, 795 bp, Homo sapiens
  misc_feature: GYAE6OF01AKTOC.49.46.E02.1.454.CMB.1.raw
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctccagactaccaccggagtaaattgtgttgacacacgtcctccggcctacccttgttctttgtcctcgagggacngtcncctacctctcgtgcgtaggccagtcagtagttagttacgtacgtccttacgttacgccgttacggtaaacccaaacgtaacggtaaaccgttcgggaccctaacgggtcccttacccggaacggtcccttaccgtacttaacttacgttacgtacggtacgtccgtaaccgtaaccgtacccggaaaaccgggccggtaccctacggttacccggacctacccgtcccggtaacgtaccgttaacgggtttcgaacgggtcggtaccggttacgggttcggttaccgtaggttaaccgaccgttaaccgttaccttaccggtaccctacccttacgaaaccctgtaccgtacgaccgtaaccgtacgtacggtacgttacgtaaacgttacgtaccttacgttacgtaaccgttttatttaaccgtacgtacgtaccgtcggttaacgcggttacgtaaccgtactaccggtctaacccgttcctacggttaccgggtacggaacggacccggtaaggtcgtaagaacggtaccgtaagacggtacgtgggactacgtcgaccttaagtcgttgtcctaaccg

SEQ ID NO: 73700 - DNA, 744 bp, Homo sapiens
  misc_feature: GYAE6OF01EWIV5.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagactaccaccgggagaaatttgtgttgacacagtctccggccacccttgtctttgtctccgaggggacagtcgcccacccttctccgtgcgacgggccagtcagtagttgttagtacgtctttacgttagccgttacggtaaccaaacgacgaaaccgtcggaccgacggtcctccccgaggtccttccgtactacttcctagtacgtatcgacctaacgtaaccgaaacggaccggggtacccacggtcggacctaacctccccgtaacggacccgtaacgggttacgacgggtcgggtacgtagggttcggggttcgttacggtacggaactacggtaccttcgtaacctcctaccgacctacgtacgacgtcgacgtaccggtaacgacggtacctaggtaacgtcttacgtcgtactttagttttacgttacgttcgtacgtacggcgaacggtcgtaacgaccgtacgttccggtacccttcgtacgttcggttacgggacgggtacgggaaccggtagggacgtaacggtaacgtaacggtaaccggtaggtacggtacggtccctaacggtaccaaccgttcgttacgttcgtttacccg

SEQ ID NO: 73701 - DNA, 623 bp, Homo sapiens
  misc_feature: GYAE6OF01A4CF8.49.46.E02.1.454.CMB.1.raw
  modified_base (259)..(259): a, c, t, g, unknown or other
  misc_feature (259)..(259): n is a, c, g, or t
  modified_base (289)..(289): a, c, t, g, unknown or other
  misc_feature (289)..(289): n is a, c, g, or t
  modified_base (592)..(592): a, c, t, g, unknown or other
  misc_feature (592)..(592): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctcaggggacagtcgccacctctcctgcagggccagtcagagtgttagtagcttcttagcctggtaccaanagaaacctgccaggcctcccgaggctcctnatcctagtgatgcactaccaacgacggccagtcggctacgcccagcctaggtcaggttcggactaggtcgggtctggtacgacgagtaccgtctaacgtctaccaaccgtataccgagaccgtacgtaccgtaagaacgtcctaagtaaacgtacttcgtacgtcttaaagttttactaacttcggtactacgtacgtaggtaccgtaacgacctaaaccggtcggtacctcgttaccgtacgggttaccggacggtacgggtacagggttagacgtacgtacgtaaacggtctggtaccggntaacggtccaaaccgtcgttgtccgtttacc

SEQ ID NO: 73702 - DNA, 797 bp, Homo sapiens
  misc_feature: GYAE6OF01C6HIS.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgccgagggcccagtcagtagtgttagtagctttcttagcctaggtaccaacgaagaaaccgtcggaccacggcctacccgaggcctcctcatctatgatgcactccaaacgacgggcctacgtggccacgtccccaggcccgtaagggttcaggttcggcgtaaggttcggggttcttggtagacgtacgtaccttccaccgtctacctacctacttcgaacggtccgaacgtacccgttaaggaaccgtcccgtaaggaagttaaccgtttcctacgggttaccgtttaaacggttttttacgttaacccgtttagttacccgtacgtaccggttaacggtaaccgggtttcgaaacccgtaacccggttttccgggtacccctttcccgttaaccggtttacccgggttttccgggggaaaccggggtaaccggggtaacccgggtaaacgggggttaggaaaccgggttaaaccgtaacccggtaaaaacccgggttaagggttaccggttacggggaccgttaaacccgggtccctaaccggtttaaaccgttccggttttaccggttttaacccg

SEQ ID NO: 73703 - DNA, 697 bp, Homo sapiens
  misc_feature: GYAE6OF01BPY30.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgttactctggctcccagataccaccggagaattgtgttgacacagtctccggccaccctgtctttgtctccgaggggacagtgccacctctcctgcgagggccagtcagagttgttagtagctttcgttacgcctggtaacccaacagaaacctggccacggcctcccgagctcctcactctatgatcgacactaccgaaccgtacggggccctaacggtcggacctaccgtccccgaacggcccgttaagggtttccgaacgggttcgggaccgtagggtttcggggtacgttacgggtacgaactacggtaacccttttccaacccttcctacccaacctacttcgacgacctacggtacccgttaggaccgtcccgttaaaggaacgttacttacgtacgtacgtttaagttttacgttactcgtaccgacgacgtacggacgtaacgcgtaaccggtcgtcccttcttaccgtacggtttcgggacgggaaccggtacgaggggtagaacgtacgtaaccgaaacgtacggtcggacgtacacgtacctaccgtattcgttcgttcctaccg

SEQ ID NO: 73704 - DNA, 637 bp, Homo sapiens
  misc_feature: GYAE6OF01DP439.49.46.E02.1.454.CMB.1.raw
  modified_base (612)..(612): a, c, t, g, unknown or other
  misc_feature (612)..(612): n is a, c, g, or t
tcagagtcgagagacacgaccggtgctcgatttagactcatctacaggggaaaggggggaggaactgctcagttaggacccagagggaaccatggaagccccagctcagcttctcttcctcctgctactctggctcccagactaccaccggagtaaattgtgttgacacagtctccggccaccctgttctttgtctccgaggggacagtcgcccaccctctcctgcgacgggccagtcagtagttgttagtagtcttcgtagcctacggtaaccaacgaacgtaaacccgtcggaccacggcctcccgaggtcctcctcaactctatgactcggaccataccgaacgcgggacccacgtggccactcccagcctaggttcaggtgcgtaggtggtctgtacgacacgtacttcgaccttcaccactactacgacgacgtacgaccgttaaggccgtaccgtagaacgttacttcgtaggttacttaggtttttaactacgtggttaaccaggtcgaggtacgtaacgtacctaacggttcggccttccgtacgtcggtttacgggacgggtacggacgaggttcgagtaacgtaacaacggtcgtgggtacncgtacgacacgttctcgtcgttacc

SEQ ID NO: 73705 - DNA, 833 bp, Homo sapiens
  misc_feature: GYAE6OF01EOL7N.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccacctgtctttgtctccgagggacagtcgcccaccctctcctgcagggccagtcagagttgttagtagtctttcttagccgtaggtaaccaacgaacgaaacctggcccgaaggcccttccccgaggtccttcctctacgttacctatggattcgcctaacgttacccgaaaccggtcggggaccctaccggttacgggacctaaccgtcccccgaacggccccgttaaggggtttcccgaaggggttcgggtaacgtacggggtttacggggttccgttacgggttacgggaaccctaacgggttaacccttttaccctaacccgtttacccgttaccgaaaccccttaacgtacccgtaacgggtacccgtaaccggttaccccttaaagggaacccggttacccgttaaacgggtaaaagttacccttttaccggtagttaacccgtttaacggtttttaaacgtttacccgtagggttacccacgggttaccgaaacgggtccggttaacgaaccgttaaccggtcgggtcccctttaccgtacctttaccgggttcgggaccgggtaacgggaacccggtagggttaccggaagtaactaaccgaaacggttcgtggtacggcgttacgaccgtaccctcgttcctggttaccc

SEQ ID NO: 73706 - DNA, 710 bp, Homo sapiens
  misc_feature: GYAE6OF01C30EY.49.46.E02.1.454.CMB.1.raw
  modified_base (387)..(387): a, c, t, g, unknown or other
  misc_feature (387)..(387): n is a, c, g, or t
  modified_base (684)..(684): a, c, t, g, unknown or other
  misc_feature (684)..(684): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccacggagaaattgtgttgacacagtctccggccaccctgtctttgtctccgaggggacagtcgcccacctctccgtgccgacgggccagtcaggtagttcgttagtagtcctttacgttacggtcccgttagggtaaccaaaccgaaacgtaaaacccgtcgggaacccgacgggcccttaccccgacggtcccttcccttacaacttcttaatggtaattcggacctaacgtcccgaaaacggngggtacctacgtcgggaccaaccgttccccgacgcccgtaggttaccgaggtacggcgtagggttcgggtacgtggtacgaacgtacgtaccttacgtaccttcctaccaccgtaatccgacgtacacgtccgtaagccggtacctagaacgttactttacgtcgtactttaagtttacttacgtcgtaccgtagcgagtacgtacgactacgtcgtacctcgttaccgtacggttcgggaacggtacgggtaactaggggtacgacgtaacgtacggaaacggtagtcggtacggngtaccgacacccttctgttccgtacc

SEQ ID NO: 73707 - DNA, 618 bp, Homo sapiens
  misc_feature: GYAE6OF01AXSX8.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacgagaaacctggccaggcctcccaggcctcctcatctatgatgcactccaacacgggccacgtggcactcccagccaggttcaggtcggctaggtgggtctgtagactagacttcactctacaccatcagtccacgacctaggacgcccgttagaaacgtacgttctagtaccgtttaagtttatttacgtcgtacagtacgaaggtcgtacgactaacccgttccgggtcccctttaccttaccgttaccggtttcggggaccgggaaccgggtaaccgaacggggtaggtaacgagttaaccgaaacggtaacgttgggtacgcgtacggaccctaaccgtacgtctttcgtaccg

SEQ ID NO: 73708 - DNA, 685 bp, Homo sapiens
  misc_feature: GYAE6OF01BWGTO.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtcctccgaggggacagtcgcccaccctctcctgccagggccagtcagagtgttagtagcttctagcctaggtaccaacgagaaacctggccaggctcccaggctcctcatctatgatgcatccaacgacggggccacgtcgggaccactccccgacggtaccctagggtttcaaggttcggcgtacgggttggggtccttaggttacgaacctacggtacctttaccaaccgttccctaccaacccacttccacgacctacgacccttaaggaccgtaccgtagaaacgtactttacgtcggttaacttaacgtttttaacttaacgttggttacctacggtacaacggtcgtaacggaaccttaaccgtcgggtcccctacgttacccgacgttttccgggaccgggtaacgggtaaccggaagggttacggaggtaacgttaccgaaaccggtacgtcggtcgtacgtcgtacgtaaccctcttcgtcgttaccg

SEQ ID NO: 73709 - DNA, 805 bp, Homo sapiens
  misc_feature: GYAE6OF01BJM8X.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagactaccgacggagaattgtgttgacacagtctccggccaccctgttctttgtcctccgagggacagtcgcccacctctcctgcgacgggcctagtcaggtagttgttagtacgtcctttcgtacgccgttacggtaaccaaacgaacgtaaaccgtcggacccgtaagggtccctacccgacggtcccttccctactacttccttagtcgtacgttacgacctaacctaccgaaaccggacgggaccctaaccgtcgggacctaaccgtaccccgagtcccgtaacggttcgaggtcggtacgtagggttcggttcgtacggtacgtaaccgtacgtaccttaccgtaccttcctaccaacccgttatacccgaacgccgtaaccggtaccgtaacggaccgtaccgtaaaggtaacgttacgtttacgtaacgtcgtttaaacgttttaccgttacgttacggttacgaacgtaccgtacggttacctaacgtacccgttaacgttccgtcccttacggttacccgttagggttacccggggaacgggaaacgggttaccggtaagggtaacggtaacgtaaaccgggttaaacctaaacccgggttacgtacgggtacggttaccaacggtaccccttaagttaccggtttcttaccggtttaccc

SEQ ID NO: 73710 - DNA, 620 bp, Homo sapiens
  misc_feature: GYAE6OF01BNOCO.49.46.E02.1.454.CMB.1.raw
  modified_base (262)..(262): a, c, t, g, unknown or other
  misc_feature (262)..(262): n is a, c, g, or t
  modified_base (437)..(437): a, c, t, g, unknown or other
  misc_feature (437)..(437): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccgaggggacagtcgccaccctctcctgcagggccagtcagagtgttagtagcttcttagcctggtaccaanagaaacctggccaggcctccaggtctcctcatctatgatgcactccgaacgacgggccaacgtggaccactaccccgagccctagggttcaggtcggctagggtcgggtctggtgaccagtaaccttcacctcctacacctatcgacgcacggtacctagacgccctagaacgtntttcgtagtacttaagttttactacgtgtcagcacggtctacgacctacggtcgtacccttgtccgtacggtttccgggacgggtaaccgggtaaccgtaagggtacggaacgtacgtaaccgtaaaaccggtacgtcggtacggccgttacacccgtaacctcgttaccgttcggtttaccc

SEQ ID NO: 73711 - DNA, 699 bp, Homo sapiens
  misc_feature: GYAE6OF01EE4WS.49.46.E02.1.454.CMB.1.raw
  modified_base (685)..(685): a, c, t, g, unknown or other
  misc_feature (685)..(685): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagactaccgaccggagaaattgtgttgacacagtcctccggccacccttgttctttgtcctccgaggggacagtcgcccacccttctccgtgccgacgggccagtcagtagttgttagtagtcttctagcctacggtaaccaacgaacgaacctggaccacggcctcccgaggcctcctcatctatgactgctactaccgaacgacgggaccctacgtcggacaccgtacccacggccgtacggttcaggtcggcgtagggttcgggtctaggtacgacgtacggtaccttacgtaccttcgtaccaacctacttaccgacgtacgtacggtaccctacgggtactacccggttagaaacgttactttcggtaacgttaccgtttacgttttaacgttacgttacgtacgtacgttacgaacggtccgtaacgtacctacggtccgtaccttcgttccgttacgggttaccgggcggtaacggacggtacggtacggaagtaccgtaacggaaacgtcgggtgttaccggcctacggtactaaccgtnttccggtcttaccg

SEQ ID NO: 73712 - DNA, 827 bp, Homo sapiens
  misc_feature: GYAE6OF01BXESX.49.46.E02.1.454.CMB.1.raw
  modified_base (781)..(781): a, c, t, g, unknown or other
  misc_feature (781)..(781): n is a, c, g, or t
  modified_base (790)..(790): a, c, t, g, unknown or other
  misc_feature (790)..(790): n is a, c, g, or t
tcagagtcgagagacacgaccggtgctcgatttagactcatctacaggggaaagggggaggaactgctcagttaggacccagagggaaccatggaagccccagctcagcttctcttcctcctgcctactctggcctccagactaccaccggagtaaattgtgttgacacgagtctccggccacctgttctttgtctccgagggacagtcgcccaccctctccgtgccgacggccagtcagtagtgttagtagtcttcgtacgccgtacggtaaccaacgaacgtaaccgtcggacctaacggtccctacccgacggtccttacctacgtacttacgttaacgtacggacttaccgacctaaaccgttacccgaaaccggacgggtacccctaacggttacggaccctaaccgttaccccgacggtacccgttacggttacgacgggtacggtcgtagggttcggttacgtacggtacgtaccgtaacggttaacctccgtactacccgtaccgtaaccgtacttaccgaacggtccgtaaccggttacccgtaaggtaaccgttaccgggtaaaacgtcgtttaaccgttccggttaacggttaacgtttttaacgttttaacgtacccgtttaggacccgtaagtaccggtaacgggttaccgtaaccggtaaccgtaccggttacccggttaccttacgggtacggtttaccgggttacgggaacggggtaacgtaaccggtagggtaccggaacgtacggtaaacgaaccggttacgngggtacccncgttaacgacccttacggtttctacggttccttaccg

SEQ ID NO: 73713 - DNA, 848 bp, Homo sapiens
  misc_feature: GYAE6OF01CG2MA.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctcggcctcccagactacccgaccggagtaaattgtgttagacacacgtccgtcccggcctacccttgttcctttgtcctaccggaggggtacagtcgccctaccctctccgtgccgaggcctagtacaggtagttagttagtacgtctttcgttacgccttacggtaaccaacgaacggtaaacctcggaccgtaacggtcccgtaccccgaggtcccttcccttactaacttccgttaagtcggtaactcgaacctacgtaccccgaaaacggtaccggggtaccctaccggttacgggaccctacccgttaaccccgacggtacccgttaagggttccggagggtacggtcggtagggttcgggttacgtaggtaccgtacgtacgtaccctttaccgacctttacgtaccctaaccgtactaccgacgaccgtaccggtacccgttaacggaccggttacccgtaacggttaacgttaccgttacgtaccgttacgtttaaacgtttttacgttaccgttacggtacgtacgtacccggtaagtccggttaaccgaacgtacccgggttcgttacccttacgttacccgggtacggttccggggtaaccgggtaaacgggtaccgtaagggttaacggaacgtaacgtaaccggaaacggttccgtaggtacccggtacctaacggtaccctaaggttcttcccggttacgttaccg

SEQ ID NO: 73714 - DNA, 784 bp, Homo sapiens
  misc_feature: GYAE6OF01C0GBM.49.46.E02.1.454.CMB.1.raw
  modified_base (751)..(751): a, c, t, g, unknown or other
  misc_feature (751)..(751): n is a, c, g, or t
  modified_base (769)..(769): a, c, t, g, unknown or other
  misc_feature (769)..(769): n is a, c, g, or t
tcagagtcgagagacacgaccggtgctcgatttagactcatctacaggggaaaggggggaggaactgctcagttaggacccagagggaacctatggaacgcccagctcagccttctcttcctctgctactctggcctccagataccacggagtaattgtgttgacactaggttctccggcctaccgtgttcttgtcctcgaggggacaggtcgaccctacccttcgtccgtggtaccggacgggcctacggtaccaggtaacgtttggtttacgtacgttcgttttaccgttaacggcccgttagggtaaaccaaacgtaaaccgtaaaacccggtcgggaccgaacgggtccccttaccccggaagggtcccttaccgttaccgtaacttccgtaacgttcggaacgttcgaacctaaaccggtcccgaaaacggtccggacccgtacggttaccggacctaaacccgttaacccgacggtaccggtaacgggttacggacggttaccggaggttaccgggttgggtccgttaggtaacgtaaccgacggttaccttcgtaaccgttccaacgtaacctcgactagactaacggtctaaccggacgaccgttaaggtaacctacttacggtaactaccgtttaattttaacggtaccttacggaactacggtacgacgtacggactacggtacttacgtccgtacttcgtaccgtggacggtggaacgtaggagacgtaagaacgtacgnggtcgacgcgtcaccctntacgtagctttaccg

SEQ ID NO: 73715 - DNA, 857 bp, Homo sapiens
  misc_feature: GYAE6OF01BTCIA.49.46.E02.1.454.CMB.1.raw
  modified_base (215)..(215): a, c, t, g, unknown or other
  misc_feature (215)..(215): n is a, c, g, or t
tcagagtcgagagacacgaccggtgctcgatttagactcatctacaggggaaagggggaggaactgctcagttaggacccagagggaaccatggaagcccagctcagcttctcttcctctgctactctggctccagactaccaccggagtaattgtgttagacacagtctccggcctacctgtctttgtcctccgagggtacagtcgccacctcncctgcagggcctagtcgagtagttagttaagtacgtcctttacgttacgtccgttacggtaacccaaacgtaacggtaaaacccgtcgggaacccgagggtaccctacccggacggtcctacctacgtaacttacctaagttagtaacgttcgacctaacgtaacccgaaaccggaccgggtacccaacgttacgggaacctaccgtaccccggaacgtacccgttaagggttaccgagggtaccgggtacggtaacgggttcggggtacgtttacgggaaccggttaacgtaaccggtttacctttaacccacctttaacccgtacccgaaaccctacgttaaacggaccgaccggtaaccggttaaccggttaacggaccggtaacccgttaaaggaaaccgttaccgttttaccgtacgtttaaccgtttttaagttttacctaaacggtttcgtaaccgtacgtaaccggttaaggttaccgtaacgaacccgtttaacggccggttaccttacgtacgttaccgggtacggggaaggaaaccgggtacgtaaaggggtaccgtaagaaccgtaacggaaacggttacggtagttaccgggacttaccgtactaccggtaacttcgtttacgtacccg

SEQ ID NO: 73716 - DNA, 759 bp, Homo sapiens
  misc_feature: GYAE6OF01BJGU8.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtctccgaggggacagtcgccaccctctcctgcagggcagtcagagtgttagtagtcttcttagcctggtaaccaaacgaacgaaaccgtcggacccgacggcccttacccgacggtcccttcccgtactacttacttagtgtacgttacggacctactacccgaacggacgggaccctacgtcggacctacgtcccgacggtccgtaaggtttccgaggttcggacgtagggtcggtacgttcggttacgacgtacggtaccttctaccgttacctaccaacccgtacttaccgacggtacccaacgggtaccccttaaggacccggtacccgttaaggtaaaccgttactttacgtacgtacgttttaagttttaaccggttacgtacgtacgtacggtacgtaacggcggtaacgtaccgtaacggttccgtacccttcgttaacgttaccggggtttaccgggaaaccggggtagggtaaccgttaaaggggtacggtaacggtaaccgttaaggtaaaaccggtggttacggtccgtaacgtcgacgaactaccgttgttacgttccg

SEQ ID NO: 73717 - DNA, 741 bp, Homo sapiens
  misc_feature: GYAE6OF01BZZ72.49.46.E02.1.454.CMB.1.raw
  modified_base (336)..(336): a, c, t, g, unknown or other
  misc_feature (336)..(336): n is a, c, g, or t
  modified_base (375)..(375): a, c, t, g, unknown or other
  misc_feature (375)..(375): n is a, c, g, or t
tcagagtcgagagacacgaccggtgctcgatttagactcatctacagggaaagggggaggaactgctcagttaggacccagagggaaccatggaacgccccagctcagcttctcttcctcctgctactctggcctccagataccaccggagtaaattgtgttgacacagtctccggccacctgtctttgtctccgaggggacagtcgccctaccctctccgtgcagggccagtcaggtagttggttagtacgtcttcgttacgccgtacggtaaccaaacgaacgaaaccgttcggccctaaggtccctacccgaggtcccttcctacattctagngtaactgactactaccaaacgcggcccagtcggactacncccgaagtccgaggttcaggtcggactaggggtcggttctaggtacgaactacgtaccttactaccgttccaacctacctacgtcgaacgtccgtaacgtacctagggacctaccgttaaggaacttcttacgtacgtacgtttaacgttttattaccgagttaccgaaggtcccgtaaggtacccgtaagaacccgtaacccgggtcgttaccccttacgttaccggttacccgggttaccgggggaacgggtaaaccggggacgttaaacgggggtagaaaccgtaaccgtaaacggaaaccggttacgtggttaccgggtacctacccggaaccttaaccgtaccgtttcgtacgtttacccg

SEQ ID NO: 73718 - DNA, 742 bp, Homo sapiens
  misc_feature: GYAE6OF01BRYLZ.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggcctcccagactaccaccggagtaaattgtgttgacacagtcctccggccaccctgttctttgtcctccgaggggactaggtcgcccaccctctcctgcacgggccagtccaggtagtgttagtgtcctttcttacgccgttcgggtaacccaaacgtaacgaaacccgttgggacccgtaacgggtcccctccccgaacgggtcccttaccctataacttccgttatacggactggacctaactacccgaaaccggcgggtacccacgtcggcctaccgtccccgacgtccggtaccgttcgacggtcggacgaggggttcggttcgtgtacgacgtaacgttacttaccgaccttaccgacccgtacctacgtactacggaccctaacggtacccgttaggaccgtaccgttaaggaacgttacgttcgtacgttacgtttattttacgttaacgtcgtacgtacgtcgtagtacgtaccgaactaccgtccgtcccgttaccttcgggttaccggttcgggaccggtaacggacggtaacggtaggaacgtaacgtaaccggaacggtacgtggtacggtcgacacccgtatccgttcgtcgttcccg

SEQ ID NO: 73719 - DNA, 757 bp, Homo sapiens
  misc_feature: GYAE6OF01D12J0.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgcccaccctctcctgcagggccagtcagagtgttagtagctttctagcctaggtaaccaacagaaacctggaccaggcctacccgaggtcctcctcactctatcgaatcgctactaccaacgcggaccacgtggacctactcccagccgtaggtcaggtcggcgtaggtcgggtctggtacgaccgtagtccttccacgttcctaccgaacctactaccgacgtacctaacggtacccgttaaggaccgtaacccgttaaggtaacgttactttccggtacgttaaccgtttaagtttttaaccttaccgttacggtacccgtaacggtccgtaacgggtacgttaaaccgtaacccggtaaccgttcccgggttaccctttacccggttaacccgtttacccgggtttacgggggaaccgggtaaacccggggttaaaccggtaacgggtaacgggtaaccgtaaaccgtaaaccggaaaaccggttaccggtacgggttacggtacccgtacgaacccgttaaccctacggtttccgttccgtttaacccg

SEQ ID NO: 73720 - DNA, 667 bp, Homo sapiens
  misc_feature: GYAE6OF01DWFU9.49.46.E02.1.454.CMB.1.raw
  modified_base (660)..(660): a, c, t, g, unknown or other
  misc_feature (660)..(660): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagtagtgttagtagcttcttagcctggtaccaacagaaacctggccaggctcccgaggcctcctcatctatgatgcactccaacgcgggcccacgtggcactcccgagtccaggttcaggtcggcgtaggttgggtctggtcgaactacggtaccttcaccttcctacaaccctataccagtaccgacgtaccttaacggacggtaccgtacggtaaacgtactttcgtacgtacgttaaggttttaactttacgttacgttacgtacggacgtacgtaccggtaacggacctaaccgttcgggtacccgttaccgtccgttaaccggtttccggggaacgggtaccgggtaaccggaacgggttaggaacgtaacgtaacgtaaaccgggtaacgtcggtaggaccgttacgaccctacgtactccgttnttacccg

SEQ ID NO: 73721 - DNA, 854 bp, Homo sapiens
  misc_feature: GYAE6OF01C6SYG.49.46.E02.1.454.CMB.1.raw
  modified_base (714)..(714): a, c, t, g, unknown or other
  misc_feature (714)..(714): n is a, c, g, or t
tcagagtcgagagacacgaccggtgctcgatttagactcatctacaggggaaaggggggaggaactgctcagttaggacccagagggaaccatggaagccccagctcagcttctcttcctcctgctactctggctccagactaccgacggataaattgtgttgacacagtcctcccggccctaccctgttctttcgtccgtccgaggggactagtcgccctacccttctccgtcgacgacgggcccaggtcgaaggtaggttagtttaagtacgtctttacgttacgccgtacggtaaccaaacaacgtaaaccgtcggaccgacggaccctaccccgaaggtccctccttacgaactttacgtaagtggtaacgtcgaacctaactaacccggaaaccggaccggggtaccctacggtacggacccctaaccgttacccccgaacggtacccggttaaacgggtttaccgtacgggtaccgggggtacggttaacggggtttcgggggttaccttcggggttaacgtaaaccgtaaccggttaccctttaccgtacccttaccgtaacctaaccgtacgaccgtacgacccgtaacgttacccgaagggtacctaccggtaagttacgtagttcgtacgtaacgttttaagttttaacttcgtcgtaccgtaacgtcgtaacgggttcgtaaacgtccgtaacggtcgtaacncccgtttacgttaaccggttaccgggttacggggaaccgggaacggtaccgggttaaaggacgggaaaacgtttaaccggaaccgtaaaacggttcgttacggaacggttcgtacccgaccttaacgtcggtttactacg

SEQ ID NO: 73722 - DNA, 637 bp, Homo sapiens
  misc_feature: GYAE6OF01B9AM6.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcagggccagtcagtagtgttagtagcttcttagcctaggtaccaacagaaacctggaccaggcctcccgaggtcctcctcatctatgatgcactccgaacgacgggccacgtggacactcccagcctaggtcaggtggctaggtggtctggtagactacgtacttcgaccttctaccacctactacgacgcgaacgtccctaaggacgtcctaaggaacgttacgtttccgtacgtactttaagttttaacgttacgtcgttacacgtacgtagtaccgttacgacgttaaccgtccggttaccttcgtacgttacggttccgggacggggtacggtaccggtaagggtacggaacggtaactaacggaaacgtacggtcggtacggaccgtcgaccctacgtcttccgttcgttaccc

SEQ ID NO: 73723 - DNA, 670 bp, Homo sapiens
  misc_feature: GYAE6OF01DXBOH.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgagggccactggacatcccagccaggttcagtggcagtcgggtatgtgactacgacttcactcctacaccataccagacacgcctaagacgaccccgtaaagtctttaccgagtaccgttaaggtttttaacttaccggttacggtttacgaacgtacggtaacggtccgggtttaacgacccgttaaccgttcgggtaccccctttcgttacccgttaccggttttaccgggggaccggggtaaacccggggaacccggttaaaggggtcgggtaaagtaaccgtaaaccgtaaaccggaacgttcggtacgggcttacgggaccctaaacccgtattaccgttccggttactttaacccg

SEQ ID NO: 73724 - DNA, 758 bp, Homo sapiens
  misc_feature: GYAE6OF01DKS4Z.49.46.E02.1.454.CMB.1.raw
  modified_base (545)..(545): a, c, t, g, unknown or other
  misc_feature (545)..(545): n is a, c, g, or t
  modified_base (613)..(613): a, c, t, g, unknown or other
  misc_feature (613)..(613): n is a, c, g, or t
  modified_base (695)..(695): a, c, t, g, unknown or other
  misc_feature (695)..(695): n is a, c, g, or t
  modified_base (733)..(733): a, c, t, g, unknown or other
  misc_feature (733)..(733): n is a, c, g, or t
tcagagtcgagagacacgaccggtgctcgatttagactcatctacaggggaaagggggaggaactgctcagttaggacccagagggaaccatggaacgccccagctcagcttctcttctcctgctactctgctccagactaccgacggataattgtgttagacacagtcctcccggcctacctgttcttgtcctccggagggacagtccgcccacctctcgtgcgacggccagtcaggtagttgttacgtagtcttacgttacggcccgttaggtaaacccaaacgtaaccggtaaacccgtcgggacccgtaacggtaccccgttcccgacggtacccttacccgtactactttaccggtagtcggtaatccggacctaacctacccgaacggtacccgggtacccaacggttcggaacctaccccgtacccggtacgtaccccggttaggttaccgtacgggtacgtacggtaagggttccgggttactacgggttaacgacctaaccggttcttactacctcctaacgtaccagttacgacnccgtaacgtaccgtacgaacgttctaaggtacgtcgtttcgacgttagttacgtttacagtcgtacgngtacgttagtacggcctaacgtaccgtcgttaacccctcgtaacgttaccgggtccggaacgggtaaccggagtacgggtanaacggttacgaacgtaaagttcggagggacctacggtnaaccccgttatcgttcgaacttccg

SEQ ID NO: 73725 - DNA, 795 bp, Homo sapiens
  misc_feature: GYAE6OF01A50R2.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagagtgttagtagcttcttagcctggtaccaacagaacctggccaggcctccaggctcctcatctatgatgcatacccaacgacgggccagtcggactactccccaaggccctagggtttccaggtcggtcgtacgggttggggtactggttacggaaccgagggttaaccttccgacccttcgtacccaaccggtactccgaacgccacggtaccctagggaccgtaccgtaggaacgtacgttccgtagtaccgtttaagttttacgttaccgtttacgtaccgtagtacccgtaacggtacggttaaccgaaccgttaaaccggtcccggtacccccgtttaccgtttaccggttaacccgggtttacccggggtaaccggggggtaacccggggtaaacccggggtaaacggggttaaaccggggtaacgggttaaacccggttaaaccccgggtaaaaaccgggttaaccgttaccggggggtttaacgtaaccccggttttacggaaacccccgtaacccggtttaaaccggtttccgtttaacccgggtttacccccg

SEQ ID NO: 73726 - DNA, 649 bp, Homo sapiens
  misc_feature: GYAE6OF01CTHS4.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagatacccaccggagaaattgtgttgacacagtctccggccaccctgttctttgtctccgaggggacagtcgcccaccctctcctgcgagggccagtcagagtgttagtagtcttctagcctggtaccaacgagaaacctggaccacggcctacccgaggcctccgtcactctatgatcgacactccaacgacggccacgtcggcactcccgagccgtaggttcaggtcggcgtaggtcgggtctggtacgacgtagtacctttcgacctttccgtaccacccgtataccgacgaccaccgtaccgtaacgacgtccgtaaggaacttacttcgtagtaccttaagtttttattaccgtggtactacggcgtaggtaccgtagacctaacgttcggtcctcgttaccgttcggtttacgggaacggtacgggaacgaagggtcgggaacgtaacgtaaccgaaacggtacgtgggtaccgtcgtaccggactacctacgttctcggtttaccc

SEQ ID NO: 73727 - DNA, 613 bp, Homo sapiens
  misc_feature: GYAE6OF01DZIGI.49.46.E02.1.454.CMB.1.raw
  modified_base (297)..(297): a, c, t, g, unknown or other
  misc_feature (297)..(297): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggcaccctgtcttgtctccagggacagtcgccaccctctcctgcagggccagtcagagtgttagtagcttcgttagcctggtaccaacagaaacctggccacggctcccgaggcctcctcatctntgatgcatccaacgaggccactggacatacccagccgtaggttcaggtacggcaggttcgggtactggacgacagtaccttgacctctcacctatccagccagccctaggactccgtagaagtacttctgtacttaagttttatacgtgtacgagactagcgttagacctaacgtcgggtccttcttacgtacgtttacggggacggtaaccgggtaccgtaagggttacgggaaacgtaaccgtaaccggaaaacggtaccggttagggtaccggacttaaccggacctaaaccctggttcccttcggtttaccc

SEQ ID NO: 73728 - DNA, 628 bp, Homo sapiens
  misc_feature: GYAE6OF01BK90L.49.46.E02.1.454.CMB.1.raw
  modified_base (438)..(438): a, c, t, g, unknown or other
  misc_feature (438)..(438): n is a, c, g, or t
  modified_base (496)..(496): a, c, t, g, unknown or other
  misc_feature (496)..(496): n is a, c, g, or t
  modified_base (502)..(502): a, c, t, g, unknown or other
  misc_feature (502)..(502): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtcctccggccaccctgttctttgtcctccgaggggacagtcgccacccttctcctggccgacgggccagtacgagtagttgttagtacgtcttacttacgcctaggtaccaaacaggaaaccgtcggaccaggtcctccgaggtcctcctcatctatgactcgctactaccgaacgacgggcccaagtcggacctactcccgaagtccgtacggttcgaggtcggacgtaggtcggtctggtacacgtactacttcacctcctacaacctancgagacgacgtacgagacgctaagaacgtacttacagtactttacgttatacgtctanagtacngtacgacgactacgtcgtacctcttccgtacgtaccgggtacgggtaacggtaccggaggtacggtaacgtacgtaagtaaccggtacgtcggtacgacgtacgactaacgtcttcgttcgtaccg

SEQ ID NO: 73729 - DNA, 848 bp, Homo sapiens
  misc_feature: GYAE6OF01AC3V9.49.46.E02.1.454.CMB.1.raw
tcagagtcgagagacacgaccggtgctcgatttagactcatctacagggaaggggaggaactgctcagttaggacccagaggaaccatggaagccccagctcagcttctcttcctcctgccttactctggcctcccgagactacccaccggagtaaacttgtgttcgacactacgtcctaccggccctaccctgttctttcgtcctccgaggggacagtcgcccacccttctccgtgccgaacgggcctagtcaggtcgttgttacgacgtcctttcgtttaacgcccgtttaggaaccctaaacgaacgtaacccgttaggcccgaacggtccctcccgtaaggccttcccgtctactccgtagtcgtacttcggactaacctaccgaaccgtacgggtacccacgtttcggaccaccgttaccccgacgttaccgtacgggtttacgtcggtacggtacgtagggtaccgggtcttaccgggaacttaccgacgttaccttaccgtacccgttacctaccgtccttaacgttacccgagtaccgttaacccggaccgttaacggaccgttaccgtaacgggttaaccttacgttaccgtcggttaaccgtttagtttacccgttaacgttacgtaccggtaacgtacgtacggttaacgtccggaaactacccggttcggtaacccgtttccgttacggttaacccggttcgggtaaccggggttaacccggaggttaaacggggtcccggtaaacggtaaccttaaaccgggaaaccttaacgggttccgttcggaaaccgttccgaacccgttccttaacgtaaccggttttcgttaaccccgg

SEQ ID NO: 73730 - DNA, 653 bp, Homo sapiens
  misc_feature: GYAE6OF01A127U.49.46.E02.1.454.CMB.1.raw
  modified_base (440)..(440): a, c, t, g, unknown or other
  misc_feature (440)..(440): n is a, c, g, or t
  modified_base (463)..(463): a, c, t, g, unknown or other
  misc_feature (463)..(463): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagtcttctagccgtaggtaccaacagaaccgtggccaggtcctcccgaggcctcctacacttctatgatgacactccaacgacgggccacgtggaccactccccgagtacccgtaggtttacacggtcggacgtagggttcgggtcgttggtacgaaccgtaggtaccttacgaccgttctaaccgaaccgtactcgacncgtacgaccgtagacgccggtanaacgtacttcgacgtacgttaagttttcgtacgtagtacgaacgcgtacgtacgtacgaccgtacgttcgtacccttcgtacgttaacgggttcggaaccgggtaccgggtaacgagggttacggaacggtaactaacccggaaacgtcgttacggtcgacgtaccgtcgtaactacgttgttcgtaccc

SEQ ID NO: 73731 - DNA, 751 bp, Homo sapiens
  misc_feature: GYAE6OF01E2LLI.49.46.E02.1.454.CMB.1.raw
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgcccaccctctcctgcagggccagtcagagttgttagtagtctttcttagcctaggtaccaacacgaaaccctggccacggcctcccgaggcctcctcatcctatnatgctactacccaaacgacggggccctacgtcggcctacctaccccacggtcccgtaagggtttcgaacggttcgggaccgtacggggtttcggggttacccgtggttacgaacccgtagtaccctttaccgtacccttccgttaccaacccgtataccgacgtaccacggtacccgtaggaccgtaccgtaggtaaacgttctttacggtaccgtacgtttaagtttttaaccgtttaccgttacggttaccacggtaccgtaacgggttacccgtaaggaacccgttaacgtccgggttacccttccgttaccgttaccgggtttccggggaccgggtaaacggggaccgtaaaggggtacgggaacggtacctaaaccggaaaacggtacggttcgggacggtctaccggaccctaccgtcgttccgttcgttacccg

SEQ ID NO: 73732 - DNA, 622 bp, Homo sapiens
  misc_feature: GYAE6OF01ANVVO.49.46.E02.1.454.CMB.1.raw
  modified_base (308)..(308): a, c, t, g, unknown or other
  misc_feature (308)..(308): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggcctcccgaggcctcctcatctatgatgcacnccaacgagggccacgtcggcactcccagccgaggttcagtggcaggtcgggtctgtgacagtacttcactctccaccatcagcacgacctagacgcctagaacgttacttcgtgtacttagttttactacgtgtacccgtaggactacgggtacgttaacggacctaacgggttccgggtacccttcccgttacttacccggtttcgggggaaccgggtaaccgggtaaccggaaacgggtagggaacgtaacgtaccgaaaacggtcgttagggcggtcttaccggactaccctagttcccggttagttcccg

SEQ ID NO: 73733 - DNA, 562 bp, Homo sapiens
  misc_feature: GYAE6OF01D39CK.49.46.E02.1.454.CMB.1.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccagggacagtgccaccctctcctgcagggccagtcagagtgttagtagcttctagcctggtaccaacagaaacctggccaggcctcccgaggctcctnatctatgatgcatccaacngggccagtggcactcccagccaggttcagtggcaggtcgggtctgtagactagacttcactctcaccatacagcacgcctaagcgccttagaacgtntttcgngtcttagttttatacgtgtacagacaggtcgtaagacaacgtcggtccttctccgtacgtttaccgggacggtaacgggtacccaaaggggtcggaagtaacgtaacgaaacggtactggtacggctcgacccaccattccgtgttaccc

SEQ ID NO: 73734 - DNA, 873 bp, Homo sapiens
  misc_feature: GYAE6OF01BCXT7.49.46.E02.1.454.CMB.1.raw
  modified_base (224)..(224): a, c, t, g, unknown or other
  misc_feature (224)..(224): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagtaaattgtgttgacacagtctcccggccaccctgtctttgtctccgaggggacagtcgcccaccctctcctgcngggccagtcagagttgttagtagcttcgtagcctaggtaaccaacgacgtaaaccgtcggaccaggtcctacccgaaggtcccttcctaccatttcctacgtagtattcgaccgtactaccccgaaaccggacggggccctaaaccggtccgggtaccaacccgttccccggaaggtacccccgttaaggggtttcctaacggggtcggggtaccttacgggggttgggtttacccgttgtacggaacgttaacggtacctttaccacgtttccctacctaacccgttattccggaaacgacccgtaccgggtaccgtttaaccgggaccgttacccggttaaaggtaaacggtttacgttttaccgtacgttacgttttaacgtttaaccgtttacgttaccggttacgtacggtaccggtaacggttaccgttaaacggtacccttaaccggtcccgggttaccctttacccggttacccgttttaacccgggtttcccgggggaaccggggttaccgggggaaaaccccggttaaggggtaaacgggtaacggtaaaccgttaacccggggaaaacgttaccggtacggggtttacgaacccggtttccgaaacctacccgtttacgttcccgtttgttacccccg

SEQ ID NO: 73735 - DNA, 779 bp, Homo sapiens
  misc_feature: GYAE6OF01BDCT2.49.46.E02.1.454.CMB.1.raw
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagactaccaccggagaaattgtgttgacacagtctccggccacctgtctttgtctccaggggtacagtcgccctaccctctcctgccagggccagtcagagttgtagtancttctagcctaggtaccaanacgaaacctggaccaggtcctccgaggcctcctcatcctagtgatgactacgtccaaacgcgggcccagtcggactactcccgacgaccagggtttcaggttcggacgtaggtcggtctagggtacaacgacgtaccttacaccgtccttaccaaccgattaccgaagtaccgacggtacccgttaaggaccgttaccgtacggtaaaacgttaccgtttaccggtagttaacccgttaaaggtttttttaacgttaaccccgtttaggttaacccgtaacgggtaaccggtaacgggttaaccggtttaaccgggaacccggttaaacccggtttccgggtaccccttttaacccggttaccgtttaacccggggtttaccggggaccgggggtaacccggggttaaaccggtacggggttaacggtaaaccggtacgttaacccggaaaaacggttcgttacgggttaccggacttaaccgaaccgtacccgtgtttacctccggtttaacc

SEQ ID NO: 73736 - DNA, 695 bp, Homo sapiens
  misc_feature: GYAE6OF01BEK9W.49.46.E02.1.454.CMB.1.raw
  modified_base (198)..(198): a, c, t, g, unknown or other
  misc_feature (198)..(198): n is a, c, g, or t
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtcttgtctcgagggacngtcgccaccctctcctgcagggccagtcagagttgttagtacgctttacgttagccgttaggtaccaaacgtacgaaaccgtcggaccaagggccttaccgacggtcctcctcgtactctatcgatcgcatccaacgcggcctagtcgacctactcccagtccgtaagttcaggtggacgaggttgggtctggtacacgtacgtacttacacgtcctacgaaccacgtacaagtccgtagacctaacggtaaccgtccgtagtaaaccgtntttacccgngttaacttaaggtttactttacgacggttacagcgttaaggcgttagaaccgtaccgttcggtacctccggttacgttaccggtttcgggggacccgtaaaggggtaccggtaaagggggttcgtaaaccggtacttaaaaccggaaaacgggtacgttcggggttacgaaccccggttgaccccggtaaatttcccgtcggttcgttttaacccgg

SEQ ID NO: 73737 - DNA, 634 bp, Homo sapiens
  misc_feature: GYAE6OF01ET9RU.49.46.E02.1.454.CMB.1.raw
  modified_base (262)..(262): a, c, t, g, unknown or other
  misc_feature (262)..(262): n is a, c, g, or t
  modified_base (311)..(311): a, c, t, g, unknown or other
  misc_feature (311)..(311): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagctttcttagcctggtaccaanaagaaacctggccacggctcccaggctcctcatcatgatgcactaccgnaaactacggggcccaactcggcactccccgtagccagggttccagttggcaggtgggtctggtgtacagacttcactctcacactcgacgcacgacctagacgtcctcgacgtattactcgtactagtttacttaacgtcgtacgacgtacgtacgtaccgtacgtacctaaccgtccggtacccgttaccgtaccgttaccggttaccggggtaccggggtaacggggtaaccggtaacgggttaacggtaaacggtaacgttaaccgtaaaaccggaaaccgtacggtacgggtaccgtacggtacccgtaacccgtaccg

SEQ ID NO: 73738 - DNA, 693 bp, Homo sapiens
  misc_feature: GYAE6OF01BSR7G.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcgagggccagtcagagttgttagtagtctttcgttagccttaggtaaccaacgaacgaaaccgtggaccaggcctcccgaggcctcctcatctatgatgcactccaacgacgggcccacgtggaccactcccgacgccgtaaggttcacggtggacgtagggttcgggtctggtacgacgtagtaccttcgacttcctacacctatccagacgacgaccgttagacgtaccgtaggtaacgtctttacgtacgtactttaagttttaacttacgttcgtaccaggtaccgtaggtacgtaacgtaccgtaaccgttccgggtacccttaccgttaccgttaccggtttaccggggaaccgggtaaccgggtaaccggtaaggggtacggtaacgtaaccgtaacggtaaaacccggtacggttacggtacggtaccgtacgacccgtaaccgttcgttccgttcgtttaacccg

SEQ ID NO: 73739 - DNA, 754 bp, Homo sapiens
  misc_feature: GYAE6OF01A244P.49.46.E02.1.454.CMB.1.raw
  modified_base (234)..(234): a, c, t, g, unknown or other
  misc_feature (234)..(234): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtcctccgaggggacagtcgcccaccctctcctgcagggccagtcagngtgttagtgcttcttagcctggtaccaacacgaaacctggaccaggcctacccgaggcctcctcatctatgatgactactacccgaaacgacggggccctaacgtcgggaccctaacgtccccccgaagtccccgtaagggtttacccgaagggttcggggaccgttaggggttcgggggtttaccgttacgggttaacggaacccgtacggtttaccctttacccgaaacccgttttcccttaacccaacccgtaattacccgaacggtccgaaccggttaacccgttaagggaccgtaccccggttaggaaacgttacgtttcgtacgttacccgtttaagttttaacgttaccgttacggtacgtacgtaccgtacggtacgtaacgtaccgtaccggttccggtcccttcgttaccgttaccggtttacgggaccgggtagggtaccgtaaggggcgtaacgtacgaacaaacggtcgtacggtcgacgtacgacctaccgtctcgttcgttcccg

SEQ ID NO: 73740 - DNA, 816 bp, Homo sapiens
  misc_feature: GYAE6OF01B457W.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagagtgttagtagtcttcgttacgccgttacggtaaccaaacgaacggtaaaacccgttcgggacccaacgggtacccttccccgtacgggtcccttacctccaacttaccgtagttacgaacgttcgacctaacgttacccgaaacgtaccggggcccaaccgttcgggaccaaccgtccccacggtacccgtacgggtttacgacggttacggtcgtacggttcggggttcgttcggttaggaacgtacgttaaccgttcctaaccgttccctaaccctaaccgtaacgttaccgaacgtccgaacgtacccgtaacgaccggtacccgttaaggtaaagttccgtttaacgttcggtaaccgttttaaggttttaaaccgtttacgtttcggtacgtaacggtacgtaacggttacgtaacgtaacccgttaacggtccgttccccttaccgttccggttaccggttaccggggacgggttaacgggaacccggttaagggacggtaaacggtacgtaaccgtaaaaccggtacggttcggtcggtaaccgtcggaacccttaacgtcttcgttcgttacccg

SEQ ID NO: 73741 - DNA, 760 bp, Homo sapiens
  misc_feature: GYAE6OF01BZQQQ.49.46.E02.1.454.CMB.1.raw
  modified_base (215)..(215): a, c, t, g, unknown or other
  misc_feature (215)..(215): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggcctcccagactacccgaccggagaaattgtgttgacacagtcctcccggccaccctgttctttgtcctcgaggggacaggtcncccacctctcctgcgacggccagtcagtagtgttacgtagtcttcgtagcctacggtaaccaacgtaacggaacccgtcgggaccgaacggtcccgtacccgacgggtcccttaccctactacttacgttaatggtaacttccggaccaaccgttaaccccaaaacggtacccggggtaccctaaaccggttcggaaccctaccgtacccccgacggtcccggtacggttacgtacgggcggtaccgtagggttcgggttgaggtacgaacgagttaccttaccgtacncctacacctancgacgctacgaccgtagacgtacgtaggtaatcttacgtatacttacgttttaacttccgtgtaccgtaggtaccgacggtacgaacgtccctaacggtccggtacccttaccgttcgtacccgggtttacggggaaccgggtaacgggtaaccggaaaggtacggtaacgtaacgtaacgggaaacccgtggtaccgggtcgtaccggttacacccgttaaccgttcttaccgttcgtttaccc

SEQ ID NO: 73742 - DNA, 737 bp, Homo sapiens
  misc_feature: GYAE6OF01C2RYV.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctcccagataccgaccggagaaattgtgttgacacagtcctccggccaccctgttctttgtctccgaggggacagtcgccctaccctctcctgcagggccagtcagtagtgttagtagtcttcttagcctaggtaaccaacacgaaaccgtggacctacggcctcccgacggtcctcctacacttctatgatcgacacgtaccaacgacgggacctacgtcggacctactaccccgaggaccgtacgggttacgaacggtgggacctagggttcgggtacgtggtacgactacggtaccttaccaaccgttctacccgaacctagtaccgagtaccgtaacgacccgtaagacgtaccggtaagtaaacgttactttacgtacgtaccgtttaagttttaccgttacgttacggtactacggtacgtaacggtacggtaacgtaccgtaaaccggtccgttacccttccttacccggttacgggtttaccgggacgggaaccgggtaaccggaggggtacgtaacggtaacgtaaacggaaacggtacggttacgggtaggtaaccctcggtaaccctaccgttaacgtcccgtttgttaacccg

SEQ ID NO: 73743 - DNA, 732 bp, Homo sapiens
  misc_feature: GYAE6OF01BY0QY.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccgaggtcctccgtcacttctatagactgcactaccaacgacgggccacgtcggaccactccccgaggccgtaagggtttccgaacgggttcggaccgtagggttcggggtacttggtacgtaccgaacggtacctttaccgaccgttcctacccacctaacgttccgaacgtccgaacggtacccgttaaggaccggtaccgttaagaaacgttacgttccgtacggtaactttacggtttttaactaccgttgttacgacggtacgtacggtacggttaacgtactaaccggtcggtaacccttccgttaccgttaccgggtttccgggaccgggtaacgggtaaccggtaaggggtaccgggtaaacggtaacgttaacccggtaaaacggttaaccgttcgggtaccggtacgttccgaccgtaaccctgttcccgttcgttaccccg

SEQ ID NO: 73744 - DNA, 776 bp, Homo sapiens
  misc_feature: GYAE6OF01CHAAN.49.46.E02.1.454.CMB.1.raw
  modified_base (536)..(536): a, c, t, g, unknown or other
  misc_feature (536)..(536): n is a, c, g, or t
tcagagtcgagagacacgaccggtgctcgatttagactcatctacaggggaaagggggaggaactgctcagttaggacccagagggaaccatggaacgccccagctcagtcttctcttcctcctgctactctggcctccaagactaccaccggaataaacttgtgttagacacacgtccgtcccggcctaccctgttccgtttcgtccgtccggaggggactagtccgaccctaccctctccgtggacgacggtccagtacgaggtagtagttaggacttcttcgtacgccgtacggtaaccaacgaacgaaccgtcggaccgacggtccctaccgacggtcctcctacgtacttacgtagtacgtagtcgacctaacgtacccgaaccgggtaccggcctacggtaccgaccgtacccgtacccggtaaccgtaccggttagggttaccgtagggtcccggttagggtagggttaccgggttacgtaaggtaccgacgttaccgttaccttactaccccgtacctcgaacccgtntacccggaacggaccttaccgaccgtaacgtacgtaccggttaaggaaccgtttcgttaccgtacgtttaacgttacgttttaacgtctacgtaccgacggacgtaccggtaagtacgtacctacggtcctccgttaccggtactccgggttaccggaggtaacggtacgtaggtacggtaacgacgtaacggtacgtccgtggttctaccgacgtacacgttacgtcctacgttacccg

SEQ ID NO: 73745 - DNA, 698 bp, Homo sapiens
  misc_feature: GYAE6OF01D30LU.49.46.E02.1.454.CMB.1.raw
  modified_base (211)..(211): a, c, t, g, unknown or other
  misc_feature (211)..(211): n is a, c, g, or t
  modified_base (492)..(492): a, c, t, g, unknown or other
  misc_feature (492)..(492): n is a, c, g, or t
tcagagtcgagagacacgaccggtgctcgatttagactcatctacaggggaaagggggaggaactgctcagttaggacccagagggaaccatggaagccccagctcagccttctcttcctcctgcctactctggcctcccagactaccaccggagaaattgtgttcgacacagtctccggccacccttgtctttgtctccgagggcagtcnccaccctcgtcctgcgacgggcagtcgagtagttcgttagtacgtcctttcttacgccgttaggtaacccaaacgtaaacgaaaccgttcggacccgtacgggtccctaccccgaagggtccctaccctactaacgtaccttaagtccgaattcggacctaagttacccgaacggacgggtcccaacgtcggacctaacgtccccgaagcccgtaaggttcacggtacggctaggttggtactggttacgacgtaacgtccttacaccgttctaccaaccntaccgagtaccacgtacgtagacgtctagtaacgtatttcgcgttactaggtttacttacgcttcgagtaccgagacgtaacgacctacggtcgtacccttgtccgtaacggttcggaacgggtacggaacgtaggtacggaaactacgttaaccggaaacgtcgtcgggtgaaccctggtaaccccagttaccttgtcgttaccc

SEQ ID NO: 73746 - DNA, 799 bp, Homo sapiens
  misc_feature: GYAE6OF01AJNB8.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtcgccaccctctcctgcacgggccagtcagtagtgttagtagtctttcttacgcctggtaaccaacgacgaaacctcggccaagggcctcccgaggcctcctcatctagtgactcgacctactacccgaaacgacgggaccctaacgtcgggaccctaccgtaccccgaacggtcccgtaacgggtttccgaacgggttcggggacccgtaggggttacggggttcttacgggttacgaacgtacggttaaccttccaaccgtttcctacccaacctactacccgacgaccgtaacggtacccgttaaggaacgtacccgttaaggaaacgttaccgtttaccgtacggttaacggtttttaacgttttaacttaccgggttacttaaccgtacggtaccgtacgggttaaccgttacgtaacccgttaaaccggttccgggtcctttacccgttccgttaaccgggtttccggggaaacccggggtacgggtaaccgtaaaggggtacgggtaaacgtaccggtaaaccggttaaacggacggtttggtccggtacggttaccgacttacccgttaacgtccgtttaacggttacc

SEQ ID NO: 73747 - DNA, 676 bp, Homo sapiens
  misc_feature: GYAE6OF01B5PKI.49.46.E02.1.454.CMB.1.raw
  modified_base (453)..(453): a, c, t, g, unknown or other
  misc_feature (453)..(453): n is a, c, g, or t
  modified_base (495)..(495): a, c, t, g, unknown or other
  misc_feature (495)..(495): n is a, c, g, or t
  modified_base (541)..(541): a, c, t, g, unknown or other
  misc_feature (541)..(541): n is a, c, g, or t
tcagagtcgagagacacgaccggtgctcgatttagactcatctacagggaaagggggaggaactgctcagttaggacccagagggaaccatggaagcccagctcagcttctcttcctcctgctactctggctaccagactaccgacggagtaaattgtgttgacacagtctccggccaccctgtctttgtctccgagggacagtcgcccaccctctccgtgcgacgggcctagtcgagaggttgttagtagtctttacttagcctaggtaaccaacaagtaaaccgtggaccaggcctccgacgtcctcctacgtatctagtgtacgtcgactaaccaccgaaacgacgggaccctaggtcggaccactccccgaagtcccgtaagggtttccgaaggtcggacgtagggttggtcttggtacgactacgtaacctctacctcctacactacnccgagtccaacggtactaacgggacgtacctaaggtaacgtntacgtacgtactttagtttactactcgtacacgtcaacggtacgtnaaccgtacgtcgtccctagtcccgttacggttcgggaacggtacgggtaacgtagggtaggtaagaaaccgtaacgtaaaccggttcggtcgccgggtactaccggactaacctttacgttccgttcgttacccg

SEQ ID NO: 73748 - DNA, 693 bp, Homo sapiens
  misc_feature: GYAE6OF01CTQ4M.49.46.E02.1.454.CMB.1.raw
  modified_base (151)..(151): a, c, t, g, unknown or other
  misc_feature (151)..(151): n is a, c, g, or t
tcagagtcgagagacacgaccggtgctcgatttagactcatctacagggaaaggggggaggaactgctcagttaggacccagagggaaccatggaagccccagctcagcttctcttcctcctgctactctggcctccagataccaccgganaaattgtgttgacacagtcgtccgcctaccctgttctttgtctccgaggggacagtcgcccaccctctcctgcacgggccagtcagagttgttagtagtcttcttacgcctacggtaccaacgaagaaacctcggaccacggctaccacgcctcctacattactatgtatcgctactacctaacgacggccacgtcggactactacccacgaccgtacggttcacggtcggcgtacggttcgggcgtttttttacggagtactacggtaccgttactacctaccttaccacctaactacgacgaccgtacgtaccgtacgtacggtacccgtaagtaagtacgtttacgtacgtacgtttaacttttaacgtttacgttacgtactacgacgtacggtaccgttaacgacctaacggtccgtccgttccttacccgttaccggttacgggacgggtaacggtaccgaagggtacggacgtaacgtaacgaaacggtacgttacggtacggtcgtacgcctaacgtactccgttcgttacccg

SEQ ID NO: 73749 - DNA, 608 bp, Homo sapiens
  misc_feature: GYAE6OF01A6CKH.49.46.E02.1.454.CMB.1.raw
  modified_base (198)..(198): a, c, t, g, unknown or other
  misc_feature (198)..(198): n is a, c, g, or t
  modified_base (202)..(202): a, c, t, g, unknown or other
  misc_feature (202)..(202): n is a, c, g, or t
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
  modified_base (382)..(382): a, c, t, g, unknown or other
  misc_feature (382)..(382): n is a, c, g, or t
  modified_base (391)..(391): a, c, t, g, unknown or other
  misc_feature (391)..(391): n is a, c, g, or t
  modified_base (465)..(465): a, c, t, g, unknown or other
  misc_feature (465)..(465): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaattgtgttgacacagtctccggccaccctgtctttgtctcgagggacngtcncccaccctctcctgcgagggccagtcagagttgttagngtcttcttagcctaggtaccaacgacgaaacctggccaggcctccgagcctcctcatctangactgacatccaagcggccagtgacacgccagccgtaggttcagtcggctaggtggtctggacgacacgtcttcgtacctntccaacctntacacggactacgacgtacgcgtaccgtagtaacgtattccgtagtacctttagttttacgttactcgtttacncggtactacgggtactaacggtccttaacggtcgtcccttagtccgttacggtccggacgggtacggtaaccgagggtaggacgtaactaacggaacggtacgttcgggtagtcgtacgacgacccttaattcggtcttaccg

SEQ ID NO: 73750 - DNA, 781 bp, Homo sapiens
  misc_feature: GYAE6OF01D79DE.49.46.E02.1.454.CMB.1.raw
  modified_base (123)..(123): a, c, t, g, unknown or other
  misc_feature (123)..(123): n is a, c, g, or t
  modified_base (730)..(730): a, c, t, g, unknown or other
  misc_feature (730)..(730): n is a, c, g, or t
  modified_base (773)..(773): a, c, t, g, unknown or other
  misc_feature (773)..(773): n is a, c, g, or t
tcagagtcgagagacacgaccggtgctcgatttagactcatctacagggaaagggggaggaactgctcagttaggacccagagggaaccatggaagccccagctcagtcttctcttcctcctnctactctggcctcccagtactaacccgaccgggtaagtaaatttcggtgttacgaactacgacgttccgtcccggccctacccgttcgttctttcgtccgtaccggaggggtacctagtccgccctaccctcctccgtcggcgacgggcctaaggtccaggtagttgttaaggtacgttcctttacgttacggtaccgtacgggtaaccaaacgtaaccgtaaaccggtcggacccgtacggtccctaccgacggtcctcctacacttctagtggtactcgactaactaccgaaacggtaccgggaccctaggccgactaaccgccccgacggtccgttaggtacgacggtggtacgtgggtgttacgtggtaacaccgtacgtacttctacgtcctacgacctacgtcgaaccgcctaacgtaccgaacggtaccgtaccgtaaaggtacttaacggtttcgtacggtttacctttaggtttaacttccgtacgtaggtaccacggtacgtacgtacgacgtacgttctaacccgttcgttacggtcgggttaccgggacggtaacggacggtaggtaagtaaccaagggtaaaccaaccgggttntaccgggtaccgtagtacccgaacctaccttaacggttccctnttaaccgg

SEQ ID NO: 73751 - DNA, 797 bp, Homo sapiens
  misc_feature: GYAE6OF01EXUEB.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgagggacagtcgccaccctctcctgcgagggccagtcagagttgttagtacgtcttcgttagccgtaggtaaccaacacgaaaccgtggaccacggcctacccgaggcctccgtctactctatacgatcgctactaccgaaacgcgggaccctacgtcgggacctacctccccgaaggtcccgtaacggggtttcctagggtcggacgtaggggttcgggttcgttaggtacgaacgtaccggttaccttaccgtacccttaccgttacccaaccctagttaccgaacgggtacccgaaccggttacccgtaacgggaccgtaccccggttaggtaaaaacgtttcgttacccggtttacggtaccttttaaacgggtttttactttaacggttcgttaccgaacgtaccggtacgtaccggttaacgtaaccgtaaccggtcgggttacccttaccggttaccgtttacccgggtttacggggacccgggttaacgggtaaccggtaaggggtaaccggaagtaacccgtaaggtaaacccggtacgggtttaggtccggtacgtaccgtaaccgtaacctttcgtaccgttcgtttaacccg

SEQ ID NO: 73752 - DNA, 710 bp, Homo sapiens
  misc_feature: GYAE6OF01A7NOY.49.46.E02.1.454.CMB.1.raw
  modified_base (175)..(175): a, c, t, g, unknown or other
  misc_feature (175)..(175): n is a, c, g, or t
  modified_base (221)..(221): a, c, t, g, unknown or other
  misc_feature (221)..(221): n is a, c, g, or t
  modified_base (674)..(674): a, c, t, g, unknown or other
  misc_feature (674)..(674): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggcctcccagactaccaccggagaaagttgtgttgacacagtccnccgcctaccctgtctttgtcctcgagggacagtcgacccacctccnctgacagggccagtcaggagttgttaagtcgtcttctacgccgttaggaaccaaacgtacgaaaccgtggaccagggtccaccaacggcctcctactatcttagagctcgaactacaccgaagacggccaactggaccctaatccccgaagtaccgtaggtttaccgaggttcggacgtaacggggttggtcgtcggttaacggactaaaccggttacttccgtaaaccgttcctaacgtaacccacgttacgaacaacggtaaccggtaaccgttaacggaaccggtaaccctttaaggaacgttacctagttaccggtattaaccgttttatacctacggttacacgtagaccgttagaactaacggtctaccggtacgtcacttacggttccggaacggaaggtactaccgggtaagaacgtaacgaccaaaacggttcgagggttaccncgtaacggtaccctaacgttctaaacgtcttaaccg

SEQ ID NO: 73753 - DNA, 823 bp, Homo sapiens
  misc_feature: GYAE6OF01DX6ZR.49.46.E02.1.454.CMB.1.raw
  modified_base (234)..(234): a, c, t, g, unknown or other
  misc_feature (234)..(234): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagtaaattgtgttgacacagtctccggccacctgtcttgtctccaggggacagtcgcccaccctctcctgcacgggccagtcaggngtgttagtagtcttcttacgccttagggtaaccaaacaacgtaaaaccgtggacccaggacctcccgaggcctcctcatctatgatgcactaccaacgacgggaccacgtcggaccactcccgacgtccgtaacggttcaggtggcgagggttcgggtctggtacgacgtaacggtactttaccaccgttacctaccgtaaccctactaccgtaacgaccgaacggtaccccgtaaaggaaccggttacccgttaaggtaaaacgttaaccgtttacctacgggttacctttaaacgggttttttaactttaaaccggttaggttaccgtaaggtaccggtacggttaacccgggtaaccgtaaccgttaaaccggttccggggttccccttaaccgtttaccccggtttaacccggttttaccccgggggaacggggtaaacccggggtaaccgggtaaaacgggggttaagggaaaccggtaaacccgttaacgggtaaaaacccggtaaccgggtttacgggtacccgggtttaccgtaaccctacccggtaaaccttaaccgttccgtttaaccgggtttacccc

SEQ ID NO: 73754 - DNA, 800 bp, Homo sapiens
  misc_feature: GYAE6OF01DZOIQ.49.46.E02.1.454.CMB.1.raw
  modified_base (341)..(341): a, c, t, g, unknown or other
  misc_feature (341)..(341): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagaaattgtgttgacacagtcctccggccacccttgttctttgtcctccgagggacagtcgcccaccctctcctgccagggccagtcgagtagtgttacgtacgtcctttacgttacgccgttacggtaaccaaacgtaacgtaaacccgtcggacccgtacggtaccctcccggaacggtccttaccctanacttaccgtatacggtactacgacctaacgtaacccaaaacggcgggtaccctaacggtccgaacctacccgtacccgacggtacccgttaggttaccgacggtcgggtacttaggggtcggtactggtacgaaccttacgtaccttcctaactcctaccactagtaccgaacgcgtacctaccgtagtacgtacgtaagtaacgtacttcgtaacgtacgtttaacgttttacctacgttcgtacgtacggtaccgtaacgggtacgtaacgtaaccgtacggttcccgttaccttaccgttaacccggtttacccgggttacgggaaccccgggttagggtaaacccggttaacgggtaacggtaacgtaaacccgtaaacgtaaacggttccgggttacgtacccgggtacttaaccggaccctttaacggtcgttccggttaacccgtttacccg

SEQ ID NO: 73755 - DNA, 751 bp, Homo sapiens
  misc_feature: GYAE6OF01ADGOS.49.46.E02.1.454.CMB.1.raw
  modified_base (206)..(206): a, c, t, g, unknown or other
  misc_feature (206)..(206): n is a, c, g, or t
tcagagtcgagagacacgaccggtgctcgatttagactcatctacagggaaaggggaggaactgctcagttaggacccagagggaaccatggaagcccagctcagcttctcttcctcctgctactctggctccagataccaccggagaaattgtgttgacacagtctccggcaccctgtcttgtctccagggacagtcgccacctntcctgcagggccagtcagagttcttagtacgtctttcttagccgttggtaacctaacgaacgtaaaccgttcggacccgaacggtcctaccccgagggtccttaccctactaacttcctagtacggtaactcggtacacttacccaaacgacggggaccctaacgttcgggacctaaccgtccccgaacggtccccgtaaaggggtttccaacgggtcgggtacctaacggggttcgggtttacccgtggttacggaaccgtacggttaccttaacggttactccgttaacacctacgtaccctaggaccgtacgtaacccgttacggaaccggtaccgtaagtaacgttaccgtttcgtacggtactttaacggtttactttaaccgtcgttaccgtacgtcgtaacgtaccggtagtaccgtaacgtcgtaccgttacttcgttacccggttacgcgggtaaccggtacggaacggttaggaacgtacggtaaccgaacggtacgtcggtacgaccgtcgacgtacttcgtcgtacgttaccg

SEQ ID NO: 73756 - DNA, 813 bp, Homo sapiens
  misc_feature: GYAE6OF01AW2ID.49.46.E02.1.454.CMB.1.raw
  modified_base (523)..(523): a, c, t, g, unknown or other
  misc_feature (523)..(523): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagaattgtgttgacacagtcctccggccaccctgtcctttgtcctccgaggggactagtcgcccaccctctcctgcgacgggccagtcgagtaggttgttagtacgtctttcgttacgccgttacggtaaccaaacgtaacgtaaacccgtcgggaccctaacgggtcccctaccccgtaacgggtcccttaccctactaactacccgttagtgacgttcgaccacgttacccgaacgaccggggtaccctaaccgtgggaccctaccgtaccccgtacggcccgtaacgggtttcaacgggttcggaccgtagggtcgggttacgttaggacgactacggttacctacgtacctcgttaccacctctaccganaccgtacgtaccgtaacgacgtacctaggtaaagtccttacgtacgttacctttaagtttataccgtagttaccacggtagtacgtacggtacgtaacctcggttaccggtacctttacccgtacgttaccgggttacccgggggaaagggttaacccgggttaaaccgggtaagggtacggggtaaaccgttaaaccgtacccggggtaaaaacgtttcgggttcccggaacggttacccggtaaccgtaaccccttaaggtacccgtttcctttaccgggtttacccc

SEQ ID NO: 73757 - DNA, 758 bp, Homo sapiens
  misc_feature: GYAE6OF01BWUDR.49.46.E02.1.454.CMB.1.raw
  modified_base (479)..(479): a, c, t, g, unknown or other
  misc_feature (479)..(479): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggcctcccagactacccgaccggagtaaattgtgttgacacagtcctccgcccacctgttctttgtcctccgagggacagtcgcccaccctctccgtgcgacgggccagtcgagagttaggttagtacgtctttacgttacgccgttacggtaaaccaaacgtaacgaaacctcggacccgacggccctacccgacggtccctacctactacttcgtatcggtatcgactaacacccgaaacggcggaccctaggtcgacctaccgtacccgagtacccgtaggttcgaggtcggcgtacgggtcggtcgtgtacgacgtacgtaccttcaccgtcctacaacccgtanaccgacgtacgaacgtacccgtaagaccgttaccgtaaggtaaacgttcttacggtagtaaccgtttaaagtttttactaccggtataccgaacgtacggaaccgttacggtaacctaacgtacccgttacccgggttcctttacggtaacccgtttcggggtaccggggtaacgggaaacgggtaaaccgaggggttacaaacgttaccgtaaaacggaaacccggtaggttcggtacccgtacgactaaccccgtagttacgttcgttacccgttac

SEQ ID NO: 73758 - DNA, 838 bp, Homo sapiens
  misc_feature: GYAE6OF01A5YTF.49.46.E02.1.454.CMB.1.raw
  modified_base (832)..(832): a, c, t, g, unknown or other
  misc_feature (832)..(832): n is a, c, g, or t
tcagagtcgagagacacgaccggtgctcgatttagactcatctacagggaaagggggagaactgctcagttaggacccagagggaaccatggaagccccagctcagcttctcttcctcctgctactctggcctcccagactaccaccggagaaattgtgttgacacagtcctccggccaccctgtctttgtccgtccaggggacagtcgcccacccgttctcctgccgaggggccctaggtccgagagttggtttacgtacggtccttttacgttacggcccttacgggtaacccaaaacgtacgtaaaaccccgttgggaccccgtaacggggtacccctcccccggaagggtcccttacccgtttaccgaaacctttaccttaagttcgggaacctttacggaacctaaccgttacccgaaaaccccggtacgggggtcccctaaaccggttcgggaaccctaaaccggttcccccaacgggaccccgttaacgggtttcccgtaaacgggtttcgggggacccgtagggggtttcggggttaccgttacgggttacgaaccgtaacgggtaaccttccgtaaccgtttcccgtaaccaaccgtaactacgaacggtaccgtacgtaccgtaacgacgtaccgtacgtaacgtacgttcgtacgtacgttaagtttacttaccgtctacgtcgacgtaccggtacgtacgaacgtaacgtccgtaccgtaccgttcgtaccggtttaccgggcggacggtaccgtagggaccgtagaacgtaacgtaacgtacgtacgtacggtacgtaccgacgaccctcttcccgttnttaccg

SEQ ID NO: 73759 - DNA, 711 bp, Homo sapiens
  misc_feature: GYAE6OF01BAJ2C.49.46.E02.1.454.CMB.1.raw
  modified_base (576)..(576): a, c, t, g, unknown or other
  misc_feature (576)..(576): n is a, c, g, or t
  modified_base (682)..(682): a, c, t, g, unknown or other
  misc_feature (682)..(682): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctccagactaccacggagtaaattgtgttgacacgagtcctccggcctaccctgttctttgtcctccgaggggacagtcgccctacctctccgtgcgacgggcctagtacagtagttgttagtagtctttacgtacgccgttaggtaaccaaacgaacgaaccgtggaccgacggtcctaccgacggtcctacctcgtacttactagtacgtactacgacctaacgttacccgaaacggaccgggacctacggtcggaccctaaccgtcccgaacggttcccgtaacgggttcgacggttcgggacgttgggtacgggttctaggtacgacgtacgttaccttacgaccttccacaaccgtcacgtacgacgtaacgtaccgtacggacgtaccgttaaggtaaacttcgttactcgtacgttttaagttacctagtagtacgngtaacgtaccggtactacggaccttacggtccgttaccctcgttcggttaacggtccgggaacgggtacgaacgtagggtacgaacgacctaagaacggtcgttgngtcctacgacgtactacgttctgttaacc

SEQ ID NO: 73760 - DNA, 752 bp, Homo sapiens
  misc_feature: GYAE6OF01APH55.49.46.E02.1.454.CMB.1.raw
  modified_base (447)..(447): a, c, t, g, unknown or other
  misc_feature (447)..(447): n is a, c, g, or t
  modified_base (743)..(743): a, c, t, g, unknown or other
  misc_feature (743)..(743): n is a, c, g, or t
tcagagtcgagagacacgaccggtgctcgatttagactcatctacaggggaaaggggggaggaactgctcagttaggacccagagggaaccatggaagccccagctcagcttctcttcctcctgctactctggcctcccagactaccaccggagaattgtgttgacacagtcctccggccacccttgttctttcgtccgtccgacgggggactaggtccgcccaccccttcctccgtcggccgacggggtcccaggtcgaggtagtttaggttaacgtacgtcctttacgttacggtcccgttacggtaaccccaagtaacggtaaacccgtcggaccgacgggtccctcccggaaggtcccttacctctacttcgtacgtgaatcgacctactcccgaaggccggaccctagtcgacctcctcccggacgtaccgtacggttacgnggttacggtcggtacggttgggttcgtaggtacctaacgtacgttacctttccgtaacttccctaacccacgtaacctaccgaacgtcccgtaaccgtacggtaaccgtacggtaccgttaaacgggtacttaagtttcccgtaaggttcccttttaaaggttttcttacccggtgtaacctacggtacgtacggtacgtactactcggtcgttcctacgtcgtacgtcgggacggtacggagtacggacgatcgtaaacgacgttagcgggtacgtctaccggctaacttcgttnttccgtccg

SEQ ID NO: 73761 - DNA, 769 bp, Homo sapiens
  misc_feature: GYAE6OF01BA9S7.49.46.E02.1.454.CMB.1.raw
  modified_base (148)..(148): a, c, t, g, unknown or other
  misc_feature (148)..(148): n is a, c, g, or t
  modified_base (161)..(161): a, c, t, g, unknown or other
  misc_feature (161)..(161): n is a, c, g, or t
  modified_base (200)..(200): a, c, t, g, unknown or other
  misc_feature (200)..(200): n is a, c, g, or t
tcagagtcgagagacacgaccggtgctcgatttagactcatctacaggggaaagggggaggaactgctcagtaggacccagagggaaccatggaacgcccagctcagcttctcttcctcctgctactctgctccagactaccacgganaattgtgtgacanacgtctccgccacctgttctttgctccgagggacagtcnccaccctctccgtgcgacgggccagtacgagtagttagttagtagtcttcgtacgccgtaggtaaccaacgaacgtaaacgtacggaccgacggaccgtaccgacgtacctacctactactactatagacgtgactaacctaccgaaccggaacggtaccgaccgtacggaccaccgtacccgaaccgtaccgtacggttacgtacggtacggtacgtacggttgggtacgtacggtacgtacgtacgtaccgttacctaccgtacctacctaacctacgggggggggtactacgacgtaacgtaccgtaagtacgtaacgtaagtaagtacgttacgttacggttaacgttaacggttttaaccgttacgttacgtacgtaacgtacggtaacgtaacggtaacgtacgtaacgtaccgtacccgttaccgttaccgttaccgggtaccgggtaacgggtaaccgggtaaaccgggtaacgggtaacgggtaacggtaacgtaaacgtaaacggtaacggttacggtacggacgtacgaccgtaacgtaccgttacgttacgttaccg

SEQ ID NO: 73762 - DNA, 804 bp, Homo sapiens
  misc_feature: GYAE6OF01DLXOD.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctcccagactaccaccggagaaattgtgttgacacagtctccggccaccctgttctttgtctccgaggggacagtcgcccaccctctcctgcgagggccagtcaggtagtgttagtagtctttcttacgcctacggtaaccaacgaacgtaaaccgtggacccaagggccctaccccgaaggtcccttacctactaacttccttagtcgtattacggacctaacgtacccgaaaacggacggggtacccctaacggtcggaccctaaccgttccccgaacggtccccgtaagggtttacgagggttcggggacgtaggggttcggggttcgttacggacgtaacgtaacgttaccctttcacccgttacctaaccaacctacgtaccgaggtacctaaccgtccgtaacggtaccgtaaccgtaaggtaacgtttactttccgtaggttaacctttagtttttacctacgttacgttacgacggtaccgtacggtacggttaacgtccgtaaccgttccggtaccctttacgttacccgttaaccggggtttccgggggaaaccgggtaaccggggtaaccggtaacggggtttaggaaaccgttaacgaaaaccggtaaacggtacggttacggtacggacgttacgacctacctagtttctcggtttacc

SEQ ID NO: 73763 - DNA, 721 bp, Homo sapiens
  misc_feature: GYAE6OF01C56X8.49.46.E02.1.454.CMB.1.raw
  modified_base (150)..(150): a, c, t, g, unknown or other
  misc_feature (150)..(150): n is a, c, g, or t
tcagagtcgagagacacgaccggtgctcgatttagactcatctacaggggaaagggggaggaactgctcaggttagggcccagagggaaccatggaagccccagctcagcttctcttcctcctgctactctggctccagataccacgganaaattgtgttgacacagtctcccggccaccctgtctttgtctccgaggggacagtcgccctaccctctcctcgcgagggccagtcaggagttgttagtagctttcttagcctaggtaccaacgtagaaaccgtggaccctaggcctacccgaggtcctcctcactctaatggacttcgacactaccgaacgacgggacccagtggaccaacctcccgaacggtcccgtaggttaccgaggtagggcgtaaggggttcggttcgtcggttacgtaaccgtacgtaccgttaccaccttcgtacctaacctacgtaccacgaccgtacgtcccgtaacggtacgtaccgtaagtaacgttactttacgtcggttaccgtttaacgtttagtttaccgtcgtacgtaacggtccgtaacggtcggtaaccgtaccgtaaaccggttccgtaccgtccgtaccgttaccgggttcgggaaccgggaacgggtaaccggtaagggacggtaacgaccggtaaacgtaaggtaccgtggtaccgcgtacgtacctattaccgtcgtttccggtaacc

SEQ ID NO: 73764 - DNA, 776 bp, Homo sapiens
  misc_feature: GYAE6OF01BKHYD.49.46.E02.1.454.CMB.1.raw
tcagagtcgagagacacgaccggtgctcgatttagactcatctacagggaaagggggaggaactgctcagttaggacccagagggaaccatggaacgccccagctcagcttctcttcctcctgctactctggcctcccagactaccaccggagaattgtgttgacacagtcctccggccaccctgttcttgtcctccgaggggacagtcgcccaccctcgtcctgccgagggccagtcgagtagttgttagtacgtcctttacgttacgtccgtacggtaacccaacgaaccggtaaaccgtcggaccgtaacggtccctacccggacggtcccttacctactacttctagtgtactgacctaacgtaccgaaccggacggccacgtacggacctaccgtacccgacgtacccgtaggttacgacgggtcggacgtaggggttcggtacggtagtacgactacgttacctcctaactccgtaacacctatccgacggacctaccgtaaccgaagtaccgtccgttaagtaacgttcttacgtacgtacgttttaacgtttactaccgttgaccgtacgtaacgtcgtaacggttacaccggttaaccgtcggttacccctacggtttacccgttaccgggttacggggaaccggggtaacggtaacggggtaccgttaggaaaacggtaaccttaaaacccggggaagtaaccggttcgggtacccgttaaccgttaccggaaccctaacccgtttattcccggttatttacccgg

SEQ ID NO: 73765 - DNA, 898 bp, Homo sapiens
  misc_feature: GYAE6OF01BT9PE.49.46.E02.1.454.CMB.1.raw
tcagagtcgagagacacgaccggtgctcgatttagactcatctacagggaaaggggaggaactgctcagttaggacccagagggaaccatggaagccccagctcagcttctcttcctcctgctactctggcctccagactaccgaccggtagtaattgtgttagaccactacgtcgtcccggacctacccgttggttctttcgtcctcccggaaggggacctagtcgaccctaccccttccgtaccgtggcccggacggtcccaaggttccagtacgttggttactacgtccttcgtacgccgtacggtaaccaacgaacgtaacccgtcggacccgtaaggcccttaccccgaggttcccttcccttacgtaccgttaccgtaagtccggtaactccgaaccttaacccgtaaccgaaaccgggaccgggtccctaacggttccggacctaacccgtttacccgacggttacccgtaaggtttacgaccggtcggggaccttacggggtacgggttcttaacgtaccgggtactaaccgtttacccgtactaccgttaccgtacctaaacgttcgtacccgacgtacgtacgttaaccgacggtaccttaaccgggtagtaacccgttaattcccgtaagttaccgtttaaaccgttttaagtaccgtcggttaaaccgtacggtacgggtaaacgtacccggttaacgaaaccgttcgggtacccgttaaccccgttactttaaaccccggtcgggtttaccggggaacggtaccgggtaaaccgggttagtaaagggtacccgtaccgggtaaaactaaccgggttagcccggggttaacgaccgtaacccgggtactaaaccccgggttcttaccccgggtttccttacccggg

SEQ ID NO: 73766 - DNA, 750 bp, Homo sapiens
  misc_feature: GYAE6OF01AOZ9V.49.46.E02.1.454.CMB.1.raw
  modified_base (731)..(731): a, c, t, g, unknown or other
  misc_feature (731)..(731): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtcgccaccctctcctgcagggccagtcagagtgttagtagtcttctagcctaggtaccaacagaaacctggaccaggcctcccgaggcctacctcatctagtacgatcgtacaactccaaacgcggggcctaacgtggacctactcccgacgccgtaaggttcacggtggccgtaaggttcgggtctagggttacgaacgtacggttaaccttcctaaccgttcctacctaaccgtacgttaccacggtaccaacgacccgttaacgggtacgtaccccgttaagtaaacggttactttaccgttacgtaaccgttttaaaggtttttaacttaccgttacgggtttaccaacggtacggtaacggtccgttaaacgtaaccgttaaccggttacgtaccccgtttaaccgttacccgtttaaccgggtttaccggggaccggggttaaacgggaaccggtaacggggttaacggaacgttaccgtaacggtaaacgtacggtacggtacggtacgtacgaccgttaanacgttccgtgtttaacccg

SEQ ID NO: 73767 - DNA, 911 bp, Homo sapiens
  misc_feature: GYAE6OF01CLG3X.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccgaccggagaaattgtgttgacacgagtctccggccacccgttgttctttcgtcctccggaagggactaggtccgaccctaccctcctccgtcggccgacgggcctagtacaggtaggttagttaggtacgttccgtttacgttacgccggttaacggtaacccaaacgaaccggtaaaccgtcggaccggaccgtccctacccggacggttccctacctacgtacttaccgttagtacgtacgtcgacctaccgtaacccgaaaccggtaccgggtaccctaacggtccggacctaacccgtacccggtaccgaccggttaacggttccggaaggttccggacggtagggttcgggtccgttaggtacggtaaacgtaccggttacttaccctaccgtacctacccgaaccgttacttacgacggtacctaaccggtaccgtacgtaacccggtaccgtaacgtaacgttacgttaccgtattaccggtttaagttttaacgtttcgtaccgtcgtaacgtaccgtaacggttacggttaaccgacgttaacccggttccgtcccgttaaccgttccggttaacccggggtttacccggggaacgggttaaacccggggttaacgggtaaacggggttaaccggtaaagggttaaccccgttaaaacccgggttaaaaaccgggttccgggttaccggtacccgggtttaaacgacccggtttaaaccgcccggttaaacgtttccccggtttaaacgtttaccccgg

SEQ ID NO: 73768 - DNA, 829 bp, Homo sapiens
  misc_feature: GYAE6OF01DDQV7.49.46.E02.1.454.CMB.1.raw
tcagagtcgagagacacgaccggtgctcgatttagactcatctacagggaaagggggaggaactgctcagttaggacccagagggaccatggaagcccagactcagcttctcttcctcctgctactctggctcccagataccaccggagaaattgtagttgacacagtctccggaccaccctgtactttgtctccgaaggggactacgtcgcctaccctctcctgccgagggccaaggttcaggtaagttgtttaaggtaacgtcctttcgttaaggccttagggtaaccccaaacgtaaggaaaaacccttcgggaccaacgggacccttaccccgaaggtccctacccgtacaacttccgtaagtcggtaatcggtaacctaacgtacccaaacggacggggtaccctaacgttcgggaccaactccccgtaaagcccggtaacggttccaggttacggacgtaacggttcggggttacctggttacgaacgtaacggacctttaccgacttaccctaccgaaaccctaacgttacgaccgtaacgtaaccgtacccgttaaacggcgaaccggttacggtaaagtaacctttacggtaacgggttactttaagttttaacctttaccgtacggtaccgtaaacgcccgtaaggtaccgttaacgacccttaaaccggttcggtacccttacttaaccggttacggttacccgggtacgggaaaccggtaaccgaaagggtcggtaaacgtaaactaacccggtaaaggtacgttacggtgggaaacccttaggaaaccccttcggtaacttccgttggttaacccc

SEQ ID NO: 73769 - DNA, 642 bp, Homo sapiens
  misc_feature: GYAE6OF01E4Z7Z.49.46.E02.1.454.CMB.1.raw
  modified_base (303)..(303): a, c, t, g, unknown or other
  misc_feature (303)..(303): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagagcttcttagcctgggtaaccaaacagaaaacctggaccaggcctcccaggcctcctcatctatnatgctatccaaacgacgggcccacgtggcactcccagcctaggttcaggtggacaggtcgggtctggtagacagtacttcaacctcctacaacctatcaacgacacgtacctaggacgcccgtaggtaaagtacttcgtacgtactaagttttaacttacgtgtacgtacggacaagtacggtaagaaccgtaacgttccgggtcccttaccgttactaaccggttttccggggaccgggtaacggggtaacccgaaaggggtacgggtaacgtaaccgtaacgaaaaccggtacgttaggtacggcgtacggaccaaccctacttccgttcgttaccg

SEQ ID NO: 73770 - DNA, 756 bp, Homo sapiens
  misc_feature: GYAE6OF01D6K75.49.46.E02.1.454.CMB.1.raw
  modified_base (381)..(381): a, c, t, g, unknown or other
  misc_feature (381)..(381): n is a, c, g, or t
  modified_base (493)..(493): a, c, t, g, unknown or other
  misc_feature (493)..(493): n is a, c, g, or t
  modified_base (512)..(512): a, c, t, g, unknown or other
  misc_feature (512)..(512): n is a, c, g, or t
  modified_base (724)..(724): a, c, t, g, unknown or other
  misc_feature (724)..(724): n is a, c, g, or t
tcagagtcgagagacacgaccggtgctcgatttagactcatctacagggaaagggggaggaactgctcagttaggacccagagggaaccatggaacgccccagctcagcttctcttcctcctgctactctcggcctccagactaccaccggtaagtaaattgtgttgactacagtcctccggcctacccttgttcctttgcctccggaggggtcaggtcgccctacccgtctcctggccgtacgggcctaggtcctaggtaggttagttaaggtcgttactttccttaacggtcccgttacgggtaaaccccaacgaaccggtaaacccgtcgggacccgacgggtcccctacccggacggtcctacccgtatacgtctancgtatcgacactaccgaacgcggtaccacgtcgaccactcccgacgtcggtacgttgacggttacgcgttacgggtgggtcttacgtacggactaccgttcttcgtaacccncgttaacccaacgttaccncggtaacgacgtacgtaccggttaagaccgtaaccgttaggaaaacgttccttaacgtagttaaccgttttaagttttacctacggtacggtgttaaacggccttaagggttaaccgtaccgaaacgttcccgtccgttacctcgtttaacggtccgtaccggggaacgtacggtacgaggtaagcgtaacgaacggtaagtcggtacggtnaaccgtacgacttagtccgtggtctttaccgg

SEQ ID NO: 73771 - DNA, 600 bp, Homo sapiens
  misc_feature: GYAE6OF01A51VO.49.46.E02.1.454.CMB.1.raw
  modified_base (372)..(372): a, c, t, g, unknown or other
  misc_feature (372)..(372): n is a, c, g, or t
  modified_base (397)..(397): a, c, t, g, unknown or other
  misc_feature (397)..(397): n is a, c, g, or t
tcagagtcgagagacacgaccggtgctcgatttagactcatctacagggaaaggggaggaactgctcagttaggacccagagggaaccatggaagccccagctcagcttctcttcctcctgctactctggctcccagactaccaccggagaaattgtgttgacacagtctccgccacctgtctttgctccgagggacagtcgccaccctctctgcgagggccagtcaggagtgttagtgcttcttagcctggaaccaacgagaaacctggccacggacctcccaggtcctacctcactctactgatcgcaactccaacgacggaccacgtcggcactacccgacgccgtagttcgagtcggacaggtcggtntgtgacaggtacttcactctcaccntcagcacgctagacgtcctaggaatcgttctggtacttagttttacttcgttgtacgtagactacggacgtacgtacctaacgtcgtacccttactacgtccggttacgggaccggaacgggtaccggtaagggtacgaaacggtcaaacgaacgggtaacgtggtacgcgttacgaccgtaactcgttagtcccggtttacg

SEQ ID NO: 73772 - DNA, 898 bp, Homo sapiens
  misc_feature: GYAE6OF01AX40Y.49.46.E02.1.454.CMB.1.raw
  modified_base (208)..(208): a, c, t, g, unknown or other
  misc_feature (208)..(208): n is a, c, g, or t
tcagagtcgagagacacgaccggtgctcgatttagactcatctacagggaaagggggaggaactgctcagttaggacccagagggaaccatggaagccccagctcagccttctcttcctcctgccttactctggctcccagactaccaccggagtaaattgtgttgacacagtctccggccacctgtctttgctccgagggacagtcncctacctctcctgcgtaggccagcagagtgttagtagcttcgtacgcgttacggtaaccaacgaacgtaaaccgtcggacccgtaggacccttacccgaacggtcccttcctacctacgttcctaatacggtaacttacggaacctacttaacccgtaaaccgaacggggtacccaacggttacgggacctaaccgtaccccgtaaccgtcccgttaagggtttacccgaggtacggggtactaggggttacggggtttacctagggttagtaacgtaacggtaaccctttaccgtaacccttacctacccgaaacccgtacgtaaccgtacggtacctaacggtacccgttaagggaaccggtaccttaaagggaaccgggttactttaaccgttcgggtaacgtttaacgtttaaactttaaccggtttacgttaacgtaaccggtacgtaaggttacccgtaacggtaacccgtaaaccggttccgggtacccgttaccgtttaccccggttaacgggtttacccgggggaccgggggttaaaccggaaacccgggttaaaggggtaaccggaaacgggttaaccgtaaaccgggtaaaacgttaaccggggttaacggggtaaccggtttacggtaccccggttaaccgaaaccccgttaaccggttccgttccgggtttaacccc

SEQ ID NO: 73773 - DNA, 659 bp, Homo sapiens
  misc_feature: GYAE6OF01AJ6GV.49.46.E02.1.454.CMB.1.raw
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcctttgtctccaggggacagtgccaccctctcctgccagggccagtccaggagttcgttagtagcttcttagcctggtaccaacacgaaacctggccaggcctcccaggcctcctcactctactgatgcataccaacgagggccaacgtggaccactcccagcctaggttccagtggacngttcgggntgtgacncgtactcactcncacntacagcacgcccttagacgtaccctagaacgttactctagtaccgtttaagttttaccttaacgttcgttaccgtaccgtacgtaagggtccgttaaacgacccggtaaacgtcccgggtcccttaccgttcccgttaacggtttcccggggaacgggtaccgggaacggtaaacgggttagggaacgaccgtacgtaaaacgggtaccttacggttacgggccttaccggaccgtaaccgttacgttaccgtccgttttacccg

SEQ ID NO: 73774 - DNA, 765 bp, Homo sapiens
  misc_feature: GYAE6OF01B4P1A.49.46.E02.1.454.CMB.1.raw
  modified_base (706)..(706): a, c, t, g, unknown or other
  misc_feature (706)..(706): n is a, c, g, or t
  modified_base (757)..(757): a, c, t, g, unknown or other
  misc_feature (757)..(757): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagactaccgaccggagaattgtgttgacacagtcctccggcctacccgtgttctttgtctccgaggggacaggtcgcccacccttctccgtgaccgacgggcctagtcaaggtagttgttaagtctcctttcttagccgttacggtaaccaaacgacgaaacccgtggacccgaggtccctacccgacggtcctcctaccacttcctaagtcggaacttcggactaaccttacccggaaaccgtccggggaccctaacggttcggaccgtaaccgtacccccgaaggttacccggtaggttttacccgagggtaccggtaccgtaacgggggttcgggttacgtacgttacggaaccgaccgtttaaccgttcctaaacccgtttccgtaacccaaccccgttacgtccgaacggaccgaccgtacgtaacggaccgtaccgtaggtaaacgtactttacgtacgttacgtttaacgttttacttacgtttccgtagtaacgcgttaacgtacggacgtacctacgtcggtcctacgttacgtccggttcgggacggtacgtaaccggnggtaagacggtactaagaacggtactcggtacgacgtacgactactacgtnttcgttac

SEQ ID NO: 73775 - DNA, 867 bp, Homo sapiens
  misc_feature: GYAE6OF01B0MLL.49.46.E02.1.454.CMB.1.raw
  modified_base (207)..(207): a, c, t, g, unknown or other
  misc_feature (207)..(207): n is a, c, g, or t
tcagagtcgagagacacgaccggtgctcgatttagactcatctacagggaaagggggaggaactgctcagttaggacccagagggaaccatggaacgcccagctcagcttctcttcctcctgctactctggcctccagactaccacggagtaaattgtgttagacacacgtccgtccggcctacctgttcttgtcctacgagggacngtcgccctacctcgtctggcgacgggccagtcgagtaggttgttatagtctttcgtagccgtacggtaaccaaacgtaacgtaaccgtcggaccgacggtaccctaccgacggtacccttcctactactttaccgtagtacggtacgtacctacaacgttacccgaaacgtccgggacctaccggtacggacccgacctcccggtagcccggttaggttaccgaggttggaaccggtggtacgggttcgtacgtacggacgtaccgttactacctaccttaccaaccgtaaacctcggtacgacctaacggtaccggtaccgtaacggtaccgtacccgttaaaggtaccgttagttaccgttaagttacccgttttaagttttaccgtaacgtttcggaacgtccggtaaacggtaccgggttaaccggtaacggtaacccttaacccgggtaacccgggttaccccgttttaaccgttaccccggtttaacccgggggttaacccggggtaccgggggtaaaacccgggtaacggggtaacggggttaaacggtaaaccgtaacggttaaacccgggttaaaccgtcgggttaccggttacccgggtaagttacccccgtacgtaaaccgtttccggtacgtttccggtttaaacccc

SEQ ID NO: 73776 - DNA, 947 bp, Homo sapiens
  misc_feature: GYAE6OF01BW2RA.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagataaccgaccggaagtaaaattgtgttacgactaacagtctcccggcccacccgtgttctttgtcctccgaggggacagtcgcccacccttctccgtgaccgacgggcctaagtcaaggtaggttagttagtacgtctttacgttaacgccgttacggtaacccaaaacgaacggtaaaacccgtcggtacccaacggtcccttaccccgaacgggtacccttacccgttaccaacgttacctaaattcggtaacgttcgtaaccgtaaaccgttaccccgaaaaccggtaaccggggacccgtaaacgtaccgggtaccaacccgttccccgtaaaccgcccggttaaacgggtttaccgaagggttcggacggttaacgggttcggggtttaccgttagggtaacgtaaaccgtaacgtaacccgtttacccaaaccgtttaccctaccctaaccgaaccttaccggaacgtaaccgaacgtacccgtaacggaaccggtccgttaaaggtaaacgtaacgttttacgtaccggtaaccttttaaggtttttaaccttaacggtttagttaaccgtaaggaacccgttaaagggttccggtaaacgttacccgaaacggtttccgggtacccctttccgttaacccgttaccgggttttaccgggggaaccgggtaaacccggggtaacccgggtaaaggggttaacggtaccgtaaacgttaaaccgaaaaccgttaaccggttacgggtaaccggtaccgttaaacggacctaacccgttacgttaccgtttggtttaaccccg

SEQ ID NO: 73777 - DNA, 893 bp, Homo sapiens
  misc_feature: GYAE6OF01BE0MJ.49.46.E02.1.454.CMB.1.raw
  modified_base (254)..(254): a, c, t, g, unknown or other
  misc_feature (254)..(254): n is a, c, g, or t
tcagagtcgagagacacgaccggtgctcgatttagactcatctacagggaaagggggaggaactgctcaggttaggacccagagggaaccatggaagccccagctcagcttctcttcctcctgctactctggctccagataccacggacgaaattgtgtagacacagtcctccggcctacctgttctttgtctccgaggggacagtcgccacctctcctgcagggccagtcagagtgttagtatcttcgttacnccgttaggtaaccaaacacgtaaaccgtcggccgacggccctcccaggcctccgtacaagtcttagtcgattcggcctacgtacccgaaacgtcgggaccctaacggttacggtaccctcccgaggtccccgtaaggttcgaacgggttcgggacgtacggtttggggtcccggttagggtaaccgtaagggtacgttacccgtacttacccgtacctaacctacgtaccgtaaccgtccgtaaccgcccggttaggtaacggttacgggttacgttaacgggttaaacggtttaacgtttttacggtaacgtttttaacggtttttaaccgtttaacgggtttacgttaccggtaacggtttaaccgtttaaacgtttaacggttttaaacgggtttcccggtcccggggtttaacccgttaaccccggggtaaccgggtttaccgggtttacccggggggtaaccgggtaaccgggggtaaccggtaaacgggggttacgggtaaacggtaacgtaaacccgggtaaaacggtaacggttcggggttaaccggtacccggtttaaacgggcccgtttaaccgttaccggttccccgtttaggtttaaccccctttgttaaacccccggtttccccgg

SEQ ID NO: 73778 - DNA, 831 bp, Homo sapiens
  misc_feature: GYAE6OF01BF2MH.49.46.E02.1.454.CMB.1.raw
tcagagtcgagagacacgaccggtgctcgatttagactcatctacagggaaagggggaggaactgctcagttaggacccagagggaaccatggaacgccccagctcagcttctcttcctcctgctactctggcctcccagactaccacggagtaaattgtgttgacacgtagtcctccggccctaccctgttctttgtcctcgagggacagtcgcctaccctctcctgcgacgggcctagtcgagtagttgttagtagtctttacgttacgaccgttaggtaaccaaacgaacggtaaaccgtcggaccgaacggtccctacccgaggtcccttcccgtacaacttcgttaacgtgtaacgtgtacccaaccttaaccgaaaccggaccgggtaccctaacggtcggtacccctaacgtcccccggaacggtaacccgttagggttacccgtaacggtcggggtaaccgtacggggtttccgggttactacggttacggaaaccgtacggttacccctttacccgaaccttcccgttaaacccaacgttaccgtccgaacgtaccggtaccgtaaccgttacggtaaccggtaccgttaaacgtaacgtttaccgttaccgttacgttaacgttttaacgtttaacgttcgttacgtacgacgtacgtaacgttaccggtaagtacccgtacgtccgttaccctacgtttaccgtaccggttaccggggaacgggtaccggtacgggtaaacggtagaaaccggtacgtaaacggtacggttacgtcggtaccgtacgtacgtacctacgtcgtttccgtcgtttaacccg

SEQ ID NO: 73779 - DNA, 663 bp, Homo sapiens
  misc_feature: GYAE6OF01C74DN.49.46.E02.1.454.CMB.1.raw
  modified_base (398)..(398): a, c, t, g, unknown or other
  misc_feature (398)..(398): n is a, c, g, or t
  modified_base (535)..(535): a, c, t, g, unknown or other
  misc_feature (535)..(535): n is a, c, g, or t
  modified_base (560)..(560): a, c, t, g, unknown or other
  misc_feature (560)..(560): n is a, c, g, or t
tcagagtcgagagacacgaccggtgctcgatttagactcatctacagggaaagggggaggaactgctcagttaggacccagagggaaccatggaagccccagctcagcttctcttcctcctgcctactctggctccagatacccgaccggaagtaaattgtgttgacacagtcctcccggccaccctgttctttgtctccgaggggactagtcgccctaccctctacctgcgacgggccagtcagtagttgttagtagtcttcttacgcctacggaacctaacgagaaaacctcggaccacggtcctccgacggcctcctacattctagtgacttgactacgtacccaaagccgggacccacggtcggacctactccccgagtcccgtacggttacgnggtacggctacgggttgggtactgggtacaacgtacgtccttaccgcctttactaccacgtactccgaacggccgtaacgacccgtaagctaccggtagtaactacttcgtatacctttagtttaactcgtatcganccgttagacgtaacgactaccggtntccgttacctcgttaccggttcgggccggaaaccggtgacgggtgaacgtaactaacgaaacgtacgttggacgtcgtacacctcttaactccgttcttaccg

SEQ ID NO: 73780 - DNA, 636 bp, Homo sapiens
  misc_feature: GYAE6OF01CSD3W.49.46.E02.1.454.CMB.1.raw
  modified_base (181)..(181): a, c, t, g, unknown or other
  misc_feature (181)..(181): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
  modified_base (516)..(516): a, c, t, g, unknown or other
  misc_feature (516)..(516): n is a, c, g, or t
  modified_base (580)..(580): a, c, t, g, unknown or other
  misc_feature (580)..(580): n is a, c, g, or t
  modified_base (604)..(604): a, c, t, g, unknown or other
  misc_feature (604)..(604): n is a, c, g, or t
  modified_base (611)..(611): a, c, t, g, unknown or other
  misc_feature (611)..(611): n is a, c, g, or t
tcagagtcgagagacacgaccggtgctcgatttagactcatctacaggggaaagggggaggaactgctcagttaggacccagagggaaccatggaagccccagctcagcttctcttcctcctgcctactctggcctccagactacccgacggaagtaaattcgtgttagacacgacgtccncccggccacctgttcttgtctccgagggactcgtcgcctacctctcngcgacggccagtcagtagttgttagtntcttactgcctagtacaacgagtaaccgtgaccncggcctcccgaggtcctacctnacttactagtgactcgactactaccgaaacggcggacctacgtcgaccacgtacccagtccgtagtcgaggtcggcgtggttacggtctaggcgtaacgtcgtaccgtcctacgtaccctactaacgtcgacgtacgaacctaccggtactaacggacgttaccgtaagtacgttacttcgtaggttactttagtttacttacgngtcgacggtcacgtacacgtctacggccttcttacgtccgttacggtcgggaacgacgtaaggnggtactaacgtacaagttaacggntcggacncgacgactcgttctacttgtaaccc

SEQ ID NO: 73781 - DNA, 703 bp, Homo sapiens
  misc_feature: GYAE6OF01AV5LB.49.46.E02.1.454.CMB.1.raw
  modified_base (349)..(349): a, c, t, g, unknown or other
  misc_feature (349)..(349): n is a, c, g, or t
  modified_base (426)..(426): a, c, t, g, unknown or other
  misc_feature (426)..(426): n is a, c, g, or t
tcagagtcgagagacacgaccggtgctcgatttagactcatctacagggaaagggggaggaactgctcagttaggacccagagggaaccatggaagcccagctcagcttctcttcctcctgctactctcggcctcccagataccaccggagaattgtgtgacacagtcctccggcccaccctgttctttgtcctccgagggaccagtcgcccaccctctccgtgccgacgggcctagtcagtaggtgttacgtacgtcgttacttacggccttacggtaacccaaacaccggtaaacgtccggaccacggtccctaccggacgtcctaccctactacgtctaatgtacncgacacctcaaaccggcggtccaacgtcggactccgacctaggaccctaggtcgaggtggacgtgtggtgtcgtaanaccgtaacggttcttaccctaaccgtcctaccgaaccctgtaccgaacgtaccaccgtaactaccgtaccggtctaacgggtaacgtacgtttaccgtacgttaacgttacgttttaagtaccgtttcgtactacgacgtacgtaacgtaccgagttaacgtccgaccttcgtactccgggttcggaccgggtacgacggacggtaacggtaacgtacgtaaggtaacctacggttacgtacggacgttaccggaccaggttcctaggttcgtaccg

SEQ ID NO: 73782 - DNA, 721 bp, Homo sapiens
  misc_feature: GYAE6OF01EUYPZ.49.46.E02.1.454.CMB.1.raw
  modified_base (704)..(704): a, c, t, g, unknown or other
  misc_feature (704)..(704): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtcctccgaggggacagtcgcccaccctctcctgcagggccagtcagtagttgttagtagtctttcgttacgccgttaggtaacccaaacgaacgtaaaacccgtcggaccctaacggccctaccccgaggtcccttccctacaattcctaagttgaacttcgactaacctacccgaaaccggaccggggaccctaacgtcgggacctaccgtaccccgaggtacccgtacgggtttaccgaacgggttcggaccgtaggggttcgggttccgtaggtacggaaccgtaacggttaccctttccgaaccctttcctacccgaaacccttacgtaccgaacggtcccaacggtacccgttaaggacggtacccgtaaggtaaacggttctttcgtacgtacgtttaagttttactacgtcgtacgagtacgtaggtacgtacgacctacgtccgtcctcgttactcgttcgggacggtacgggacgtagggtagacgtataacgaaacgtgtgcgtcncgtacactgtctgtacc

SEQ ID NO: 73783 - DNA, 769 bp, Homo sapiens
  misc_feature: GYAE6OF01EGISC.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcgagggccagtcagagttgttagtagtcttcgttacgccgtaggtaaccaacgaacgaaaccgtcggaccctaacggcctacccgaggtccttccgtctacttcctataggtactggacctaactacccgaaaccggcgggacccacgtcggcctacgtaccccgagtacccgttagggtttaccgacggttcggacgtacggggttcgggttctgggtacgaccgtaaggttacccttcaccgttccgtaaccctaaccctattaccgacaccgtacggtaccctaaggaccgtaccgttaaggaaacgttacgtttcgtacgtacggttttaagttttaccttccggttcgtaacccgaaggttacccgaaggttcccggtaagaaccccggttaaccgtccgggttaacccctttcgtaccggttaaccggtttccggggacggtaaccggggaccgtaagggtacggaccgtaaacgtaaccggaaaccggtacgttcgggaacgtcccgtaaggaccccttaacgcgttccgttacgttacccc

SEQ ID NO: 73784 - DNA, 786 bp, Homo sapiens
  misc_feature: GYAE6OF01DODDL.49.46.E02.1.454.CMB.1.raw
  modified_base (149)..(149): a, c, t, g, unknown or other
  misc_feature (149)..(149): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagactaccacgganaattgtgttgacacagtctccggccacctgttctttgtctccgaggggacagtcgcccaccctctcctgcgacgggccagtcgaggtagttgttagtacgtctttacgttagccgttaggtaacccaacgaacgaaacccgtgggacccgacgggtacccttaccccggaacggtcccttaccctacgtaacttacctaagttagagttaccgacctaaccgtacccgaaacggtaccggggtacccacgggtccggtaccaaccgtcccccgaagggtacccgtacgggttcggacggtcggacgttaggggttcggttactggtacgaacgtacgtcctttacaccttaccgactaacctacgtacctacgaccgtaaccgttccgtaacggaccgtaacggttacgtaaagttacttacgtacggtttaacttaagtttttaacttcgtacgttaccgaagtccgttaacgtaacggtacgtacgttaaccggttccggtaccttcccggtttccgtttaaccggggttccggggaagggtaaccgggaaccgtaaagggtcggtaaacgtacgtaaacccgtaagggtaacggtacggtcggtacgtaccgaccttagcttcgttcgtacccg

SEQ ID NO: 73785 - DNA, 725 bp, Homo sapiens
  misc_feature: GYAE6OF01EGNY0.49.46.E02.1.454.CMB.1.raw
  modified_base (234)..(234): a, c, t, g, unknown or other
  misc_feature (234)..(234): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcacgggccagtcagngtgttgtagctttcgttacgcgtacggtaaccaaacacggaaacctggaccacggccctacccgacggtcctaccctacacgttctaagtgtactgcctaacgtacccgaaacgaccgggtccaccgcggtactaccaccccgtccggtaacccgtccgaaagggtttcgggaccggttaggtcggggttacgttcgggttacgtaacgtacggtacgttaccttaaccggttaccttaacccgccgtaacctaaccaggtccacgccgtaacgcgaactacggtacgaagttacgttagttaccgtgtttaacttaaccgttagttaccgtacgtcgaacggtacgtaacggtccgtaaacgtcggtaacccgttcgtcctacgtttaccggtacgggtacgggaccggtaaccgggtaggaaacggacgttacgaaacgtaaaccgtaggccggtacgtgcccgtaactcgtaccttacgtctttaccg

SEQ ID NO: 73786 - DNA, 831 bp, Homo sapiens
  misc_feature: GYAE6OF01C1CKC.49.46.E02.1.454.CMB.1.raw
  modified_base (612)..(612): a, c, t, g, unknown or other
  misc_feature (612)..(612): n is a, c, g, or t
tcagagtcgagagacacgaccggtgctcgatttagactcatctacagggaaagggggaggaactgctcagttaggacccagagggaaccatggaagccccagctcagcttctcttcctcctgctactctcggctccagactaccgacggaagtaattgtgttgacacgagtctccgccaccttgtctttgtctccgagggacagtcgcccacctcgtctgccgacgggccagtacagtagttgttagtacgtcttacgttacgccgttaggtaaccaaaacgaacggtaaaacccgttcgggacccgtaacgggcccttaccccggaacggtcccttaccctactaaaccttccgttaagtcgtacgttccggacctaacgtaaccccgaaaacggccggggtaacccctaacggtcggaccctaaaccgttcccccgaacggtacccgttaacgggttacccgtaggggtacccgggtacggttaggggtttcggggttacctgggttaacctaacggtaacccgttactttaaccctccgtttccgaacctacccgtaataccgagtaccgtaacgtaacccgtaagacggtaccgtaagttaaaccgtntttaccgtaacgttacgtttaagtttttaacgtacttcggtaaccgtagaccgttacggtaccgtacgaacccgttaacggttcccgacgtttacccggttcggtttaaacccgggtggggaaccggggttaaccggaaaccgggtggttaagggaactaccgtaaacgtaacgggtagttcgggacacgttacgacctacgttgtcctcggtttaacc

SEQ ID NO: 73787 - DNA, 806 bp, Homo sapiens
  misc_feature: GYAE6OF01B65A8.49.46.E02.1.454.CMB.1.raw
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (367)..(367): a, c, t, g, unknown or other
  misc_feature (367)..(367): n is a, c, g, or t
  modified_base (417)..(417): a, c, t, g, unknown or other
  misc_feature (417)..(417): n is a, c, g, or t
  modified_base (466)..(466): a, c, t, g, unknown or other
  misc_feature (466)..(466): n is a, c, g, or t
tcagagtcgagagacacgaccggtgctcgatttagactcatctacaggggaaagggggaggaactgctcagttaggacccagagggaaccatggaacgccccagctcagcttctcttcctcctgctactctggcctccgagataccacggagtaattgtgttcgacacacggtcctcccggcctacccgttgttcgtttcgtcgtaccggagggactaggtccnccctaccctcgtccngccggacggtccagttcgaggtgttacggttaagtacgtccgtttactaccggtcctacgggtaaccaaacgaaacggtaaacccgttcgggacccgacgggtcccctacccgacggttcccttaccncttatccttagtcggatcgtaccacctacggaaccgcggaccagtcgacncgtccaagtcccgtagtcgaggtcggacgtggtacgtgtaggacgtacngttacctacgctaccctagaaccctgacgtacgaccgacgtaacggttaccaaccggttcgtaaggtaacttacgtttacccgtagttaaccggttttacttttaaacgtcgttaaccggtacgtaacgggtacctaccgttaacggaaccgttaacccgaggttccccgttacccgttaccggtttaacccgtccggggtttacggggaaccgggttaaaccgggtaacccggagggttaaggtaaacccggtaacgtaaaccggttacccggtaaagggtccgtaacccggttgtaaaccgttacccgtaacctcgttttacccgtgtttaacccccg

SEQ ID NO: 73788 - DNA, 694 bp, Homo sapiens
  misc_feature: GYAE6OF01DIHVK.49.46.E02.1.454.CMB.1.raw
  modified_base (247)..(247): a, c, t, g, unknown or other
  misc_feature (247)..(247): n is a, c, g, or t
  modified_base (267)..(267): a, c, t, g, unknown or other
  misc_feature (267)..(267): n is a, c, g, or t
  modified_base (375)..(375): a, c, t, g, unknown or other
  misc_feature (375)..(375): n is a, c, g, or t
  modified_base (404)..(404): a, c, t, g, unknown or other
  misc_feature (404)..(404): n is a, c, g, or t
  modified_base (430)..(430): a, c, t, g, unknown or other
  misc_feature (430)..(430): n is a, c, g, or t
  modified_base (448)..(448): a, c, t, g, unknown or other
  misc_feature (448)..(448): n is a, c, g, or t
tcagagtcgagagacacgaccggtgctcgatttagactcatctacagggaaagggggagaactgctcagttaggaccagagggaaccatggaagccccagctcagcttctcttcctcctgctactctggctcccagactaccaccggaagaaatttgtgttgacacagtctccggccacccttgtctttgtctccgaggggactagtcgcccaccttctcctgcgacgggccagtcagagtgttagngtcttctagcctggtaccanagaacctggccaggctccgagcctctcatctatgatgtacactccaaacgcgggtacccagtcggctactcccaagtcccgaggttccaggtcggctaggtcgggttnaggtcgacgtacgtcctttacacttccanaccctatccagtacacggcctagacnccgtaggaattcgttacncggttaacctaggttttacttacgcgttaacgtacgtacgaggtccgtaagacccgtaaaccgtttccgggtcccctttattcccggttaacccgggtttggggaacccggggtaaaccgggttaaacccgggagggtttacgggaacgggttaaacgaaaccccgggttaaaacggttcgttaccggggtacgggtaacccttcgggaaaccgttcctaaaccggttcgtttccgtttaaacccg

SEQ ID NO: 73789 - DNA, 752 bp, Homo sapiens
  misc_feature: GYAE6OF01DDRTE.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagaattgtgttgacacagtctccggccaccctgtctttcgtctccgaggggacagtcgcctaccctctcctgcagggccagtcaggtagtgttagtagtctttctacgtccgtacggtaaccaacgaacggtaaacctcgggacccacgggtccctaccccgacgggtccttccgtactacgttacctagtcgtatacgacctaacgtaccccgaacggaccggggtacccacggtacggcctacctacccgacggtcccgtacgggttacgacgggttcggcgtagggttcgggtctcggtacgaactacggtaccttcaccgttactcccgaactctaccgagaccgactaccgtaacgcggtacctaagtacgtcttacgtagttacttagtttaacttcgtacgttaccagtacgacgggttataacgtaccgtaaccgtccgtacctttcccgtacggtttacccggggtcggaaccgggggtacggttaaaccggaacggggttggaaaccgttaccgtaaaccggtaacggttacggtacgggttacgtaccgtaacccggtaccctaaggttaaccttccggttactttaccccg

SEQ ID NO: 73790 - DNA, 980 bp, Homo sapiens
  misc_feature: GYAE6OF01A0FOD.49.46.E02.1.454.CMB.1.raw
  modified_base (217)..(217): a, c, t, g, unknown or other
  misc_feature (217)..(217): n is a, c, g, or t
  modified_base (438)..(438): a, c, t, g, unknown or other
  misc_feature (438)..(438): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccacggagaaattgtgttgacacagtctccggccaccctgtctttgtcctccgaggggacagtgcccaccctctccngcgacgggccagtcgagtagttgttagtagtctttcgttacgccgtcggtaaccaacgaacgtaaaacccgtcgggtacccaggccctcccgagggtcctccctcaacttcctaagtcgatcggactaccttaccgaaacggaccgggacccaacgtcgggacctactacccccgaagtcccgtaaggttccgaagggtcggacgtacgggtcggggtttntacggtacgaacgtacgttaccgttaccacccttcgttaccccaaccgtactaccgaacgggtaccctaacgggtacccccttacgggtaacccgttacgggttttaccccggttaaaggggttaaaccgttttaaacgggtttttttttaacccggggtaaccgtttttaaacgggttttttttttaaacccgtttaaaaccggtttcggttttaaaccccgtaaacggggttttaaccgttaaaacggtttttaaacggttaaaacgggtttttcccccggggtttaacccccggggggtttacccgggtttaacccccgggtttaaaccccggttttaccgggttttaaccccgggggtaaccgggggttaaacccgggggtaaaccgggtaaaccggggggtttaaacgggaaacggttaaacccggttaaccggtaaaaacccgggttaccggttacggggtaccgggttacccttacgggtaaaccccttaacggttaaacccgtttcgtttcccggtttaaccgttttacccccg

SEQ ID NO: 73791 - DNA, 885 bp, Homo sapiens
  misc_feature: GYAE6OF01A4FAD.49.46.E02.1.454.CMB.1.raw
tcagagtcgagagacacgaccggtgctcgatttagactcatctacagggaaagggggagaactgctcagttaggacccagagggaaccatggaagccccagctcagcttctcttcctcctgctactctggcctcccagactaccaccggagtaaattgtgttgacacagtcctccggccacccttggtcctttgtcctacccgaggggacagttcgacccctacccttcttaccgtgaccgtacggggccctaggtaccgaggtagttcggtttaagtaccgtccttttacgttaacggtccgttaggtaacccctaaaacgtaacggtaaaacccttcgggaccctaagggtacccgtccccgaacgggtcccttaccctacgtaacttcccgttaatagggacttacgactaaccgtacccgaaacgtaccggggaccctaacggtacggtaccgtacctacccgacgtacccgtaacggttcgaacggttcgggaacccgtagggttcgggttctacggtagtaaccgtacgtacctttaccgtaccgtcccttaaacctaaccgtacgtacgtaacgaccgtaacgtacccttaagggccgttaacccggtaagtaaccgttacgtttacgtacggttaaccttaaggttttactaacggtacgttacgaacggtcgaacggttacgtacggacccgttaacgcccggttaccccttacgttaacccgtttcgggttaccgggtaaccggggaccggtaaacccgggttaagggtaccggtaaacgttaacccgtaaacggtaaaccggtacggttacccgggttacgtacccggtacgttaacccgtaaccgttacccgttaacgtttccggttaacccc

SEQ ID NO: 73792 - DNA, 851 bp, Homo sapiens
  misc_feature: GYAE6OF01C7NRE.49.46.E02.1.454.CMB.1.raw
  modified_base (219)..(219): a, c, t, g, unknown or other
  misc_feature (219)..(219): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagatacccaccggagtaaattgtgttgacacagtcctcccggccaccctgtctttgtctccgagggacagtcgcccaccctcncctgcgacgggcagtcgagtagtagttagtacgtcctttacttacgtccgtaggtaaccaaacgaacgtaaaaccgtcggacccaacgggcctaccccgacggtcccttaccctacaacttacttacgttaggtactacgactaacgtacccgaaaccgtaccgggaccctacggtcgacctacccgaccccgaggtcccgtaggttaccagggtacggcgtttacgggtcgggttacctaggtacgtaaccgtacgtaccttcctacttcctaaccgtacctactaccgcgaccgtaccgtacgtaacgggacgtacgtaacggtaacgttacttacggttacgttaacgtttaacgttttaacctttacgttcggttaaccctaacgggtagtacggttacgtaaccggttaccgttacccggttaccgttacccgtttaccgttaacccgtttaacccgggtttccgggggtaacccgggtaaccggggttaaacccgggtaacgggggttaacggtaaccgggtaaaaccggttaaacccgggtaaaacggtcccgggtttagggtaaaccggttccggtaacccgtaaaccgtaccgtttaacccggtgtttacccggttttacccg

SEQ ID NO: 73793 - DNA, 860 bp, Homo sapiens
  misc_feature: GYAE6OF01AVU8O.49.46.E02.1.454.CMB.1.raw
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
tcagagtcgagagacacgaccggtgctcgatttagactcatctacagggaaagggggaggaactgctcaggttaggacccagagggaaccatggaacgccccagctcagcttctcttcctcctgctactctggctcccagactaccaccggaagtaaattggtgttgacacagtcctcccggccctacccgtgttctttgtctaccgaggggacngtcgcccaccctctccnggcgacgggcctagtcaggtgttagtttacgtacgttcctttcgttcggacccgttcggtaacccaaacggaaccgtaaacccgtcgggaccctacgggtccttacccggacggtcccttacctctaacttcttagtacgtactcggtactaaccgtaaccgaacgtaccggggacctcggtacgggaccaaccgtcccgacggtaccggtacggtttaccggagggttcggggacgttacggggttacgggtttcggtacgggttacgaaaccgtacggtttaacctttaccgtacccttaccgtccgtaacccgtacggtaccacgttacggacccgtacccggttaaggccgtaacgggtagtaaacgttactttaaccgggttcggttaacttttaccggtttacgttaccgttaacggtgtaccgggtacggtacccgggttacgttaaccggaccgttaccggtccgttaccgttaccgttttaaccggttccggggtttaccgggaacgggggttaaccgggtaacgggtaaacgggtcggtaacgaaccggtttaaacggaaccgttacggttcggggaacgtccgtacgtaaccttaccctcggtttcttccgtttacg

SEQ ID NO: 73794 - DNA, 793 bp, Homo sapiens
  misc_feature: GYAE6OF01A29S6.49.46.E02.1.454.CMB.1.raw
  modified_base (226)..(226): a, c, t, g, unknown or other
  misc_feature (226)..(226): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagtaaattgtgttgacacagtcctccggccactctgtctttgtctcgaggggacagtcgccctaccctctcctgcgnggcctagtcaggtagttgttagtagtcttcgttacgccgtacggtaaccaacgacgtaaacccgtcggaccgacgggtcctacccgtagggtcccttccctactacgttacttagtacggaacgtcgtacctaccgtaaccccgaaaccggtaccgggacccctaccggtcggtaccctaccgtaccccgacgtaccggtacggttaccgtagggtcggaccgttaggggttcgggtcgtaggtaccggaactacggtacctttacctactcctaccgacctactaccgacgaccgtacggtaaccgtaggtaacccgtacgtaagtaacgttctttaccgtacgtttacgtttaacggtttaccttacggttaccgtacggtagtaccggtacgttaccggtaacgtacccgttaaccggttccgtaccccgtttaccgttacccggttaccgggttccgggaacgggtaaccgggtaaccggtaagggtacggtaaccggtaacgtaacggaaaccggtaacgtcgggaccggttcgtaccgtaccctacgtccgttcgttaccg

SEQ ID NO: 73795 - DNA, 786 bp, Homo sapiens
  misc_feature: GYAE6OF01D4BLK.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggcctccagactaccacggataaattgtgttgacacgagtccgtccggccacctgttctttgtcctcgagggactagtcgccctaccctctccgtgcgacgggccagtcgagtagttgttaagtacgtctttcgtacgtccgtaggtaaccaaacgtaacgtaaaccgtcggaccgacgggcccttacccgaggtcccttacctacgtaacttacgtagtggtaactcggacctaaccgtaaccgaaccggacgggaccctacggtcggacctaccgtacccgacggtaccgttagggtacgtaagggtcggtacggtagggttcgggttaccgtggtacgaacgtacgtaccttaccgtacctcctaacctacctatacacgacgtaacgtacccgtagacggtaccttaaggtaactgttacgtagtactttaagttttacgttaccgtacgtacgtacgtactaacgggtcgtaaccggtacgtaaccgtccggttccttaccgttacgttaccggggttacgggaaccgggttaacgggaaccggtaaagggtaaccgggtaacgtaaaccgttaaaccggtaaaacggtcggttacgggtacccggacgttaaccgacccgttaacgttacgttccgtttaccgttacccg

SEQ ID NO: 73796 - DNA, 631 bp, Homo sapiens
  misc_feature: GYAE6OF01EWL3V.49.46.E02.1.454.CMB.1.raw
  modified_base (214)..(214): a, c, t, g, unknown or other
  misc_feature (214)..(214): n is a, c, g, or t
  modified_base (264)..(264): a, c, t, g, unknown or other
  misc_feature (264)..(264): n is a, c, g, or t
  modified_base (442)..(442): a, c, t, g, unknown or other
  misc_feature (442)..(442): n is a, c, g, or t
  modified_base (583)..(583): a, c, t, g, unknown or other
  misc_feature (583)..(583): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagaaattgtcgttgacacagtctccggccaccctgtctttgtctccaggggacagtgccaccctntcctgcagggccagtcagagtgttagtagcttcttagcctggtaaccaanagaaacctgaccaggcctcccaggtcctcctcagtctatgatgcataccaacgcgggccacgtggacactcccagccgtaggttcaggtcgctaggtcggtctggtcgaacgtagtaccttcgacccttctaccacatccgaaggctaacgaccttaagacgtacccgtagaaacgtnttacgtagaccgttaatttagtactgtacagtccgaagtcgtaagaacctaccgtcggtacccttacgtccgtaacgttcggggaccggtaacgggaacccgtaaaggggtggaacgtaacgttaaccgaaaacccggttntcgggttaacgcgtaacgaccctaccgtaagttcccgtacggttaacc

SEQ ID NO: 73797 - DNA, 823 bp, Homo sapiens
  misc_feature: GYAE6OF01A8YGJ.49.46.E02.1.454.CMB.1.raw
tcagagtcgagagacacgaccggtgctcgatttagactcatctacagggaaaggggaggaactgctcagttaggacccagagggaaccatggaagccccagctcagcttctcttcctcctgcctactctggcctcccagataccaccggagaaattgtgttgacacagtctccggccacctgtctttgtctccgagggacagtgccaccctctcctgcgagggtccagtcagtagtgttagtagtccttctagcctaggtaccaacgacgaaacctcggacctagggcctacccgaggtccttcccgtatactaccgtataggtactcggtaccaacttacccgaaaccggtaacggggtcccctaaccggtagggtaccctaacgttacccccgaaagggttccccctaaaggggttttacccgaacgggtttcggggacccgttaacggggtttcggggttaccctttagggttaaccggaacttacgggttaacccttttacccgaaccctttccccgttaaccaaccccgttaagttacccgaaacgtaccgtaaccggtaccccgttaacggaccggtaacccgttacgggtaaaacgttacgtttacgttaccggtaccgttaaacgtttttaacgttaccgtttcgtacctacggacgtacggtacgtaacgtcgtaaaccgttcgggtcccttaccgtaccgttaccgtttcgggaccggtacggtaaccggtaacggtggtaacgtaacgttacgaaaaccggttcgtacgggttacgacgtcgaaccgtaccgtagttccgttacgttacccg

SEQ ID NO: 73798 - DNA, 805 bp, Homo sapiens
  misc_feature: GYAE6OF01C016V.49.46.E02.1.454.CMB.1.raw
  modified_base (597)..(597): a, c, t, g, unknown or other
  misc_feature (597)..(597): n is a, c, g, or t
tcagagtcgagagacacgaccggtgctcgatttagactcatctacagggaaaggggggaggaactgctcagttaggacccagagggaaccatggaagcccagctcagcttctcttcctctgctactctaggcctccgagtacgtaccaccggagtaattggtgttaggactacgagttccgccgggacctaccgtgttcctttgtccgtccgaaggggacaggtcgacccgtacctcggtccgcggcgtacggggacccaggtaccgagggtacgttgttacggagtccttctacggtccgtagggtaaccaacgacggtaaccgtcggaccgttacgggacctccggtaagtccttccctacgtaacttccgtagttaggacttaccggacctaaccgttacccgaaagggacccggtcccctaaggggtcccggtaacgacccggtacccccgggaaggtccggttaaagggttccggaacggttcggtaaccggtgggtaacgggtttgtacggtacgaacgttaacggtcctttacaacggttcctaacggacaacgtcggagtaccgacgtacgtacggtacgaccggttanaacggttacgtacgtacgtaacgtttaacgttaacgtttacgtacgtacggtactaacgggtacgtaacgtaccgtaacggttccggaaccgttccgtaccgtacgttaccgggtacgggtacggtaacggggacgacgggtacggtacgtaacgtaacggactacggtacgcttaccggactacggtaccacggttacctgtacccg

SEQ ID NO: 73799 - DNA, 827 bp, Homo sapiens
  misc_feature: GYAE6OF01ASAVD.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccgagactaccaccggagaaattgtgttagacacacgtaccgtccggacctaccctgttctttcgtcctaccgaggggtactacgtcgaccctaccccgttcgtcctggaccgacgggccctagtcacggtagttcgttaagtacgtcctttacgttaacgccgttacggtaaccctaaacgtaacggtaaacccttcgggacccgtacgggtccctaccgtaggtccctccgtactacgttctacgtgtactcggctaacgtaccgaacggacgggtcccaccgtggtacccaccgtaccccgacggtacccgttaagggttaccgacgggtacggtaccgtacggggttccgggttacgttacgtaggtaaccctaacgggttaaccttcccgtaaccttaccgtaccctaaccgtacgtaccggacgaccgttaaccgtacgtaaccggacgttccgtaaaggtacgttaccgtacgttacgtaccgtttacgttaacgttacgtagaccgtcgtaactaccgtacgtaacgccgttaaccgtctacccgttactacgggttcccggtacgggaccggtaacgggtaaaccgttagggtccgtaaaacggtcccgtaaaccggaacggtttaccgcgggttacgtacccggtaccttacgaaccggtccgtttaccggtccttaacccg

SEQ ID NO: 73800 - DNA, 893 bp, Homo sapiens
  misc_feature: GYAE6OF01C5D5E.49.46.E02.1.454.CMB.1.raw
tcagagtcgagagacacgaccggtgctcgatttagactcatctacagggaaagggggaggaactgctcagttaggacccagagggaccatggaacgccccagctcagcttctctttcctcctgccttactctggcctccaagactacccgaccggaagtaaattgttgttcgactacgacgtccttcccggcctacccgtgttccttttcgtcctcccggaaggggactagtccgccctaccctctccgtgccgacgggcccagttccgagtagttgttaggtactctttcgttacgcttacggtaccaacacgaaaccgtggacctacggcctacccgacgtcctcccgtactacgttacctagtgtacgtacggtcctaacgtacccgaaacggaccgggtaccctaccggtacggcctaaccgtcccgaacgtcccgtaacgggttacctgggtccggtacggtacgggtttcgggtccgtaggttacgaacgtacggttaaccgtttcccaaccctttccgtaacccgtacctaaccgttaccggacgtaacccgttacggaccccgttaaggacccgttcgtaaggttaacttacgttaccgttacggttactttaaacggtttttacttacccgtacggtttacgtaacgtacccggtaaggttaccggtaaccgttaacccttaaccggtttcccggtaacccctttcggtaaccccgggttttaacgggttaccccgggggaacgggtaacccggggttaaacccgggtaagggtaccggggtaaaccgtaaacggttaacggtaaaaccggttacggtcggttaaccgggcgtaaacccggtttaccggaccttaaaccggtttcgtttaaccgtttacccccg

SEQ ID NO: 73801 - DNA, 935 bp, Homo sapiens
  misc_feature: GYAE6OF01AV7Q2.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgttctttgtctccgaggggacagtgcccaccctctcctgcagggccagtccagtagtgtttaagtagtcctttacgttacgccgttaggttaaccccaaaacgacgaaaacccttggacctaacgggtcctcccgaaggtccctacctctaacttcgtatagtacgttgacctactaccaaacgaacgggtcccacgtcggaccaactcccgaacgtcccgtacggtttacgacggtggaccgtaagggttggggttcctaggtcggtaaaccacggttaaccttcgacttccctaaccgtaaccctagtaccggacgtacgtaaccggtaacccgttaacgggtaccgttacccggtaacggaaacggttaacttacccgttaggtaccgttttaaacggttttaccgttttaacgtacggtttaaccgtaaccggtaccgtaaaccgggttaccggttaaacccgtaccgggttaaaccgtttccccggggttaccccttttaaacccgggtttacccgtttaaccccggggttttaccggggtaaacccggggggttaacccggggtaaaacccggggtttaaaccggggaaagggggtttaaacccggtaaaaccgggttaaacccccggggttaaaaaaccgggtaaaccccggggtttaacgggttaacccgggtaaccggttttaaaccccgggacccgttaaaaccccggttaactttaccccgtttaacccgggtttttaacccgg

SEQ ID NO: 73802 - DNA, 754 bp, Homo sapiens
  misc_feature: GYAE6OF01EH4L7.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagtaaattgtgttgacacagtcctcccggcccacccttgttcttttgtcctccgaggggactagtcgcccaccctctcctgcgagggccagtcaggtagttgttagtacgtcctttacgttacgccgttacggtaaacccaacgaacgtaaacccgtcggacccgacggtccctaccccgacggtccttcctactacttaccttatcgtatcgacctaccgtaccgaaaccggaccgggtaccctacggtcggacctaccgtacccgaacgtccgtacggttcgtagggtggacggttacggttcggggtcttacggtacgaacgtacgttaccttcgtacccttcctaccaccgtactaccgacgtaacgaccggtaccgttacggaccgtaacgtaagtaagttaccgtttacgtacgttaaccgttttacgttttacttaccgttcgtaacgtcggaagtacggtacgtaaccgtaccgtacgtccgttaccccttaggttccggttacggttacccggggacgggtaacggtaaccggtaagggacgacgtaacgaagtaacgtacgtggtaccgtacgtccacgaccttcgtgttcgtccg

SEQ ID NO: 73803 - DNA, 788 bp, Homo sapiens
  misc_feature: GYAE6OF01BIL2E.49.46.E02.1.454.CMB.1.raw
  modified_base (177)..(177): a, c, t, g, unknown or other
  misc_feature (177)..(177): n is a, c, g, or t
  modified_base (244)..(244): a, c, t, g, unknown or other
  misc_feature (244)..(244): n is a, c, g, or t
  modified_base (253)..(253): a, c, t, g, unknown or other
  misc_feature (253)..(253): n is a, c, g, or t
  modified_base (324)..(324): a, c, t, g, unknown or other
  misc_feature (324)..(324): n is a, c, g, or t
tcagagtcgagagacacgaccggtgctcgatttagactcatctacagggaaagggggaggaactgctcagttaggacccagaggaaccatggaagcccccagctcagcctttctccttcctcctgctactctggcctcccagactaccacggaagtaaattgtgttgacacagttcncccggccacccttgtctttgcctccgaggggacagtcgcccaccctctcctgcgagggccagtcagngttgtttangtctttcgttcgacgttacggtaaccaaacgagtaaaccgtcggacccgtaggcctcccgacgtccctccnctaatccgtatcgtacgtgactactacccgaaaccgacggggtacccaaccggtcggtacctaccgttaccccgaacgtacccgtaacggggttacgaacggtcgggacgttacggggttacgggttcggtggttaaccgtaccgtaacggttacccgtttaccgtacccgttcccgttaaccaaaccgtacgtaccgaccggtaccgaacgttacgtaccggaccgtacccggttaacgtaaacggttaccttacgttacgttacgtttaacgttttacgtttaaccgtacttaaccggtcgtaaccgtaacgtcggtaaccgtaacgacccgttaccgttccttacccgttcgttaccggttaccgggacggtaacccggggtaacacgggtacggtaactacgggaactaaacggtacgttacggacgttacgtcaacctaacttctacggtcgttacccg

SEQ ID NO: 73804 - DNA, 768 bp, Homo sapiens
  misc_feature: GYAE6OF01CKAF4.49.46.E02.1.454.CMB.1.raw
  modified_base (182)..(182): a, c, t, g, unknown or other
  misc_feature (182)..(182): n is a, c, g, or t
  modified_base (215)..(215): a, c, t, g, unknown or other
  misc_feature (215)..(215): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctccagactaccacggaagaattgtgttgacacagtctccggccaccgtntcttgctcgaggggacagtcgccctacctctcngcgacgggccaggtcgagtagtgttagagtcttacgtagccgtaggacctaaacgaacgaaccgtcggaccgacggtcctccgaaggtcctacctacaactccgtataggtacttacgacctacgaccgaaaccgacggtaccctacgtcggacacctacccggacgtccgtagggttaccgaggtcggtacgtaaggtcgggttcgtaggtacggaactacgttaccgtacctaccttacctaccgaaccttacgacgtacgtacgaccggttaccgtaacggtaacgtaccgtaacggtaaacgtcggttaccgtagtaccgttttaaacgttacgtttaccgtaacggtactaaccggacggtaccgggtaacgttacccggtaaccgttaacgtacccgggtaccttaccgttaccgtttaaccgggtccgggttaacggggacggttaaccgggaaccgggttaggaaccgtaaccgtaacgtaaaccggtcgttacgggtacgtaccggtacggtacttaaccccgtgtttcgtaaccgtttccccg

SEQ ID NO: 73805 - DNA, 842 bp, Homo sapiens
  misc_feature: GYAE6OF01AZ2WI.49.46.E02.1.454.CMB.1.raw
tcagagtcgagagacacgaccggtgctcgatttagactcatctacagggaaagggggaggaactgctcagttaggacccagagggaaccatggaagccccagcctcagcttctcttcctcctgctactctggctcccagactaccgaccggaagtaaagttgtgttagactacgtacgtccgtccggccctacccgttgttccgttttgtccctaccggaggggtaccaggtcacccctacccgttccgtaccgtggccggacggggccctaggttaccgaggtacggttggttaaggtacgtcctttacgttacgtccgtacggtaaccaaacgaccgaaccgtcggccaggccctacccgaggtcctcctacatcctagtgacttcgaccacgtacccgaacggtacgggccctacgtgggccctaaccggtccccgtacggtccgttagggtttccgacgggtacggtacgtacggggttcggtacgtaggtaccggaaacgtacggttacctttccgtaaacccttccgtaaccctaaccgtactaccgaaccgtacctaccgggtaaccgtaacgggacctacccgttaggtaaaccttcgttaccgacgtttacgttaacgtttttactaccgttcggtacgaccgggtacaacgggtttccggaactacccgttaacccgtccggtaccccttacgttaaccggttcgggttacccgggacgggtaaccggttacggtaacggggtccgtaaaggttaccctaaacccgtaaacggttcgtccgggtaccgttacgaacgtaacccgtacgttacgttaccgtttccggttaacc

SEQ ID NO: 73806 - DNA, 760 bp, Homo sapiens
  misc_feature: GYAE6OF01DFUHJ.49.46.E02.1.454.CMB.1.raw
  modified_base (654)..(654): a, c, t, g, unknown or other
  misc_feature (654)..(654): n is a, c, g, or t
tcagagtcgagagacacgaccggtgctcgatttagactcatctacaggggaaagggggaggaactgctcagttaggacccagagggaaccatggaagccccagctcagcttctcttcctcctgcctactctggcctcccgagactaaccaccggaagtaaattgtgttgacactagtcctcccggcctaccctgttcctttcgtctccgaggggactagtcgaccctaccctctccctggaccgtacgggacctagtaccgaggtaggttagttaggtacgtctttacgttagcctacggtaaccaaacgaacgtaaacccgtcggacccgacggcccgtacccgaacgggtccttacctctaacgttactaacgtgtacttcggacctaacctacccgaaaccggtaccgggaccctacgtccggcctaaccgtcccgaacggtcccgtaaggttccgtacggtcgggaccgtagggttcggggtctaggtccggacgtaacgtcttacaccttcaacctactactacgacgaccgtacgacccgtaacgtacgtaccggtaagtaaccgttagtttaccgtacggttactttaacggttttaacttcgtagttaccgacgtaccgtaggtactacgtactaccgtcgtaccncgttacgtaccgggttcggacgggaaccggtagtacggggtactacgtaacgaacggtaaacgtacggtcggtcgacgtccgaactccggttctacgtttctaccg

SEQ ID NO: 73807 - DNA, 672 bp, Homo sapiens
  misc_feature: GYAE6OF01BPH9J.49.46.E02.1.454.CMB.1.raw
  modified_base (160)..(160): a, c, t, g, unknown or other
  misc_feature (160)..(160): n is a, c, g, or t
  modified_base (307)..(307): a, c, t, g, unknown or other
  misc_feature (307)..(307): n is a, c, g, or t
  modified_base (536)..(536): a, c, t, g, unknown or other
  misc_feature (536)..(536): n is a, c, g, or t
  modified_base (662)..(662): a, c, t, g, unknown or other
  misc_feature (662)..(662): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttnacacagtctccggccacccgtgtctttgtctccgagggacagtcgccaccctctccgtgcgacgggccagtcgaggagttcgttagtcgtcttcttacgccgtaggtaccaaacaacgaacctcggccaaggcctcccgaggctccntatcgtatgatcgacactaccgaacgcgggaccacgcggacacgtacccgacgtacccgaggttaccgaggttggaccgtaggttcggggttcctaggttaccgaacgtaacgttaccttaccgtaccttaccgtacctaaccgacttaccgagacctaggacccgtaagaccgtacctaaggaaacttacgttctacggtactttaacgtttacggtactacggtacncggtactacggtacggtacaaccgttacgtcggtccctaacgttcctacgggttcgggaccggacgggtaacgtaagggacgaacgacttaacggaacgtgtacggtcgacggtacaccgaacttntcgttatacg

SEQ ID NO: 73808 - DNA, 732 bp, Homo sapiens
  misc_feature: GYAE6OF01B4VFM.49.46.E02.1.454.CMB.1.raw
  modified_base (393)..(393): a, c, t, g, unknown or other
  misc_feature (393)..(393): n is a, c, g, or t
  modified_base (708)..(708): a, c, t, g, unknown or other
  misc_feature (708)..(708): n is a, c, g, or t
tcagagtcgagagacacgaccggtgctcgatttagactcatctacaggggaaaggggggaggaactgctcagttaggacccagagggaaccatggaagccccagctcagcttctcttcctcctgctactctggcctcccagataccgaccggagaaattgtgttgacacagtcctcccggcctacctgtctttgtcctccgaggggacacgtcgccctaccctctcctgcgacgggccagtcaaggtgttagttagtacgtctttcgttacgccgtacggtaaccaaacgaacgtaacccgtggccaacggtccctcccgaaggtccttcctactacttcctaagtcgtatcgacctaactacccgaaacgccgggtaccacgtcgggtaccnccgtacccgacggtaccgtacggtttacgacgggtcggacggtagggttcgggttcttacggtaacgacgtaacgtaccttaccgtacctttacctaaccctaaccgtcgtaccacggtacccgtaaccgttaaccgtaacgggtacctaccggtttaaaggaaacgttcctttacggttacggtaccttttaagtttaccttacgtacggttacgacgtacgacggtaccgtaagtacctaacgtcggtacctcgttacctggttccgggagacgggacgtaggagtacgtacaacgaacggtcgtacgcgtcncgtaccacttctacggtcttaccg

SEQ ID NO: 73809 - DNA, 841 bp, Homo sapiens
  misc_feature: GYAE6OF01BEXEY.49.46.E02.1.454.CMB.1.raw
  modified_base (153)..(153): a, c, t, g, unknown or other
  misc_feature (153)..(153): n is a, c, g, or t
tcagagtcgagagacacgaccggtgctcgatttagactcatctacagggaaagggggaggaactgctcagttaggacccagagggaaccatggaagccccagctcagcttctcttcctcctcgcttactctggcctcccagactaccacgganaaacttgtgttgacacacgtctccggccaccctgttctttgtcctccgaggggactagtcgccctaccctccttccgtgcgacggggcctagtcgagtcgttagttagtagtctttacgttacgccgttacggtacccaaacgaaccgaaaccgtcggaccgacgggtcccgtacccgtaacggtcccttaccctcgtaaccgttccttaagttacggtacgtaccgtaccgtaaccgttaccccgaaaaccggtccgggtaccccgtacggtaccggaccctaacccgttccccgaacccgggtacccggttacgggttaaccggacgggttacggggtaccggttaggggttaccgggtcgttaggtacggtacccgtaacggttaccttcccgttaaccttccctacctaaccgtacgttacccgaacgacccgtaacggttacccgaaccggtacgttaacccgggtaagtaaaacggtttcgttaaccgtttgttaaccgttttagttttaaacgtccggtacgtaacgtcggactacgggtacgtacgtaccgtaccggttcgtcctttaccgtacgtttcgggtaccgggaccgggtacggtaacgttaagggacgtaacgaacgttaccgaacggtagtacgggtcgaccgtcgaaccttacggtctttgtccgttaccg

SEQ ID NO: 73810 - DNA, 742 bp, Homo sapiens
  misc_feature: GYAE6OF01AEP2B.49.46.E02.1.454.CMB.1.raw
  modified_base (428)..(428): a, c, t, g, unknown or other
  misc_feature (428)..(428): n is a, c, g, or t
  modified_base (486)..(486): a, c, t, g, unknown or other
  misc_feature (486)..(486): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctccagataccaccggagaaattgtgttgacacagtctccggccaccctgtctttgtcctccgaggggactagtcgccaccctctcctgcacgggccagtcagtagttgttagtagtcctttcgtttacgccgttcggtaaacccaaacgaacggaaaacccgttcgggcccgtaacggggcccttccccgaagggtccccttcctacctaacgttctagtcggaattcgacctaacctacccgaaaccgtacggcccacggttcgcctacctacccgacgtaccgtacggttacnggtcggcgttaggtcggttcgagttcgaactcggtaccttcaccgtcctacgactacncgacgcctagaccgagtcgtaacgaggacgttactcgttacgtagttttaacgtttaccgtacgttcgcggaactcggaccttacggtactaccgtacggtccggtaccctttacccgtcggttacggttaccggggacgggtaacggtaacccggtaaagggtccggtaaaggtaacccggttaaagtaaaccgggtcgttcggtaaccggttacgtcgtaaccctaccgttaccggttacgtttccgttacccg

SEQ ID NO: 73811 - DNA, 954 bp, Homo sapiens
  misc_feature: GYAE6OF01CUZHV.49.46.E02.1.454.CMB.1.raw
tcagagtcgagagacacgaccggtgctcgatttagactcatctacaggggaaagggggaggaactgctcagttaggacccagagggaaccatggaagccccagctcagtcttctcttcctcctgtctactctggcctcccagatacccgaccggaagaaatttgtgttgacacacgtcctccggacctaccctgtctttgtcctccgaggggacaggtcgaccctacccttctccgtgccgacgggccagtacgacgtagttagttagtacgtcctttacgttacggtccgttaacggtaccctaaaacgacgtaaaacccggttcgggaccctaacgggcccttacccggacggttccctaccgtactattctactagtacgtcgacctacgtacccgaaaacggccgggaccctacggttccggaccttaccgtaccccgagggtccccggttaagggtcccgaggggttaccggtccggttaaggggtttccggggtttacgtaagggttaaccgtaaacggttacccggtaaaccgtttttccccggaaaccttttacccgtaaccccgtaaaccgttacgtacccgggtaacggtacccgtaaccggtaaccccggttaacggtaaccggttacccgttaaggttaaaccgttacggtttacccgggttacggtaaccttttaacgggtttttaaccgtttaaaccgtcgtttaaccggagtaacccggtacgggttacggtaaccgtaaccggtaccggttaccgttacccttccgtttaaccggtaccgggtttaccggggaacccgggggtaaacgggttaacccggggtaaagggttacgggtaaaccgttaacccgggttaaaccggtaaaacgggttcgggttacgggaccgttacccgtaccggtaacccgttaccttaacggtttcgttaccggtttaccc

SEQ ID NO: 73812 - DNA, 688 bp, Homo sapiens
  misc_feature: GYAE6OF01AO3I2.49.46.E02.1.454.CMB.1.raw
  modified_base (300)..(300): a, c, t, g, unknown or other
  misc_feature (300)..(300): n is a, c, g, or t
  modified_base (312)..(312): a, c, t, g, unknown or other
  misc_feature (312)..(312): n is a, c, g, or t
  modified_base (410)..(410): a, c, t, g, unknown or other
  misc_feature (410)..(410): n is a, c, g, or t
  modified_base (599)..(599): a, c, t, g, unknown or other
  misc_feature (599)..(599): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagtaaattgtgttgacacagtctccggccaccctgtcttgtctccgaggggacagtcgccaccctctcctgcacgggccaagtcagtatgttagtagcttctagccgttggtaccaacgagaacctggaccaggtcctccaggtcctcctnactctacgagtntcgatactaccgaacgtacgggcctaacgcggaccactcccagccgtaggttccaggtcggcgtaggtcgggttctggcgaccgtagtaccttttacncctttaccacctacctacgcgtaacgcctacgccttaacgacgtcgtaaggaacttacgttctaacgtaccgtttagtttaacctttagtcgtacgacgaacgtacggttacgtacgtaaccgtaccgttacggttccctacgtttacccgtacgggtttacccgggaacgggggttacgaaaccgggngggttaacggacggtaaccgttacggaaacgtccgggttaagtccggttaccacggtacccgtaattaccgttccgtccggtttaaccc

SEQ ID NO: 73813 - DNA, 727 bp, Homo sapiens
  misc_feature: GYAE6OF01C1Q7O.49.46.E02.1.454.CMB.1.raw
  modified_base (528)..(528): a, c, t, g, unknown or other
  misc_feature (528)..(528): n is a, c, g, or t
tcagagtcgagagacacgaccggtgctcgatttagactcatctacaggggaaagggggaggaactgctcagttaggacccagagggaaccatggaacgccccagctcagccttctcttcctcctgctactctcggcctcccagactaccaccggagtaaattgtgttagacacgacgtccgtcccggaccacccgttgttcctttcgtcctccggaagggggaccaggtccgaccctacccgtctccgtcggcacggggcctagtcgagtgttagtagtacgtctttacgtagccgttacggtaaccaacgacgaaccgtcggaccaacgggccctaccggacggtcccttaccgtactacttacctatacggtactcgacctacgaccgaaacggcggaccacgtccggacctaccggacccacggtacccgtaggtaccgtaggttcggaacggtcggggttacgggtttcgtacgggacgtaacccgaacggtttcccttaactaccgttactaccaaccgttanaccgacgtaccgacgttaccgagaccgtacttaagggatttacgtacggtataaccggtttatttaaccgttacgtcggacagtacgagtacgtacacgtacggctcctcgtaccggtacggtacgggaacggacggaggtaacggaggacgtaacgaggaaacgtcggtagcgacgtacacgacttgtcttacgtacc

SEQ ID NO: 73814 - DNA, 647 bp, Homo sapiens
  misc_feature: GYAE6OF01DTJED.49.46.E02.1.454.CMB.1.raw
  modified_base (232)..(232): a, c, t, g, unknown or other
  misc_feature (232)..(232): n is a, c, g, or t
  modified_base (301)..(301): a, c, t, g, unknown or other
  misc_feature (301)..(301): n is a, c, g, or t
  modified_base (481)..(481): a, c, t, g, unknown or other
  misc_feature (481)..(481): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgagggacagtgcccaccctctcctgcagggccagtcagngtgttagtagtcttcttagcctaggtaaccaacaagaaacctggaccaggcctcccgaggtcctcctanactcgtatgtatgactataccaaacggcggacctaacgtggaccactcccgagacccgtaggttccagtcggacgtaggttggggtctgtgaaaccagtaccttacaccttctcaaccatcagcgaacgtcctaaggacgacctaggaacgtattacgtagtcttaagtttaataccgtntaccgagctacggacgtagtaccaacgttcgtaccgttactaccgtacggtttccgggaacgggtaccgggaaccggtaagggttacggaacggtaacgtaacccgtaaaacggtacgtagggttacggaccgtacgacccaaccgttacttcgttccggttaacc

SEQ ID NO: 73815 - DNA, 830 bp, Homo sapiens
  misc_feature: GYAE6OF01A89XB.49.46.E02.1.454.CMB.1.raw
  modified_base (251)..(251): a, c, t, g, unknown or other
  misc_feature (251)..(251): n is a, c, g, or t
tcagagtcgagagacacgaccggtgctcgatttagactcatctacagggaaagggggaggaactgctcagttaggacccagagggaaccatggaagccccagctcagcttctcttcctcctgctactcgtggctcccagactaccacggagaattgtgttgacacgtacgtcgtccggcctacccttgttctttcgtcctaccgaggggaccaggtcgccctaccctcctccgtgcgacgggccagtcagnggttcgttagtacggtcttcgttacgccgttcgtaaccgaaacgaaccgaaaccgtcggacccgtaacggtcccctacccgtaaggtcccttacccgtacgtacttaccgttaagtcggtaacgttcgaccgtaaccttaacccgtaaaccggtacgggtaccctaaccgtacgggtacccgtaaccttaaccccggaccggttaaccggtaaccgggtttacgtaccggtacggtacggtacggtacggggttccggtaggtacgggtacgtacggtacccttacgtaccctacctccctacctaactacgtaccgtaccgacggtaacccgtaccgtagtaacccggtagtaacgttaagtccgttaggtacctttaaacggtttatttacgttcgtaacgtacggtacgtaacggttaccgagtaaccgtacgaccgttcccgttcccgttacggttccgtttaccggggcggtaaccgggaggttaccgggtaaacggtacgggtaactaacggaaccggtaacgtacggttcgaacgtaccgtacgaaccctttcggtaccttaccgggtttcc

SEQ ID NO: 73816 - DNA, 953 bp, Homo sapiens
  misc_feature: GYAE6OF01DN6HU.49.46.E02.1.454.CMB.1.raw
tcagagtcgagagacacgaccggtgctcgatttagactcatctacagggaaagggggaggaactgctcagttaggacccagagggaaccatgggaacgccccagctcagcttctcttcctcctgcttactctggcctccagactaaccgaccggagtaaattggtgttcgacacacgtctccggcccacccttgtctttcgtcctaccgaggggacagtcgccctaccctctcctagccgagggcctagtcaggtagtgttagtagcttcgtagccgtagtaaccaacgaacgaaacctcggaccgacggcctacccgacggtcctacctcacgttctagtagacgtgtaccacgttacccaaaccggaccgggtacccaacggttcggaacccctaaccgtaccccgtaaccggtaccccggtaacgggtttaccggaacgggttcgggtcccggttaaagggggtttccggtttcgttacgggtaaccgtaaccggttaacgtaacctttttaccgaccgtttacccgttacccgaaacccttaccgtacggaaccgttacccggaaacccggtaccgttaacgggaacccgttaaccggtaaaccgttaaacgggttaccttttacgggtaaccgtttaacgtttttaacggttttttaaccgtaacggtttacggtaaccgaacgggttaccggtacccggttaaacgggttaaacccgtaaccccggttaagttaccccggggtcgtttttaccccggtacggtttttaacccggggttcccggggaaaacgggttaacccggggtaacggtaacgggggttaaacgaaaccggtttaaccggtaaaaacccgggttaaaaccggttacgggttaccgggtaacggtaacccgtttaaaccggacccgtttaaacccgtttcggtttcccgttacgggttttaacccc

SEQ ID NO: 73817 - DNA, 855 bp, Homo sapiens
  misc_feature: GYAE6OF01AZWNJ.49.46.E02.1.454.CMB.1.raw
  modified_base (166)..(166): a, c, t, g, unknown or other
  misc_feature (166)..(166): n is a, c, g, or t
  modified_base (226)..(226): a, c, t, g, unknown or other
  misc_feature (226)..(226): n is a, c, g, or t
tcagagtcgagagacacgaccggtgctcgatttagactcatctacagggaaagggggaggaactgctcagttaggacccagagggaaccatggaagccccagctcagcttctcttcctcctcgctactctggctcccagactaccaccggagaattgtgttgacanagtcctcccgccaccctgttctttgtcctccgaggggacagtcgccctaccctcctccgngccgacgggccagtcagtagtgttagtacgtcttacgttacgccgtacggtaacccaacgaacgaaacccgtggcccaagggtccctcccgaacggcccttacccacctagttaccctagttacgtacgtacgtaccgaacctacccgaaacggtaccgggtaccctaaccgtcgggtaacccctacgaccccccgtaacgggtcccggtaacgggtttacccgaagggttccggaacgttcgggggttaccggggtttacgttcggttacggaaccgtaaccgttaacccgtttccgttaacctttaccccgtacccgttaaacccgtacttacccgaaccgtaaccgtacggtaacccccttaagggtccccgtaacgtaaggtttaaaccgttaacttaccggttgtaacccgttttaaggttttaacttaccgtagtttaccgtacggtacccgtaagggttacctaacggtaaccctacggtacccggttccttaccgtacccggttacgggttaccgggtacgggtaaccgggacggtaagggtttaccggaataaaccgggtaaccgtaaacggtcgtacgggtctaccggtacacccgtacgtaactcggttacgttaccg

SEQ ID NO: 73818 - DNA, 768 bp, Homo sapiens
  misc_feature: GYAE6OF01A75DS.49.46.E02.1.454.CMB.1.raw
  modified_base (563)..(563): a, c, t, g, unknown or other
  misc_feature (563)..(563): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagtaaattgtagttgacacagtctcccggcctacccttgttcgtttgtccgtaccgaggggactggtcgcccctacccttctccgtgccgtaggggccctagtcaggtagttcgttaagtacgttccttttcttaggcccgttacggtaacccaaagacgtaaacccgtgggacccaacggccctcccgaggtccctcctacgtactctagtgactgactacgtaccaacggccggacctacgtcggacctacctacccgacgtacctagggttaccgacgggtacggcgtacgggttcgggtacccgtttaggacggtaacgtacgttaacccgttacctaccgttcctacctaacccgtagttaccgaacgttcaaccggtacccgtaggtacgtaccgtagtaaacggttnttacggtacttacgtttaagtttacttacgtcgtaccgaagtccgacgtacgtaacctacgtaccgtcgtcccttacgttaccgtcggtttaacggggccggaacgggttacgtaaaggggttagaaccggttaaactaaccgggtaaaccttacgggtacggtcgacgtccgtaacccgtataccgttacgtccggttaaaccg

SEQ ID NO: 73819 - DNA, 709 bp, Homo sapiens
  misc_feature: GYAE6OF01DCVQG.49.46.E02.1.454.CMB.1.raw
  modified_base (203)..(203): a, c, t, g, unknown or other
  misc_feature (203)..(203): n is a, c, g, or t
  modified_base (215)..(215): a, c, t, g, unknown or other
  misc_feature (215)..(215): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccgaccggaagaaattgtgttgacacagtctccggccacctgtctttgctcaggggacagtcncccacctctccngcagggccagtcagagtgttagtagcttctagcctaggtaccaacaagaaaccgtcggaccacggctaccccgaggtcctccttcatctatgagttcgactactacccgaaacgcgggacctaaccgtcgggactaccgtacccacggccgtacggtttacgaaggttcggcgtaacggggttcgggttaccgtggtaacgtaacgtacggtaaccctttaccctacctttacctacccggtaaaccgtactaccgacggaaccgtaccggtaacccgttaaggaccgttaacccgtaaggtaaaccgttaacgtttccgtacgtttaacgttaatttttaacgttaccgtgtaaccgttacgacggtacgtacgtacgaccttaacggttcgcccttaacgtcgttaccggttcgggaccggtacgtacgagggtcggaatacgtaacgaacggtgtcggtaggcttacgaccgtactacgtcgttcgttacc

SEQ ID NO: 73820 - DNA, 764 bp, Homo sapiens
  misc_feature: GYAE6OF01CF8NR.49.46.E02.1.454.CMB.1.raw
  modified_base (149)..(149): a, c, t, g, unknown or other
  misc_feature (149)..(149): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccgacgganaattgtgttgacacagtctccgccacctgtctttgctccgagggacagtcgcccacctctccgtgcgacggccagtcagtagttgttaagtacgtctttcgtacgccttagggtaaccaaactacggaaaccgtggacccgaggtccctacccgagggtcccttaccctactacttactagtagtacgtacgtacctaacgtacccgaaacggtaccgggccctacggtacggacccttaaccgccccgtacgggtacccgttaggttccgaagggtttccggaccggttaggggttcggtaccgttaggtacggtaacgtaaccgttacctttaccgaacccgtttccctaaccgtacctacggtaccgaaccgggtaccgtaaccgggtaccgtaacggggtacccttaccgggttaaagtaaaccggtttcgttaccggtaacgttacgttttaacggttttactacggttcgtaaccgtacgtagtaaccggtcgttaccgtaccgtacgtccgtacctacggtcgttacggtcggacggtacggtacgaggtacgagtacgtaacggaacgtagtcggcgtacgtacgcccgttagtctcgttcgtaccg

SEQ ID NO: 73821 - DNA, 779 bp, Homo sapiens
  misc_feature: GYAE6OF01CHYPC.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagatacccgaccggagtaaattgtgttgacacagtcctccggccaccctgtctttgtcctccgaggggactagtcgcccaccctctcctggcgagggccagtcaggagttagttagtacgtcttcgttacgcccgtaggtaccaaacgacggtaaacctcgggaccacggccctaccccggaggtccctcctactacttctagtcgtatcgaccaacttaccccgaaacggacgggaccccacgttcgggacctaaccgtcccccgaacggtacccgtaagggtttaccgaggttacggggtccgtaaggggttcggggttacgtcggtacggaaccgtagttaaccctttccgaccgtttaccctaacctaacccgtgttacccgagacccgtaacggtacccggtaacgggcgtacccgttaacggtaacgttaactttaccggtacgttaccgttaacgtttttaacgtaccgtttaggtacctacggccgtaaacggttcggaacgtacctaccggttccgggtaccctttcgtaccggttaccgggtacggacgggtaacggtacggagggtacgtacgaccggtaacgtaacggtaacgttggaacgtccgacgtacccactacgttgtcttaccg

SEQ ID NO: 73822 - DNA, 498 bp, Homo sapiens
  misc_feature: GYAE6OF02JAJ0X.49.46.E02.1.454.CMB.1.raw
  modified_base (400)..(400): a, c, t, g, unknown or other
  misc_feature (400)..(400): n is a, c, g, or t
  modified_base (490)..(490): a, c, t, g, unknown or other
  misc_feature (490)..(490): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctggtgacagacttcactctcaccatcagcagcctagacgcctgaagattcngctagtttattactgtcagcagcgtagcaactggcctctctacttcggcgagggaccagggtggagatacaaacgactgtggctgcaccntcgtgttc

SEQ ID NO: 73823 - DNA, 502 bp, Homo sapiens
  misc_feature: GYAE6OF02G953T.49.46.E02.1.454.CMB.1.raw
  modified_base (369)..(369): a, c, t, g, unknown or other
  misc_feature (369)..(369): n is a, c, g, or t
  modified_base (394)..(394): a, c, t, g, unknown or other
  misc_feature (394)..(394): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttaggagcaacttagcctggtatcagcagaaacctggccaggctcccaggctcctcatctatggtgcatccaccagggccactggtatcccagccaggttcagtggcagtgggtctggggacagagttcactctnaccatcagcagcctgcagtctgaanatttgctagtttattactgtcagcagtataatgtccggctccggactacgtttcggcggaggaccgaaggtggagatcgaaagactgtggctgcacatctgtctctac

SEQ ID NO: 73824 - DNA, 504 bp, Homo sapiens
  misc_feature: GYAE6OF02HYE19.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagacgcctagaagtattctgctagtttattactgtcagcagcgtagcaacgtgcctctctacgttcggcggagggaccagggtggagatacgaaacgacgtgtggctgaccaccatctgttc

SEQ ID NO: 73825 - DNA, 506 bp, Homo sapiens
  misc_feature: GYAE6OF02GZTI0.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctagaagtattcgtgctagtttattactgtcagcagcgtagacaactcggccttctctacgtttcggacggacgggaccaagggtggaagatacaaacgactgtgctgcacatctgtcc

SEQ ID NO: 73826 - DNA, 511 bp, Homo sapiens
  misc_feature: GYAE6OF02F7HFC.49.46.E02.1.454.CMB.1.raw
tcagagtcgagagacacgaccggtgctcgatttagactcatctacagggaaaggggaggaactgctcagttaggaccccagagggaaccatggaagccccagctcagcttctcttcctcctgctactctggctcccagataccaccggagaaattgtgttgactacagtctccggccaccctgtctttgtctccaggggacagtgccaccctctcctgcgagggccagtcagagtgttagtagcttcttagcctggtaccaacagaaacctggccaggcctcccaggcctcctcatctatgatgcatccaaacagggccactggcatcccagccaggttcagtggcagtggtctgtgacagacttcactctcaccatcagcagcctagacgcctagaagtattctgactaagtttattactcgtcagcagcgtagcaactgcctctctacgttcggcggtaggaccgaggtggagaatacgaaacgaacgtagtagctgacaccatctgtc

SEQ ID NO: 73827 - DNA, 509 bp, Homo sapiens
  misc_feature: GYAE6OF02HYBDH.49.46.E02.1.454.CMB.1.raw
  modified_base (261)..(261): a, c, t, g, unknown or other
  misc_feature (261)..(261): n is a, c, g, or t
  modified_base (306)..(306): a, c, t, g, unknown or other
  misc_feature (306)..(306): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaacctggccaggctccaggctcctcatctatgatgcatccaanagggccactggcatccagccaggttcagtgcagtggtctgtgacagacttcacttctcaccatcagcagctagagcctgaagattctgtctagtttatttactgtcagtcagcgtagacaacgtcgtcctctctacgtttcggcggtaggaccgaagggtcggaagacgtacgaacgaactgtggtctcgccacatctgttac

SEQ ID NO: 73828 - DNA, 526 bp, Homo sapiens
  misc_feature: GYAE6OF02HREDK.49.46.E02.1.454.CMB.1.raw
  modified_base (291)..(291): a, c, t, g, unknown or other
  misc_feature (291)..(291): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctnatctatgatgcatccaaacgagggccactggcactcccagccaggttcagtggcagtgggtctgtgacagacttcactctcaccatccagcacgcctagacgcctagaagtattctgctagtttattactgtcagctagcgtagactaactggcctctctacgtttcggcggaaggaccagggtggagactaccgaaacgtaacgtggtacggctcgacctaccgtatcgtagtc

SEQ ID NO: 73829 - DNA, 497 bp, Homo sapiens
  misc_feature: GYAE6OF02GMPMG.49.46.E02.1.454.CMB.1.raw
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggctcccaggctcctcatctatgatgcatccaacnggccactggcatcccagccaggttcagtgcagtgggtctgtgacagacttcactctcaccatcagcagcctagagcctgaagtattctgctagtttattactgtcagcagcgtagcaactcgcctctctactttcggcggagggaccaggtggagactacaaacgactgtgctgccaccatctgttc

SEQ ID NO: 73830 - DNA, 508 bp, Homo sapiens
  misc_feature: GYAE6OF02IHB5Y.49.46.E02.1.454.CMB.1.raw
  modified_base (439)..(439): a, c, t, g, unknown or other
  misc_feature (439)..(439): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatcaacagggccactggcatcccagccaggtcagtggcagtggtctgtgacagacttcactctcaccatcagcagcctaagacgcctagaagattctgctagtttattacttgtcagcagcgtagcaacgtgccttcnctactttcggcgagggaccgtaggtggagtataccgaaacgacgtgtacggctaggacaccatctgtcc

SEQ ID NO: 73831 - DNA, 547 bp, Homo sapiens
  misc_feature: GYAE6OF02I3656.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccatggcatcccagccaggttcagtggcagtgggtctgtgacagacttcactctcaccatcagcagcctagcgcctgaagtattctgctagtttattactgtcagcagcgtagcaacgtggcctcgtcctacgtttccggcgggaacgggacccgtaagggtggaacgtaacgtaccgaaaaccggtacgttggtacggccgttacgacccgtacctaacgttcgttacgttacc

SEQ ID NO: 73832 - DNA, 560 bp, Homo sapiens
  misc_feature: GYAE6OF02JD7OY.49.46.E02.1.454.CMB.1.raw
  modified_base (384)..(384): a, c, t, g, unknown or other
  misc_feature (384)..(384): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtgggtctgtgacagacttcactctcaccatcagcagcctagngcctgaagattctgctagtttattcttgtcagcagcgtagctaacgtcggcccttcttcctaacgtttccgggacggtacgggacccgtagggtcgggaacgtaacgttaccgaaaacggtaaccgttggttacggccgttacggaccgaaccctaagttccgttacggtttaccc

SEQ ID NO: 73833 - DNA, 512 bp, Homo sapiens
  misc_feature: GYAE6OF02ID0HL.49.46.E02.1.454.CMB.1.raw
  modified_base (232)..(232): a, c, t, g, unknown or other
  misc_feature (232)..(232): n is a, c, g, or t
  modified_base (356)..(356): a, c, t, g, unknown or other
  misc_feature (356)..(356): n is a, c, g, or t
tcagagtcgagagacacgaccggtgctcgatttagactcatctacagggaaagggggacggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagngtgttagtagcttcttagcctggtaccaacagaaacctggccaggctcccaggctcctcatctatgatgcatccaacagggccactggcatcccagccaggttcagtggcagtggtctgtgacngacttcactctacaccatcagcacgcctagagcctgaagattctgtcagtttattactgtcagcagcgtacgcactggtcctcgtctacgtttcggcgacgggaccaggtggagtactacaaacgtactgtacggctcgccaccatccgtgttacc

SEQ ID NO: 73834 - DNA, 495 bp, Homo sapiens
  misc_feature: GYAE6OF02H9IZJ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtggtctgtgacagacttcactctcaccatcagcagctagagcctgaagattctgctagtttattactgtcagcagcgtagcaactgcctctctacttcggcgaggaccaggtggagatacaaacgaactgtaggctggaccacactctgtcc

SEQ ID NO: 73835 - DNA, 524 bp, Homo sapiens
  misc_feature: GYAE6OF02G19KL.49.46.E02.1.454.CMB.1.raw
  modified_base (213)..(213): a, c, t, g, unknown or other
  misc_feature (213)..(213): n is a, c, g, or t
  modified_base (290)..(290): a, c, t, g, unknown or other
  misc_feature (290)..(290): n is a, c, g, or t
  modified_base (360)..(360): a, c, t, g, unknown or other
  misc_feature (360)..(360): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctntcctgcagggccagtcagagtgttagagcttcttagcctggtaccaacagaaacctggccaggctcccaggctcctnatctatgatgcatccaacgagggccacgtggcaatcccagcctaggttcagtggcagtggctgggacagngttcactctcaccatcagcacgcctgcagtctagaagtagtttgctagtttattacgttgtctagctagtattaattactggtcgttcgttttggccgtagggacctaagcgtagagtatacgagacgtaacgtcggtgcgtgcacgtactctcgttcttctac

SEQ ID NO: 73836 - DNA, 563 bp, Homo sapiens
  misc_feature: GYAE6OF02IS1GX.49.46.E02.1.454.CMB.1.raw
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (396)..(396): a, c, t, g, unknown or other
  misc_feature (396)..(396): n is a, c, g, or t
  modified_base (424)..(424): a, c, t, g, unknown or other
  misc_feature (424)..(424): n is a, c, g, or t
tcagagtcgagagacacgaccggtgctcgatttagactcatctacagggaaaggggaggaacgtgctcagttaggaccagaggaaccatggaagcccagctcagcttctcttcctcctgctactctggctccagataccaccggagaaattgtgttgacacagtctccggccaccctgtctttgtcctccaggggacagtgcccaccctctcctgcagggccagtcagcgtgttagagcttcttagcctggtaccaacagaaactgaccaggctcccgagctccgtcactctatgtatgcatccgaacacggccaactcggcatcccagccacgttcacggtgcaggtggtctgtagacagacttcactctcacatcancacncagcgctgaacgnttctagctacgttattacgtactctacnctacgcgttacgaccgtacgtacgtccgtcttacctaccgttcggcggtaacggtccgaacgggtggtaaccggaagttaccgaacggtaaacctgggttacgcgttacggaccttaaccgacgttaccgttgttaccg

SEQ ID NO: 73837 - DNA, 505 bp, Homo sapiens
  misc_feature: GYAE6OF02GM9R8.49.46.E02.1.454.CMB.1.raw
  modified_base (357)..(357): a, c, t, g, unknown or other
  misc_feature (357)..(357): n is a, c, g, or t
  modified_base (498)..(498): a, c, t, g, unknown or other
  misc_feature (498)..(498): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacacgggccactggcatcccagccaggttcagtggcagtgggtctgtgacngacttcactctcaccatcagcagcctagagcctgaagattctgctagtttacttactgtcagcagcgtagcaactcgccttctctacgtttcggcgacgggaccgagggtgagatacgaaacgtactgtcgctcgcacctntctgtcc

SEQ ID NO: 73838 - DNA, 641 bp, Homo sapiens
  misc_feature: GYAE6OF02FWAWJ.49.46.E02.1.454.CMB.1.raw
tcagagtcgagagacacgaccggtgctcgatttagactcatctacagggaaagggggaggaactgctcagttagggacccacgagggaacccagtggtaagccccgagtctctagcttctcttcctcctgctactctggactcccacgataccgaccggtaggaaattgtgttgactactagtcgtccggtcctaaccctgtccttgtctccgaggggacagtgccacccgtcgtcctgcggagggcctaggtcagacgtgggttacgtagcttcttagcctggtaccaacagaaaccctggccaggtcctcccaggtctctcactctatgatcgcagtccaacgacgggccactggcagtcccagccgtaggttcaggtcggctaggtgggtctggtacgacgagtacttacgaccttctaccaacgtactactacgtacacgtcctaagacgtacctagaacgattcgtagtacttagtttactcgttgtcagtcaaggtacgtagaccgtaaacgtcgggcccttacgtccgtaaccggtttccgggacggtaacgggtacctaagggtcggaagtaggtaaccgaaacggtaacgttggtacggtctcggaccgaacccgtacttccgtgttacccg

SEQ ID NO: 73839 - DNA, 717 bp, Homo sapiens
  misc_feature: GYAE6OF02IXE8V.49.46.E02.1.454.CMB.1.raw
  modified_base (299)..(299): a, c, t, g, unknown or other
  misc_feature (299)..(299): n is a, c, g, or t
tcagagtcgagagacacgaccggtgctcgatttagactcatctacagggaaaggggaagggaacgtgctcagttaggacccagagggaaccagtggaagccccagctcagcttctcttcctcctgctactctggcctcccagataccaccggagaaattgtgttgacacagtctccggccaccctgtctttgctccagggacagtgccaccctctcctgcagggccagtcagagtgttagagcttcttagcctggtaaccaacagaaaacctggtcacggcttacccgaggcctccctnaactcttaatgactgctaactccccaaatacgggcctaccgtggacctaactcccccaaggccctaaggggttccaaggtcgggacctaggttcggggtctggttgaaccgagtacctttccacgttcctccgaaccctatacgaacgcgtacgaccgtaacggtacgaccgttagaaacgtacgtttacgacggtaccttaagtttacgtttaaccttcggttaacacgtcgtaagacgttacgtacgtaaaccgtccggtacccttaccgttacttaccggttttaccggaccgggtaacgggtaaccccgtaaggggttaccgggtaactaacggttaacccgtaaaacggtaaacgttcggttaacggtccgttacggacccgttaaccgtaccgttacgtttacggttacccg

SEQ ID NO: 73840 - DNA, 502 bp, Homo sapiens
  misc_feature: GYAE6OF02G15N2.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtggtctgtgacagacttcactctcaccatcagcacgcctagacgcctgaagtattctgctagtttattactgtcagcagcgtagcaactgcctctcacgtttcggacgagggaccaggtggagatacaacgaactggtggctgaccaccgattctgtcc

SEQ ID NO: 73841 - DNA, 494 bp, Homo sapiens
  misc_feature: GYAE6OF02F1AA2.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagcaactggcctctcactttcggcgagggaccaggtggagatacaaacgaactgtggctgcaccatctgtc

SEQ ID NO: 73842 - DNA, 497 bp, Homo sapiens
  misc_feature: GYAE6OF02HFD2G.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagcttcactctcaccatcagcagcctagagcctgaagattctgctagtttattactgtcagcagcgtagcaactgcctctcacgttcggcggagggaccagggtggagatacgaaacgaacgtgtggctgccaccatctgtc

SEQ ID NO: 73843 - DNA, 492 bp, Homo sapiens
  misc_feature: GYAE6OF02HW5F7.49.46.E02.1.454.CMB.1.raw
  modified_base (307)..(307): a, c, t, g, unknown or other
  misc_feature (307)..(307): n is a, c, g, or t
  modified_base (349)..(349): a, c, t, g, unknown or other
  misc_feature (349)..(349): n is a, c, g, or t
  modified_base (394)..(394): a, c, t, g, unknown or other
  misc_feature (394)..(394): n is a, c, g, or t
  modified_base (476)..(476): a, c, t, g, unknown or other
  misc_feature (476)..(476): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaanagggccactggcatcccagccaggttcagtgcagtggtctgnacagacttcactctcaccatcagcagcctagagcctgaagattcngtctagtttattactgtcagcagcgtagacaactggcctctctacttcggcggagggaccaggtggagatacaacgaactgnggctggcacatctgtc

SEQ ID NO: 73844 - DNA, 506 bp, Homo sapiens
  misc_feature: GYAE6OF02JA74X.49.46.E02.1.454.CMB.1.raw
  modified_base (498)..(498): a, c, t, g, unknown or other
  misc_feature (498)..(498): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagtattctgctagtttatactgtcagcagcgtagcaactggacctctactactttcggcgagggaccagggtggacgagtacaaacgacttgtacggcttgccaccntctgttcc

SEQ ID NO: 73845 - DNA, 504 bp, Homo sapiens
  misc_feature: GYAE6OF02HODHQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtggtctgtgacagacttcactctcaccatcagcagcctagacgcctgaagtattctgtctagtttattactgtcagcagtcgtagcaacgtgcctctcactttcggcggtacggaccgaggtggagactacgaaacgactgtaggctcgccacctatctgtc

SEQ ID NO: 73846 - DNA, 649 bp, Homo sapiens
  misc_feature: GYAE6OF02FIXSX.49.46.E02.1.454.CMB.1.raw
  modified_base (313)..(313): a, c, t, g, unknown or other
  misc_feature (313)..(313): n is a, c, g, or t
  modified_base (634)..(634): a, c, t, g, unknown or other
  misc_feature (634)..(634): n is a, c, g, or t
tcagagtcgagagacacgaccggtgctcgatttagactcatctacagggaaaggggaggaactgctcagttaggacccagagggaaccatggaagccccagctcagcttctcttcctcctgctactctggctcccagataccaccggagaaattgtgttgacacagtctcccggccaccctgtcttgtcctccgagggtaccagtcgcccacccctctcctgcagggcccagtcagagtgttagtagcttcttagccctggtacccaacagaaaccctggcccaggcctcccaggtcctccctcactcctatnatgcatccaacgacggccactggccactccccagccctaggttcaggtgcgtaggtcgggtctggtagacctacggtaccttccaccttcaccgacccatccgagccacggccttaaggacgtaccctaggaaacgttcttaccgtgtaccgttaagttttaactaccgtgttaccagtccgtaaggtccgttaacgaccctaaccgttccggtacccttacgttaccgtaaccgtttaccggggaccggtaacgggaaccgtagggttacgacgtaaccgtaccgaaaaccgtacgtcggtacggtcctcggacctaccncgttctcgttacccg

SEQ ID NO: 73847 - DNA, 503 bp, Homo sapiens
  misc_feature: GYAE6OF02IIFIJ.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtggcagtgggtctgtgacagacttcactctcaccatcagcagcctagagcctgaagattctgctagtttattactgtcagtcagcgtagacaactggcctctcaccgtttcggcggagggaccagggtggagagtacaaacgaacgtgtggctgcaccatcgtgtc

SEQ ID NO: 73848 - DNA, 574 bp, Homo sapiens
  misc_feature: GYAE6OF02GN0ZQ.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtgcagtgggtctgtgacagacttcactctcaccatcagcacgcctagacgcctagaacgtattctgtactaagttttacttacttgttacagccaggtcgttacgacctaacgtcggtacccttcttaccgtaccgtttcgggaccgggtacggggaaccctaggggtacggaacgtaacgtaccgaaaacggtacgttggtacggacgtcgaccctaacctagttccgtgtttacc

SEQ ID NO: 73849 - DNA, 516 bp, Homo sapiens
  misc_feature: GYAE6OF02IU1AY.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcacgccctagacgcctagaagtattctgctagttttattacttgtcagcagcgtagcaacgtcggcctctctactttccggacggagggaccgtaggtggagatacaaacgaactggtaggcgtacgcaccactctgtcc

SEQ ID NO: 73850 - DNA, 510 bp, Homo sapiens
  misc_feature: GYAE6OF02HM6R9.49.46.E02.1.454.CMB.1.raw
  modified_base (383)..(383): a, c, t, g, unknown or other
  misc_feature (383)..(383): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacaggccactggcatcccagccaggttcagtggcagtggtctgtgacagacttcactctcaccatcagcagcctagngcctgaagtattctgctagtttattactgtcagcagcgtagcaactcggcctctctacgttcggcggaggaccagggtggagataccgaaacgacgtggtaggctggaccaccgtattccgtgttcc

SEQ ID NO: 73851 - DNA, 558 bp, Homo sapiens
  misc_feature: GYAE6OF02HC2HJ.49.46.E02.1.454.CMB.1.raw
  modified_base (261)..(261): a, c, t, g, unknown or other
  misc_feature (261)..(261): n is a, c, g, or t
  modified_base (289)..(289): a, c, t, g, unknown or other
  misc_feature (289)..(289): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaaacctggccaggctccaggctcctnatctatgatgcatccaacagggccactggcactcccagccaggttcagtggcaggtggtctgtgacagacttcactctcaccatcagcagcctagcgctgaagnttcngctagtttattactgtacagcaggcgtaagctaacgtggcccttctacgtaccgtttcggaccgggtaacgggtaccaaggggtggaacgaacgttaccgaaaaacggtaaccttgggtacggacgttacggacccaaccgtacgttcgttacgttacccg

SEQ ID NO: 73852 - DNA, 491 bp, Homo sapiens
  misc_feature: GYAE6OF02FX04Z.49.46.E02.1.454.CMB.1.raw
  modified_base (307)..(307): a, c, t, g, unknown or other
  misc_feature (307)..(307): n is a, c, g, or t
  modified_base (382)..(382): a, c, t, g, unknown or other
  misc_feature (382)..(382): n is a, c, g, or t
  modified_base (485)..(485): a, c, t, g, unknown or other
  misc_feature (485)..(485): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaanaggccactggcatccagccagttcagtggcagtgggtctgtgacagacttcactctcaccatcagcagcctagancctgaagacttctgctagtttatactgtcagcagcgtagacacgtgcctctctacgtttcggcgacgggaccaggtgagactacaacgactgtgctcgcaccntctgtc

SEQ ID NO: 73853 - DNA, 503 bp, Homo sapiens
  misc_feature: GYAE6OF02F9UZ8.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatccccagccaggttcagtggcagtgggtctgtgacagacttcactctcaccatcagcagcctagagcctgaagattctgctagtttattactgtcagcagcgtagcacgtggcctctctactttcggcggacgggaccagggtcggagatacgaaacgactgtggctgccaccatcgtgtcc

SEQ ID NO: 73854 - DNA, 543 bp, Homo sapiens
  misc_feature: GYAE6OF02HUALI.49.46.E02.1.454.CMB.1.raw
  modified_base (261)..(261): a, c, t, g, unknown or other
  misc_feature (261)..(261): n is a, c, g, or t
  modified_base (384)..(384): a, c, t, g, unknown or other
  misc_feature (384)..(384): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaaacctggccaggctcccaggctcctcatctatgatgcatccaacagggccactggcatcccagccaggttcagtggcagtgggtctgtgacagactcactctcaccatcagcagcctagngcctgaagattctgctagtttacttactgttcagcagcgtagcaatcggcctctctacgtttcggacggtacgggaccgtaagggtcggaaggtaagtaccgaaaacggtaacgttaggtacggacttacgggacctaacccgattaccgtgttacccg

SEQ ID NO: 73855 - DNA, 615 bp, Homo sapiens
  misc_feature: GYAE6OF02H5IHN.49.46.E02.1.454.CMB.1.raw
  modified_base (467)..(467): a, c, t, g, unknown or other
  misc_feature (467)..(467): n is a, c, g, or t
tcagagtcgagagacacgaccggtgctcgatttagactcatctacagggaaaggggggaggaactggctccagttacggaccgagtagggaacgattggaagtcccgagctcagcttctactctcctgactactctggctcctaggataccaccggagtaaagttgttgttgacgactagttacgtccggccacctgtcttggtctccaggggacaggtgccgaccgtctcggtggctagggccaggtccggacgaggtgttagtacgtccttcgttaggacctcggtaccaacgacgtaaacctcggtaccacggactcccgaggcctacctcgactcgtactcgagtcgcagtaccgacgaggccagtcgctatccagtccgtaggtcagtggacagtggtctgcgacagccttcgaactcgtacacctatccagcacgacctaagacgactagaacgattccgngtacttagttacttacgtgtacagcacgtagtacgactacgtcggacctcgtacacgtttacggcgtaacggtacgtacgggtgtaacgtcttaacgaaacgtacgttacgtacggcctacggcctaaccgtcgttaccgcgttaccg

SEQ ID NO: 73856 - DNA, 582 bp, Homo sapiens
  misc_feature: GYAE6OF02HFJ15.49.46.E02.1.454.CMB.1.raw
tcagagtcgagagacacgaccggtgctcgatttagactcatctacagggaaagggggagggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagtacttcactctcaccatcagcagcctagacgccctagaagtattctgtaccttaaggttttacttacctgttacagtcaggtcgtagacctaacgtcgggacccttctaccgtacggttttcgggaccgggtacgggaaccgagggttacggaagtacgtaccgaaacggtacgttacggtcggaccgttacggacctaacccgtagttcccgtagtttacccg

SEQ ID NO: 73857 - DNA, 509 bp, Homo sapiens
  misc_feature: GYAE6OF02I9WNG.49.46.E02.1.454.CMB.1.raw
  modified_base (401)..(401): a, c, t, g, unknown or other
  misc_feature (401)..(401): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcatccaacagggccactggcatcccagccaggttcagtggcagtgggtctgtgacagacttcactctcaccatcagcagcctagacgcctgaagtattcngctagtttattactgtcagtcagtcgtagctaacgtgtcctctctacgttcggcggaggaccaggtggagtactacgaaagtactgtaggctcgacaccatctgtacc

SEQ ID NO: 73858 - DNA, 515 bp, Homo sapiens
  misc_feature: GYAE6OF02HRZR7.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggctccaggctctcatctatgatgcatccaaacngggccactggcatcccagccaggttcagtggcagtgggtctgtgacagacttcactctcaccatcagcagcctagagcctagaagtattctgtctagtttaattacgttgtcagtcagcgtagacaacgtcgcctctctacgttcggcggacggaccgagggtggagatacgaaacgaactgtcggacgtcgcactactctgttac

SEQ ID NO: 73859 - DNA, 528 bp, Homo sapiens
  misc_feature: GYAE6OF02GEIER.49.46.E02.1.454.CMB.1.raw
  modified_base (385)..(385): a, c, t, g, unknown or other
  misc_feature (385)..(385): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatcccaacgcgggccactggcatccccagccaggttcagtgcaggtggtctgtgacagacttcactctcacatcagcagctagngcctagaatattctgctagtttattactgtcagtcagcgtagctaacgtcgtcctctccgtacgtttcggcggtacggaccgtagggtggagacgtacgaaacgtacgttggtcgcgttcgacctaccgtattccgtgttacc

SEQ ID NO: 73860 - DNA, 531 bp, Homo sapiens
  misc_feature: GYAE6OF02H6RND.49.46.E02.1.454.CMB.1.raw
  modified_base (260)..(260): a, c, t, g, unknown or other
  misc_feature (260)..(260): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggcagtgccaccctctcctgcagggccagtcagagtgttagtagcttcttagcctggtaccaanagaaacctggccaggctcccaggctcctcatctatgatgcatccaacagggccactggcatcccagccaggttcagtggcaggtgggtctgtgacagacttcactctacaccatccagcagcctagagcctgaagtattctgctagtttattactagacagcagcgtagaccaacgtcggccttctctacgtttcggcggacgggaccgaggtaggagtataacgaaacgaacgttagtacggcgtcgacctacccgtaactcgtacttcc

SEQ ID NO: 73861 - DNA, 520 bp, Homo sapiens
  misc_feature: GYAE6OF02IINQO.49.46.E02.1.454.CMB.1.raw
  modified_base (403)..(403): a, c, t, g, unknown or other
  misc_feature (403)..(403): n is a, c, g, or t
  modified_base (506)..(506): a, c, t, g, unknown or other
  misc_feature (506)..(506): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatccccagccaggttcagtggcaggtgggtctgtgacagacttcactctccaccatcagcagcctagacgcctagaagtattcngctagtttattacttgtcagcagcgtagacaactggccttctcctacgtttcggcggagggaccagggtggagagtacaaacgacgtgtggctggaccaccgnttacctggttaccc

SEQ ID NO: 73862 - DNA, 520 bp, Homo sapiens
  misc_feature: GYAE6OF02IRLFP.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacaggggccactggcatcccagccaggttcagtggcagtgggtctgtgacagacttcactctcaccatcagcacgcctagacgtcctgaagattctgctagtttatttactgtcagcagcgtagcaactcgccttctcctacgtttcggacggacggaccgaggtggagaattaccaaacgtaacgtgtcggctgaccaccgattccgtgttcc

SEQ ID NO: 73863 - DNA, 508 bp, Homo sapiens
  misc_feature: GYAE6OF02G5GZ9.49.46.E02.1.454.CMB.1.raw
  modified_base (315)..(315): a, c, t, g, unknown or other
  misc_feature (315)..(315): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatcccgcagggccnctgacatcccagccaggttcagtggcaggtgggtttgggacaggacttcacgctcaccatcagcagcctagagcctagaagtattttgctagtttattactgttacaacagcgtaccacagattcactttcgcctgggaccagagtgatatcaacgactgtggctgcacatctgtccttcacttcctcccgac

SEQ ID NO: 73864 - DNA, 539 bp, Homo sapiens
  misc_feature: GYAE6OF02IRSYI.49.46.E02.1.454.CMB.1.raw
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (413)..(413): a, c, t, g, unknown or other
  misc_feature (413)..(413): n is a, c, g, or t
tcagagtcgagagacacgaccggtgctcgatttagactcatctacagggaaagggggaggaactgctcagttaggacccagagggaaccatggaagcccagctcagcttctcttcctcctgctactctggctccagataccaccggagaaattgtgttgacacagtctccggccaccctgtctttgctccagggacagtgccacctctcctgcagggccagtcagagtgttagtagcttcttagcctggtaccaacagaaacctggccaggctccaggcctcctnatctatgatgcatccaaacngggccacgtggcatcccagccgaaggttcagtcggcaggttcgggtctggtgacagaccttcgaactctcacctatccgaagcagcctagacgcctagaagtacttcngactagtttattactgtcagcagctagcaacgtgcctctcgtacgttggacggaggaccagggtggaacgtaacgtacgaaacggtacttacggtggacctacggcctaaccgagttcgtgttacc

SEQ ID NO: 73865 - DNA, 502 bp, Homo sapiens
  misc_feature: GYAE6OF02FS2LX.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtggtctgtgacagacttcactctcacatcagcagcctagagtcctgaagattctgctagtttattacttgtcagcagcgtagcaactggcctctctactttcggacggtagggaccaggtggagatcgaaacgactgtaggctagccaccatcctgtacc

SEQ ID NO: 73866 - DNA, 528 bp, Homo sapiens
  misc_feature: GYAE6OF02HHXD0.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagccttggtaccaacagaaacctggccaggctcccgaggctcctcatctatgatgcatccaacagggccacgtggcatcccagccaggttcagtgcagtgggtctgtgacaggacttcactctcaccatcagcagcctagacgccgtagaagtattcgtgctagtttacttactgtacagcagcgtagacaactgtcctctcacgtttcggcggacggacgaggtcggacgataccgaaacgtacgtaggtcggacgtcggaccaccgacttcctgttacc

SEQ ID NO: 73867 - DNA, 587 bp, Homo sapiens
  misc_feature: GYAE6OF02FZCFC.49.46.E02.1.454.CMB.1.raw
  modified_base (440)..(440): a, c, t, g, unknown or other
  misc_feature (440)..(440): n is a, c, g, or t
tcagagtcgagagacacgaccggtgctcgatttagactcatctacagggaaagggggagggaacgtcgcgtcgagttaggacccagaggggaaccatggaagccccaggcctcgagccttctcttcctccctgctactctggctcccagagtaccaccggagaaattcgtcgttgacacagtctccggccaccctgtcctttggtctccaggggacacgtgccgaccctctccgtgcgagggccacgtcagagtgttagtagcttcttagcctggtaaccaacagaaacctggccaggcctccaggctccgtcagtctagtcgatgcgatcctaacgacgggcctacgtgggcactcccgaggccctaggttcaggtggcaggtgggtctgtgacagactcactctcacctatcagcagctagacgcctagaagactcgngctagtttactactgtcagcagacgtagactaacgtcggtcctcgtacgtacgtttcggacgggtacgggtaccgagggtacggacgtacgtaccgaaacggtacgtcggtacggcctacggacccgacgtacgttccgtcgttccg

SEQ ID NO: 73868 - DNA, 494 bp, Homo sapiens
  misc_feature: GYAE6OF02FY6O6.49.46.E02.1.454.CMB.1.raw
  modified_base (309)..(309): a, c, t, g, unknown or other
  misc_feature (309)..(309): n is a, c, g, or t
  modified_base (439)..(439): a, c, t, g, unknown or other
  misc_feature (439)..(439): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtgcagtgggtctgtgacagacttcactctcaccatcagcagctagagcctgaagattctgctagtttattacttgtcagcagcgtagcaacgtggcctctcnctttcggcggagggaccaggtggagatcaaacgaactgtggctgcaccatctgtc

SEQ ID NO: 73869 - DNA, 510 bp, Homo sapiens
  misc_feature: GYAE6OF02FUE9Z.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtggtctgtgacagacttcactctcaccatcagcagcctagagcctgaagattctgctagtttattactgtcagcagcgtagcaacgtcgcctctctacgtttcggcggagggaccgagggtcggagtaacgtacaaacgactggtaggctcgaccaccatctgttcc

SEQ ID NO: 73870 - DNA, 506 bp, Homo sapiens
  misc_feature: GYAE6OF02IQ2YQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtgggtctgtgacagacttcactctcaccatcagcagcctagacgcctagaagattctgctagtttattactgtcagcagcgtagcaactgcctctctcttcggcgagggaccaggtgagactacgaaacgtactggtaggctcggaccaccgtactcgtgttcc

SEQ ID NO: 73871 - DNA, 534 bp, Homo sapiens
  misc_feature: GYAE6OF02I96EC.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacagggccactggcatcccagccaggttcagtgcaggtgggtctgtgacagacttcactctcaccatcagcagcctagagcctagaagtattctgctagtttattactgtcagtcagcgtagcaacgtcgcctctctaccgtttcggcggtacgggaccgtagggtggaacgtacgtaaccgaaacggtaacgtggttaggacctggaccaaccgtacttcgtgttacc

SEQ ID NO: 73872 - DNA, 540 bp, Homo sapiens
  misc_feature: GYAE6OF02I0JB1.49.46.E02.1.454.CMB.1.raw
  modified_base (380)..(380): a, c, t, g, unknown or other
  misc_feature (380)..(380): n is a, c, g, or t
  modified_base (535)..(535): a, c, t, g, unknown or other
  misc_feature (535)..(535): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcactcccagccaggttcaggtggcaggtgggtctgtgacagtacttcactctcaccatcancagcctagacgcctagaagtacttctagcttagttttacttactgttacaggcagtcgtagctaacgtcggtcctctctacgtttcgggacggagggacctagggtggagacgtaacgaaacgtaacgtggtaggctacggacctacgacttcgngttcc

SEQ ID NO: 73873 - DNA, 553 bp, Homo sapiens
  misc_feature: GYAE6OF02F9VCG.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacgcgggccacgtggtactcccgagcctaggttcaggtggctaggtggtctgggacagtagttcactctcacatcagcagctgcagtctagagtatttcgactagttattactgtacagtactagtataacgttacgtgtcgttacgttttcggaccgtacgggtacctaagtcgtaggacgtagtacgaacgtacggtaacgtggtacggtcgtcgacgtactacgtcctagtcttctacttacccg

SEQ ID NO: 73874 - DNA, 495 bp, Homo sapiens
  misc_feature: GYAE6OF02JIPXB.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagcaactgcctctctacgtttcggcggaggaccaggtggagatacaaacgactgtggctcgcaccatctgtc

SEQ ID NO: 73875 - DNA, 520 bp, Homo sapiens
  misc_feature: GYAE6OF02GMBK9.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcaggtggtctgtgacagacttcactctcaccatcagcagcctagacgcctagaagtattcgtgactagtttatacttgtacagcagcgtagcaactcggcctctctacgtttcggacggacgggaccagggtggagtactacgaaacggacgtgtggactcggaccacctatcgtgttcc

SEQ ID NO: 73876 - DNA, 501 bp, Homo sapiens
  misc_feature: GYAE6OF02IYSSX.49.46.E02.1.454.CMB.1.raw
  modified_base (466)..(466): a, c, t, g, unknown or other
  misc_feature (466)..(466): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagctttcttagcctggtaccaacagaaacctggccaggctccccaggctcctcatctatgatgcatccaacagggccactggcatcccagccaggtcagtggcagtgggtctgtgacagtacttcactctcaccatcagcagcctagagcctgaagtattctcgctagtttatactgtcagcagcgtagccaacgtgctctctacgttcgcggagaccgaggtgagntacgaaacgactgacgctcgacaccatcgtgtacc

SEQ ID NO: 73877 - DNA, 550 bp, Homo sapiens
  misc_feature: GYAE6OF02GMP5Q.49.46.E02.1.454.CMB.1.raw
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctnatctatgatgcatccaacgnggccactggcatcccagccaggttcagtgcagtgggtctgtgacagacttcactctcacatcagcagcctagacgcctgaacgtattcgacgtctagtttatacgttgtactagctaggcgttagactacgtggtcctctacctacgtttcggacgggtacgggaaccgtagggtcggaagtactaacgtaaacgtacgttaggtacggacgtacggaccgaccgtactcgttgttacccg

SEQ ID NO: 73878 - DNA, 537 bp, Homo sapiens
  misc_feature: GYAE6OF02F6BVO.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgtatccaacgagggcccacgtggcatccccagccaggttcagtgcagtggtctgtgacagacttcactctcaccatccagcagcctagagcctgaagtattctgctagtttattactgtcagcagtcgtagcaacgttcggccttctctacgtttcggaccggtagggaccgagggtggacgtagtaccgaaacgtaacgtggtacggacgtcggtacacctatccgtagtcttaccg

SEQ ID NO: 73879 - DNA, 510 bp, Homo sapiens
  misc_feature: GYAE6OF02I2XOB.49.46.E02.1.454.CMB.1.raw
  modified_base (402)..(402): a, c, t, g, unknown or other
  misc_feature (402)..(402): n is a, c, g, or t
  modified_base (502)..(502): a, c, t, g, unknown or other
  misc_feature (502)..(502): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatccccagccaggttcagtggcagtgggtctgtgacagcttcactctcaccatcagcagcctagacgtcctgaaagtattcngctagtttattactgtcagcagtcgtagctaacgtgcctctctaccttggcggaggaccagggtcgagtactacgaaacgaacgtggtagctgccacctntcctgtcc

SEQ ID NO: 73880 - DNA, 512 bp, Homo sapiens
  misc_feature: GYAE6OF02HCWD2.49.46.E02.1.454.CMB.1.raw
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaaacctggccaggctcccaggcctcctcatctatgatgcatccaacngggccactggcatcccagccaggttcagtgcaggtggtctgtgacagacttcactctcaccatcagcagcctagagcctagaagtattctgctagttttattactgtcagcagtcgtagctaacgtgcctctctacgtttcggacggagggaccaggtggaagactacaaacggtactggtgctcgacctactactcgtgtc

SEQ ID NO: 73881 - DNA, 549 bp, Homo sapiens
  misc_feature: GYAE6OF02I791I.49.46.E02.1.454.CMB.1.raw
  modified_base (359)..(359): a, c, t, g, unknown or other
  misc_feature (359)..(359): n is a, c, g, or t
  modified_base (374)..(374): a, c, t, g, unknown or other
  misc_feature (374)..(374): n is a, c, g, or t
tcagagtcgagagacacgaccggtgctcgatttagactcatctacagggaaagggggaggaactgctcagttaggacccagagggaaccatggaagcccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgacgggccacgtggcactcccagccaggttcagtcggctaggtggtctgngacagtcttcactcncaccatcagcacgtcctagacgcctagaacgtcttcgtagcttaagtttattactgttacagtcaggtcgtagacctaacgtcgccttctcgtacgttccggacgggtacgggaccgtaggtcggacgtagtaaccgaaacgtactggtagcgtcgaccacgtacttctcgttcc

SEQ ID NO: 73882 - DNA, 604 bp, Homo sapiens
  misc_feature: GYAE6OF02HY357.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcatccaagcgggccacgtggccactcccagccaggttcagtggcaggtgggtctgtgacagtacttcactctacaccatcagcacgcctagacgcctagaaacgtacttctggtacttagttttacttactgtccagcaggtcgtagacctaacgtcggtacccttcgtaccttacggtttcgggaccgggtaacgggaacccgtaaggggtggtaacggtaacgtaaccggtaaaaccggtaacgttacgggtacgggtaccgtacggtaccctaacccgtatttcccggttaggtttaccc

SEQ ID NO: 73883 - DNA, 562 bp, Homo sapiens
  misc_feature: GYAE6OF02H1QQ2.49.46.E02.1.454.CMB.1.raw
  modified_base (261)..(261): a, c, t, g, unknown or other
  misc_feature (261)..(261): n is a, c, g, or t
  modified_base (308)..(308): a, c, t, g, unknown or other
  misc_feature (308)..(308): n is a, c, g, or t
  modified_base (350)..(350): a, c, t, g, unknown or other
  misc_feature (350)..(350): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaacctggccaggcctccaggctcctcatctatgatgcatccaacnggccactggcatcccagccaggttcagtggcaggtggtctgngacagtacttcactctcaccatcagcagcctagacgcctagaacgtacttctgtactagtttactttactgtcagcagtcgtagactaacgtcgtccttcgtcctaccgtttcggacgggtaacggaccgtagggtcggtacgtaactaaccgtaaacggtaacgttacggtcggtacgtacggaccgtaaccgtagttccgtagttacccg

SEQ ID NO: 73884 - DNA, 660 bp, Homo sapiens
  misc_feature: GYAE6OF02IJXPL.49.46.E02.1.454.CMB.1.raw
tcagagtcgagagacacgaccggtgctcgatttagactcatctacagggaaagggggagaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttctagcctggtaccaacagaaacctggccaggctcccaggctcctcatctatgatgcatccaacagggccactggcatccccagccgtagtcgtaggcggacgtagggtcggtacgtggtacgacgtaacgttaccttacgtaccttctacccaacctactacgacgtaccgacgtaccgtaacggaccgtaccgtaagtaaacgttcttacgtcgtaacgtttaagtttaacttacgtcgttacgacgtacgacggtacgtaccgaaccgtaacggtccggtcccttaccgttaccgtttaccgggttccgggaaccggggtaacggtaaccgggtaacggggttaggaacgtaacgtaaaccggaaaacggttacgtggtacggtcgtacgtacctacgtacttcgttacttaccg

SEQ ID NO: 73885 - DNA, 533 bp, Homo sapiens
  misc_feature: GYAE6OF02HNMN3.49.46.E02.1.454.CMB.1.raw
  modified_base (368)..(368): a, c, t, g, unknown or other
  misc_feature (368)..(368): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcaggtgggtctgtgacagacttcactcncaccatcagcagcctagacgctagaagtattccngactagttttattactntcagtcaagcgttagacaacgtcgcctcgtctacgttcggacggtagggaccgagggttcggaagtactacgaaaacgtacgtaggtcggctcggacctacctattcgtgttcc

SEQ ID NO: 73886 - DNA, 576 bp, Homo sapiens
  misc_feature: GYAE6OF02IA1RB.49.46.E02.1.454.CMB.1.raw
  modified_base (537)..(537): a, c, t, g, unknown or other
  misc_feature (537)..(537): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatcctatgatgcatccaacagggcccactggcactcccagccaggttcagtggcagtgggtctgtgacagacttcaactcttcaccatcacgtcacgcctagacgccgtagaagattcgtgtcctaaggtttacttactgtacctagcagtcgtacgacaacgtcggcctcctcgtaccgtttacgggaccggtaacggggaccgtaagggtcggaacgtacgtaaccgaaacggtaaccgttaggngggtaccctaggaccaccgtacttaccggtgtttacccg

SEQ ID NO: 73887 - DNA, 562 bp, Homo sapiens
  misc_feature: GYAE6OF02I3VKZ.49.46.E02.1.454.CMB.1.raw
  modified_base (385)..(385): a, c, t, g, unknown or other
  misc_feature (385)..(385): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagttgttagagcttctagcctggtaccaacagaaacctggccaggcctcccaggctcctcatctatgatgcatccaacgacgggccacgtggcactccccagcctaggttacagtcggcaggtggggtctggtgacagtacttcactctccaccntcagcagcctagacgcctagaagtcttactgcttagttttacttacttgtactacgcaggtcgtaagacctaacgtcggtccttctccttacggttccggacgggtacgggaccgagggtacgagtacgtaaccgaaacgtacgtggttcggctacgccaacgtcttcgtcgttacc

SEQ ID NO: 73888 - DNA, 604 bp, Homo sapiens
  misc_feature: GYAE6OF02JL6PU.49.46.E02.1.454.CMB.1.raw
  modified_base (403)..(403): a, c, t, g, unknown or other
  misc_feature (403)..(403): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcataccaacgacggccactcggccactccccaagccaggttcagtggcaggtgggtctgtcgacagtacttcgacttctacaccatcagctacgcctagacnccgtagaacgtcttcgagtctaagtttacttacgtgtccagtcaggtacgtacgacctaacgtcgggtcccttacgtaccttaccggtttaccgggaccgggtaagggtaccctaaggggttacggaacggtaacgttaacggaaaccggtacgtcggtacggaccgttacggacctaacccgtgttccgtaggtttaccc

SEQ ID NO: 73889 - DNA, 510 bp, Homo sapiens
  misc_feature: GYAE6OF02HBE2N.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcaggtgggtctgtgacagacttcactctcaccatcagcacgcctagacgcctagaagtattctgtctagtttattactgtacagcagtcgtagcaactgcctctctacgttcggcggacgggaccgaggtggagtatacgaaacgaacgtgtgctcggacaccatctgtc

SEQ ID NO: 73890 - DNA, 616 bp, Homo sapiens
  misc_feature: GYAE6OF02G9FEF.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcactcccagccaggttcagtggcaggtgggtctgtgacagtacttcactctacacctatcagcagccctagacgtccgtagaagtcttcgtgacttaaggttttaacttacgttacgtctacgcctaggtacgttaacgacctaaacgtcgggtacctagttccgtaccgttaccggtttccgggaccgggtaacggggtacccgtaaggggtacgggaacgtaacgtaaccggtaaaacggtaccggttacgggtcgggtaccgttacggaccctaacccgttagttcccgttcgg

SEQ ID NO: 73891 - DNA, 528 bp, Homo sapiens
  misc_feature: GYAE6OF02GCVAK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccacgtggcactcccagccaggttcagtggcagtgggtctgtgacagagttcactctcaccatcagcacgcctgcagtctagaagtatttgacttagtttattacgttgtacagctagtataagtgtccgggctccggtactaccgttcggacggtacggaccgtagggtgagtagtacgaaacgacgtgtacgcgtcgccaccatcgtcgtctac

SEQ ID NO: 73892 - DNA, 535 bp, Homo sapiens
  misc_feature: GYAE6OF02FQF1L.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtggcagtgggtctgtgacagacttcactctcaccatcagcagcctagacgcctagaagtattctgctagtttactacttgtcagcagcgtagactaacgtcggcctctctacgtttcggacgggaggaccgtagggtcggagtaactacgaaacggtaacttggtacggtcgtacggcctaaccgagttcctgttacc

SEQ ID NO: 73893 - DNA, 514 bp, Homo sapiens
  misc_feature: GYAE6OF02F384V.49.46.E02.1.454.CMB.1.raw
  modified_base (398)..(398): a, c, t, g, unknown or other
  misc_feature (398)..(398): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattcngctagtttatacttgtcagcagcgtagacaacgtgcctctctacgtttcggcggacgggaccgagggtggagtatacgaaacgaacttggtaggcttgaccactacgttctgttcc

SEQ ID NO: 73894 - DNA, 525 bp, Homo sapiens
  misc_feature: GYAE6OF02HTQ3R.49.46.E02.1.454.CMB.1.raw
  modified_base (261)..(261): a, c, t, g, unknown or other
  misc_feature (261)..(261): n is a, c, g, or t
  modified_base (407)..(407): a, c, t, g, unknown or other
  misc_feature (407)..(407): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanagaaacctggccaggctccaggctcctcatctatgatgcatccaaacgacgggccacgtggcactcccagccaggttcagtggcaggtggctgtgacagacttcactctacaccatcagcacgcctagacgcctagaagtacttcngtctagtttattactgtcagcagtcgtagacaacgtcgcctcgtctacgttcggacgggtacggaccgaggtggagacgtacgaaacgtacgtgtgacgtcgacgacctatctgttcg

SEQ ID NO: 73895 - DNA, 524 bp, Homo sapiens
  misc_feature: GYAE6OF02G2H5L.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcacgcctagacgcctagaagattctgctagtttattactgtcagcagcgtagacaacgtcgcctctctacgtttcggacggtacgggaccgtaggtggagagtaccgaaacggtaactaggtggactcggaccaccgtatctgttacc

SEQ ID NO: 73896 - DNA, 504 bp, Homo sapiens
  misc_feature: GYAE6OF02G2PSS.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacagggccactggcatcccagccaggttcagtggcagtgggtctgtgacagacttcactctcaccatcagcagcctagacgcctgaagattctgctagtttattactgtcagcaggctagcaacgtcggcctctctacgttcggacggaggaccagggtgagactacgaaacgtacgtgtaggctgaccacatcgtgtc

SEQ ID NO: 73897 - DNA, 588 bp, Homo sapiens
  misc_feature: GYAE6OF02IFV9Y.49.46.E02.1.454.CMB.1.raw
  modified_base (204)..(204): a, c, t, g, unknown or other
  misc_feature (204)..(204): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccactggagaaatagtgatgacgcagtctccagccaccctgtctgtgtctccgaggggaaagngtcaccctctcctgcagggccagtcagagtgttaggagcaacttagcctggtatcagcagaaacctggccaggctcccaggctcctcatctatgatgcactccaccgagggcccacgtggtaactcccgagcctaggtttccaggtcggctaggtggggtctaggggactaggacgttcactctcaacatcagcagcctgacctagtctagaagttatttgacttagtttacttactgtactagtactagtataacgttcggtaccgggtccttaccggactaccggtttacgggacgggtacgggaaccggtaagggtaggaacgtacgtaaccgaaaccggtacgttcggtacggccgttacggaacctaccgtattcccgg

SEQ ID NO: 73898 - DNA, 549 bp, Homo sapiens
  misc_feature: GYAE6OF02IX21I.49.46.E02.1.454.CMB.1.raw
  modified_base (368)..(368): a, c, t, g, unknown or other
  misc_feature (368)..(368): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagtacttcactcncaccatcagccagcctagacgcctgaagtattctgctagtttattactgtcagcagtcgtagacaacgtcggccttctccttacgtttccgggacgggacgggtacccgaagggtggaacggagtaaccgaaacggtaacttggtacggtactcggaccaacccgtacgttcgttgttccg

SEQ ID NO: 73899 - DNA, 508 bp, Homo sapiens
  misc_feature: GYAE6OF02ICQGP.49.46.E02.1.454.CMB.1.raw
  modified_base (260)..(260): a, c, t, g, unknown or other
  misc_feature (260)..(260): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggcaccctgtctttgtctccaggggacagtgccaccctctcctgcagggccagtcagagtgttagtagcttcttagcctggtaccaanagaacctggccaggctcccaggctcctcatctatgatgcatccaacagggccacgtggcactcccagccaggttcagtgcaggtggtcngtganagacttcactctcacatcagcagcctagagcctagaacgattctgctagtttattactgtcagcagcgtagcaactggcctctctactttcggcggtaggaccgagggtggagagtacaaacggaactcgtaggctgacctacctatctgttac

SEQ ID NO: 73900 - DNA, 514 bp, Homo sapiens
  misc_feature: GYAE6OF02F9V8D.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtggcagtgggtctgtgacagacttcactctcaccatcagcagcctagagcctagaagtattctgctagtttacttactgtcagcagcgtagcaacgtcgtcctctctacgtttcggcggtagggaccgtaggtggagactacaaacgaactgtacggcgtcgccacactcgtgttcc

SEQ ID NO: 73901 - DNA, 522 bp, Homo sapiens
  misc_feature: GYAE6OF02G0BFK.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtggcagtgggtctgtgacagacttcactctcaccatcagcagcctagacgcctagaagattctgctagtttattacttgttcagcagcgtagcaactcggcctctctacgtttcggacggacgggaccgaggtggagtacgtacgaaacggaaccgtgtggcgtcgccgaccacttcgtgttccg

SEQ ID NO: 73902 - DNA, 513 bp, Homo sapiens
  misc_feature: GYAE6OF02F03RZ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtggtctgtgacagacttcactctcaccatcagcagcctagagcctagaagtattctgactaagttttacttacgtgtcagcagcgtagcaacgtcgcctctctacgttcggcggagggaccagggtggagtatacgaaacgaacttggtacggctgaccaccattctgtc

SEQ ID NO: 73903 - DNA, 504 bp, Homo sapiens
  misc_feature: GYAE6OF02IB5TT.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctacaccatcagcagcctagagcctgaagtattctgctagtttattactgtcagcagcgtagcaactgcctctctacgtttcggcggaggaccagggtgagataccgaaacgaacgtgtggctgaccaccattctgttc

SEQ ID NO: 73904 - DNA, 538 bp, Homo sapiens
  misc_feature: GYAE6OF02IADQ3.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaacctggccaggctcccaggctcctcatctatgatgcatccaacagggccactggcatcccagccaggttcagtggcagtgggtctgtgacagacttcactctccacatcagcagcctaagacgcctagaagtattctgtactagttttacttacgttgtacagcagtcgtagactaacgtcggccttcgtcctacgtttcgggacgggacgggacctaagggtcgagtaatacgaaacgtacgttggtggcttcgacctacattccgtgttacc

SEQ ID NO: 73905 - DNA, 513 bp, Homo sapiens
  misc_feature: GYAE6OF02GQ5EW.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcaggtgggtctggtgacagacttcactctcacctatcagcagcctagacgcctagaagtattctgtctagtttattactgtcagcagcgtagcaactcggcctctctacgtttcggacggacgggaccgaggtggagactacgaaacgacttgtggctgccacgtatcgtgtc

SEQ ID NO: 73906 - DNA, 552 bp, Homo sapiens
  misc_feature: GYAE6OF02HIJID.49.46.E02.1.454.CMB.1.raw
  modified_base (401)..(401): a, c, t, g, unknown or other
  misc_feature (401)..(401): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccatggcatcccagccaggttcagtggcaggtggtctgtgacagacttcactctcaccatcagcagcctaagcgccgtagaagtattcngactaagttttactactgtacagtcagcgtagactaacgtggtccctcttacctacggtttcggaccgggtaagggaccgtaagggtggaacgtaggtaccaaacggtacgtggtacggtcgttacgacctaccggtattccgtgttaccg

SEQ ID NO: 73907 - DNA, 533 bp, Homo sapiens
  misc_feature: GYAE6OF02H2CTM.49.46.E02.1.454.CMB.1.raw
  modified_base (246)..(246): a, c, t, g, unknown or other
  misc_feature (246)..(246): n is a, c, g, or t
  modified_base (262)..(262): a, c, t, g, unknown or other
  misc_feature (262)..(262): n is a, c, g, or t
  modified_base (389)..(389): a, c, t, g, unknown or other
  misc_feature (389)..(389): n is a, c, g, or t
  modified_base (427)..(427): a, c, t, g, unknown or other
  misc_feature (427)..(427): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttnttagcctggtaccaanagaaacctggccaggctccaggctcctcatctatgatgacatccaacagggccaactggcactcccagccaggttcagtggcaggtggtctgtgacagacttcactctcaccatcagcagcctagcncctagaagacttcgtgactagtttattactgtacacgnagcgtagacagtcggcctactcgtacgttcggacggtacgggaccagggtcgagtactaccgaaacggtactgtcggcttacggaccaccgtattccgtagttacc

SEQ ID NO: 73908 - DNA, 588 bp, Homo sapiens
  misc_feature: GYAE6OF02IDRX9.49.46.E02.1.454.CMB.1.raw
  modified_base (309)..(309): a, c, t, g, unknown or other
  misc_feature (309)..(309): n is a, c, g, or t
  modified_base (387)..(387): a, c, t, g, unknown or other
  misc_feature (387)..(387): n is a, c, g, or t
  modified_base (404)..(404): a, c, t, g, unknown or other
  misc_feature (404)..(404): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatcgatgcatccaanagggccactggcatcccagccaggttcagtggcaggtggtctgtgacagtacttcactctcaccatcagcagcctagngccgtagaagtattcgngtctagtttacttactgtctaagcagcgttacgacctaacgtcggtccctcgttacctaccggttttacgggccgggtaacggggtaacccgaaggggttcgggtaaggtaacgtaaccgtaaaacggtaaccgttacggtacgggtacctcggaccgacccgttacgtcccgttagttacccg

SEQ ID NO: 73909 - DNA, 558 bp, Homo sapiens
  misc_feature: GYAE6OF02G3E1D.49.46.E02.1.454.CMB.1.raw
  modified_base (373)..(373): a, c, t, g, unknown or other
  misc_feature (373)..(373): n is a, c, g, or t
  modified_base (388)..(388): a, c, t, g, unknown or other
  misc_feature (388)..(388): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctcatctatgatgcatccaacgagggccactggcatcccagccaggttcaggtgcagtgggtctgtgacagacttcactctcacntcagcagcctagacnccgtagaagtacttctaggcttaagtttacttacgttgtcagctagtcgtagctaacgtcggcctacgtctaaccggtttcgggaccgggtaagggaccgtaagggtcggaaggtaacgtacgaaaacggtaacgtggtaggctcggacctaccgacgttcgtcgttacc

SEQ ID NO: 73910 - DNA, 579 bp, Homo sapiens
  misc_feature: GYAE6OF02JFZG4.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacncgggccactggcactcccagccaggttcagtggcagtgggtctgtgacagacttcactctcaccatcagcacgcctagacgccgtagaaagtacttctcgacttaagttttattactgtacacgcacggtcgtagactaacgtcggcccttcgtcctaacgtttccgggacgggtacgggaaccgtagggttggaacggtactaaccgaaaacggtaacgttggtacgggtcgttacggacctaacccgacgtttccgttacggttaccc

SEQ ID NO: 73911 - DNA, 553 bp, Homo sapiens
  misc_feature: GYAE6OF02G1910.49.46.E02.1.454.CMB.1.raw
  modified_base (401)..(401): a, c, t, g, unknown or other
  misc_feature (401)..(401): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagacgcctagaagtattcngtctagtttattactgtctagcaggcgtagactaacgtcggtcctcttctacgtttcgggacggtacgggaccgtaaggggtcggaacgtacgtaccgaaaaccggtacgttggtaccggcttcggacctaacctacgttcctaggttaccc

SEQ ID NO: 73912 - DNA, 503 bp, Homo sapiens
  misc_feature: GYAE6OF02F6YUQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtggtctgtgacagacttcactctcaccatcagcagcctagacgcctagaagtattctgctagtttatactgtacagcagcgtagacaacgtgcctctactacgttcggacggaggaccaggtggagactacaaacggtactgtgctgaccactatctgtc

SEQ ID NO: 73913 - DNA, 582 bp, Homo sapiens
  misc_feature: GYAE6OF02F0TUA.49.46.E02.1.454.CMB.1.raw
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacaggccactggcatcccagccaggttcagtgcagtggtctgngacngacttcactctcaccatcagcagcctagacgcctagaacgtacttctgtactagttttataccgttgctagctaggcgtagacctaacgtcggtacctcttaccgtaccgtttccgggacgggaacgggtaacccgtaagggttacgggaacggtaagttaacccgaaaacggtaaccgttgggtacggtccttcgggaaccctaaccgtagttaccgttacggttaccc

SEQ ID NO: 73914 - DNA, 508 bp, Homo sapiens
  misc_feature: GYAE6OF02G0WJ7.49.46.E02.1.454.CMB.1.raw
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtggcaggtgggtctgtgacagacttcactctcaccatcagcagcctagacgcctagaagtattctgctagttttattacttgtcagcagcgtagactaacgtggcctctctacgtttcggcggaggaccgagggtgagatacaaacgactggtagctacgccacatctgtc

SEQ ID NO: 73915 - DNA, 504 bp, Homo sapiens
  misc_feature: GYAE6OF02H0DNJ.49.46.E02.1.454.CMB.1.raw
  modified_base (393)..(393): a, c, t, g, unknown or other
  misc_feature (393)..(393): n is a, c, g, or t
  modified_base (398)..(398): a, c, t, g, unknown or other
  misc_feature (398)..(398): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagagcttcttagcctggtaccaacagaaacctggccaggctcccaggctcctcatctatgatgcatccaacagggccactggcatcccagccaggttcagtggcagtgggtctgtgacagacttcactctcaccatcagcagcctagacgcctgaanattcngctagtttatactgtcagcagcgtagcaactcggcctctctacgtttcggacggtagggaccagggtgaagataccgaaacgactgtggctgccaccatctgttcc

SEQ ID NO: 73916 - DNA, 518 bp, Homo sapiens
  misc_feature: GYAE6OF02FV1JE.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagacgcctgaagtattctgctagtttattactgtcagcagcgtagcaacgtcggcctctctacgtttcggcggtacggaccgtaggtggacgtaatacgaaacgtaacgtggtaggcgtcgaccacctatctgtcc

SEQ ID NO: 73917 - DNA, 653 bp, Homo sapiens
  misc_feature: GYAE6OF02JP8AG.49.46.E02.1.454.CMB.1.raw
  modified_base (293)..(293): a, c, t, g, unknown or other
  misc_feature (293)..(293): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcctttgtctccaggggacagtgccaccctctcctgcagggccagtcagagtgttagtagcttcttagcctggtaccaacagtaaacctggccaggcctccgaggcctccncatctatgatgcatccaacgcggccacgtggcactccccagcccgtaggttccaggtcggacaggttgggtctggtgacagtcttacactctacacctatcacgcgacgtcctaaggacgtacctaggaaagtcttcgtacgtacttaacggttttacttaaccgttgttacgaacgtacctacggttaccgttacgtaacctaaccggttaggaccttaacgtttcctaccgttaacccggtttcggggaccggggtaacgggtaaccgtaacgggttaggggaaccttaacgtaaccggaaaaccgtaacggttggttaccggtacgtccggtaactaacccgttagttccgttacgg

SEQ ID NO: 73918 - DNA, 499 bp, Homo sapiens
  misc_feature: GYAE6OF02HLZPC.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtggtctgtgacagacttcactctcaccatcagcacgcctagacgctagaagtattctgactagtttattactgtcagcagtcgtagacacgtcgcctctctacgttcggcggaggaccgaggtgagatacaacgaactagtgctcgacacatctgtc

SEQ ID NO: 73919 - DNA, 489 bp, Homo sapiens
  misc_feature: GYAE6OF02GMMCY.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagcactgcctctcactttcggcgagggaccaggtggagatacaaacgactgtgctgcacatctgtc

SEQ ID NO: 73920 - DNA, 525 bp, Homo sapiens
  misc_feature: GYAE6OF02HTJQL.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggcccactggcatccccagccaggttcagtggcaggtgggtctgtgacagtacttcacctctcaccatcagcagcctagcgcctagaatacttctgtactagtttacttactgtcagcagcgtagacacgtcggcctctcctacgtttcggcggacgggacagggtggaagtactaacgaaacggtactggtgacgtgaccaccagttctgttcc

SEQ ID NO: 73921 - DNA, 576 bp, Homo sapiens
  misc_feature: GYAE6OF02F9XSN.49.46.E02.1.454.CMB.1.raw
  modified_base (411)..(411): a, c, t, g, unknown or other
  misc_feature (411)..(411): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctcatctatgatgcatcccaacgacgggccacgtggcactccccagccaggttcaggtggcaggtgggtctggtgacagtacttcactctcaccatcagcagcctagcgcctagaagtattcngtctagtttacttactgtcagcagcgtagacaacgtcggaccttctaccgtacgtttcgggacgggtacgggtaccgagggtcgggacgtaacgtaaccggaaaacggtaacgttaggtacgggtccgttacggaccctaaccgtacgttccgttacgtttaccc

SEQ ID NO: 73922 - DNA, 628 bp, Homo sapiens
  misc_feature: GYAE6OF02IORSA.49.46.E02.1.454.CMB.1.raw
  modified_base (308)..(308): a, c, t, g, unknown or other
  misc_feature (308)..(308): n is a, c, g, or t
  modified_base (358)..(358): a, c, t, g, unknown or other
  misc_feature (358)..(358): n is a, c, g, or t
  modified_base (370)..(370): a, c, t, g, unknown or other
  misc_feature (370)..(370): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaanacgggccactggcactcccagccaggttcagtggcagtgggtctgtgacngtacttcactcncaccatcagcagacctagacgcctagaaagtacttctgtacttagttttaacttacgtgttaccaagaccgtagtcgtaagtacctaaacgtcggccctttaccgtccgtttaaccggtttccgggaaccggggtaacgggtaaccccggtaaggggttacgggaacgtaaaccgtttaaaccggaaaaccggttaacgttacgggttacggtacccgttcggacccgtaacccgtacgtttcccgtagtttaccccg

SEQ ID NO: 73923 - DNA, 809 bp, Homo sapiens
  misc_feature: GYAE6OF02J4VW6.49.46.E02.1.454.CMB.1.raw
  modified_base (130)..(130): a, c, t, g, unknown or other
  misc_feature (130)..(130): n is a, c, g, or t
  modified_base (246)..(246): a, c, t, g, unknown or other
  misc_feature (246)..(246): n is a, c, g, or t
tcagagtcgagagacacgaccggtgctcgatttagactcatctacagggaaaggggagaactgctcagttacggacccagagggaaccatcggaacgccccagctcagtcttctcttcctctgctactcncggcctaccgaagactaccgacggtaataacttcgtacgtacacacgtcgtcccgtccgtacctaccgttgttaccgttcgccgtacgggacggcctacgtccaccctcctctcgngacgacggtactagtactaggtagttacgttacgtactccttaggtaaccgaccgttaaccggaaccaacgtaccggaaccgtcgaccacgtccctaccacgtcctactataacgtctacgacttaccggaccaaccgtaccgtaaccgaccggtcggtacctacgtccgacctaccggtacgacggttaccgttaggtacgtacgggtccgtacggttaacggttccgtactacggtaaccctacctaacttaccctacctaccgtaccaaacccgtaacgtaccgacggtaaaccgtacggtaccgtacgtacggtaaccgttacgttaagtacgttacttacgtaacttacgtttaacgtactacggtacgtacctacgaccgtaaccggtacgtccgtaaccgtttaccgggtacccttacgggttaacgtccggggttaaacgacgggggaaaccgtaaccggtagtaccggtaactaccggtaaaccctgtaaacccggtgtccgtacctacccgttacttaaaccccgtctttacccggtttctacccgttacccg

SEQ ID NO: 73924 - DNA, 503 bp, Homo sapiens
  misc_feature: GYAE6OF02IEL2H.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctggtgacagacttcactctcaccatcagcagcctagagcctgaagattctgctagttttattactgtcagcagcgtagcaacgtggccttctctacgtttcggcggacgggaccagggtggagatacaaacgactgtggctgccaccatctgtc

SEQ ID NO: 73925 - DNA, 600 bp, Homo sapiens
  misc_feature: GYAE6OF02F2ZQN.49.46.E02.1.454.CMB.1.raw
  modified_base (333)..(333): a, c, t, g, unknown or other
  misc_feature (333)..(333): n is a, c, g, or t
  modified_base (490)..(490): a, c, t, g, unknown or other
  misc_feature (490)..(490): n is a, c, g, or t
tcagagtcgagagacacgaccggtgctcgatttagactcatctacagggaaaggggggacggaactcgcgtcacgttaggacccagtagggaaccatggaagccccagctcagcttctcttcctcctgctactctggctcccagataccaccggagaaatttgtgttgacactaagtctccggccaccctgtctttgtctccgaggggacaggtgccgaccctctcctggccgacgggccagtcagagtgttagtagcttcttacgccttggtaccaacagaaacctggccaggcctcccgaggcctcctcatcctagtgatgcatccgaacncgggccacgtcggccacgtcccgaagcctaggttcaggttggcaggtcgggtctaggtcgacagtaccttcactcgtaccaccatacacgcaacgaccctaagacgtacctagaaatattctagacttaagtttaatacgtgtacagctagcgttanactacgtggccttatcctacgtttcggacgggtaacggtaccgtagggtcggaagtacgtaccgaaacgacgttggtcggcgtcgaccgtaccgtcttaccgtgttaccc

SEQ ID NO: 73926 - DNA, 552 bp, Homo sapiens
  misc_feature: GYAE6OF02FRASV.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacagggccactggcatcccagccaggttcagtggcagtgggtctgtgacagacttcactctcaccatcagcacgcctagagcctagaagtattctgctaagtttatacttgtacagtcagcgtagactaacgtggacccttctctacgtttcgggaccggtaagggtaccgtaagggtcggaaggtaacgttaccgaaacggtaacgttggtacggactacggacctaccgtagttccgtgttaccg

SEQ ID NO: 73927 - DNA, 538 bp, Homo sapiens
  misc_feature: GYAE6OF02JPLXU.49.46.E02.1.454.CMB.1.raw
  modified_base (400)..(400): a, c, t, g, unknown or other
  misc_feature (400)..(400): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcactcccagccaggttcagtggcaggtggtctgtgacagtacttcactctacaccatcagcagcctagacgcctagaagtnttctgctagtttatacgtgtacagcagtcgtagctaacgtcgccttctctacgtttcggacggtacggaccgtagggtgacggtactaacgaaacgtaacgtcggtacggcgttacgacctactagttccgtgttacc

SEQ ID NO: 73928 - DNA, 537 bp, Homo sapiens
  misc_feature: GYAE6OF02HSNYP.49.46.E02.1.454.CMB.1.raw
  modified_base (427)..(427): a, c, t, g, unknown or other
  misc_feature (427)..(427): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcactccaacagggccacgtggcatcccagccaggttcagtggcaggtgggtctgtgacagacttcactctacacctatcagcagcctagacgcctagaagtattctgtctagtttattactgtacngcagcgtagcaacgtcgacctcgtctacgttcggacggtaacgggaccgtagggtggaagtaactaccgaaacggaacgtggtaggcgttcgaccactacgtcctgttcc

SEQ ID NO: 73929 - DNA, 502 bp, Homo sapiens
  misc_feature: GYAE6OF02HL43G.49.46.E02.1.454.CMB.1.raw
  modified_base (356)..(356): a, c, t, g, unknown or other
  misc_feature (356)..(356): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacngacttcactctcaccatcagcagcctagagcctgaagattctgcagtttattactgtcagcagcgtagcaactggcctctcactttcggacggaggaccagggtggagatacaaacggtaactggtaggcgtggcaccatctgtcc

SEQ ID NO: 73930 - DNA, 538 bp, Homo sapiens
  misc_feature: GYAE6OF02F96YO.49.46.E02.1.454.CMB.1.raw
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccacgtggcatcccagccaggttcagtggcaggtgggtctgtgacagtacttcactctccaccatcagcagcctagacgcctgaatnttcngctagttttatacttgtcagcagcgtagctaacgtcggccttctcgtacgtttcgggacggtacgggtaccgagggtcggaagtactacgaaacggtacttggtacggctcggaccaacctgttaccgtgttacc

SEQ ID NO: 73931 - DNA, 498 bp, Homo sapiens
  misc_feature: GYAE6OF02FMV1T.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcacctatcagcagcctagagcctagaagattctgctagtttattacttgtcagcagcgtagcaactgcctctctactttcggcggaggaccgaggtggagtatacaaacgactgtgctgacacactctgtc

SEQ ID NO: 73932 - DNA, 613 bp, Homo sapiens
  misc_feature: GYAE6OF02HFL6A.49.46.E02.1.454.CMB.1.raw
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (410)..(410): a, c, t, g, unknown or other
  misc_feature (410)..(410): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaanagaaacctggccaggcctccaggctcctnatctatgatgcataccaacgagggccacgtggccactcccagcctaggttcaggtggctaggtgggtctgtgacagtacttcactctcaccatcagcagcctagacgtccgtagaagtnttcgtgtacttagttttaattacgttgtacagtacaggtacgtaagacctaacgtcggtacccttacgttaccttaccgggtttccgggaccgggtaacggggtaacccgtaggggttacgggtaacgtaacgttaacccggaaaacggtaaccgttgggttacggaccgtacggccctaaccgtgttaccgttacgttaccc

SEQ ID NO: 73933 - DNA, 827 bp, Homo sapiens
  misc_feature: GYAE6OF02G2L7T.49.46.E02.1.454.CMB.1.raw
tcagagtcgagagacacgaccggtgctcgatttagactcatctacagggaaagggggaggaacgtgctcagttaggacccagagggaaccatggaagcccagctcagcttctcttcctcctgctactctggctccagataccaccggagaaattgtgttgacacagtctccggccacctgtctttgctaccagggacagtcgccacctctcctgcagggccagtcagagtgttagtagtcttctagcctggtaaccaacacgaaacctggccaggcctcccgaggcctcctcactctatgatagcaactccaaaccgtagggcccacgtcggaccacgtccccgagcccgtaacggttcaacggttcggaccgtaggtcgggggttactggtacgtaacgacggtaacctttcgaaccgttccgtaccctaacccgtaacttaccgaacggtacccgtaaccgtacccgttaacggaaccggttacccggtaaggtaaacggtaccgtttaccgttacgggttacccttaaaggtttttaaaccgttttaacccgttacgggtttaaccgtaacggtaacccggttaaacggaccggtttaaaccggaccgttaaaacccggtttcccggggtacccttttaacccgttcccgttaaccgggtttttacccgggggaacccggggtaacggggtaaccccggtaagggggttaacgggtaaccggtaacgttaaacccggttaaaaccggtaaacggtttacggggtaccggtaccggttaccggtaaccccgaacccgtacggttttacccgttacgggttacccc

SEQ ID NO: 73934 - DNA, 559 bp, Homo sapiens
  misc_feature: GYAE6OF02I4DZ7.49.46.E02.1.454.CMB.1.raw
tcagagtcgagagacacgaccggtgctcgatttagactcatctacagggaaagggggaggaactgctcagttaggacccagagggaaccagtggaagccccagctcagcttctcttcctcctgctactctggctcccagataccaccggagaaattggtgttgacacagtctccggccaccctgtctttgtctcccaggggacagtgccaccctctcctgcagggccagtcagagtgttagtagcttcttagcctggtaccaacagaaacctggccaggctcccaggcctcctcatctatgatgcatccaacagggccactggcactcccagccaggttcagtggcagtgggtctgtgacagacttcactctcaccatcagcagcctaagacgcctagaagattcagctagtttatacttgtacagccagcgtagacaacgtcggccttctcctacgtttccgggacgggtaacgggaaccgtaggggtcggaaggtaacgtaccgaaaacggtacgttaggtacggtcttacggacctaaccgattccgtgttacccg

SEQ ID NO: 73935 - DNA, 723 bp, Homo sapiens
  misc_feature: GYAE6OF02J3ELO.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggcctcccaggcctcctcatcctatgatgcatacccaacgtgggccacgtggccactcccagcctaggttcaggtgcaggtcgggtctgtcgacacgtacctttacaccttcctacaacccgtaattcccgaacggtaccgaacgacccgttaacggaaccggtacccgttaagggtaaacgttacgtttaccgttacggttaccgttaaacgttttaaccgttttaacgttacggttaccgtaagtaccgtacgggtaccgtaacgtaccgtaaccggtccgtacccgttacgttacccgttacccggttttaccggggaccgggtaaccggggtaaccggtaacgggtacggtaacggtaaaccgttaaccggaaaaccggtaaccggttacggtaccggtacgttacggacccgtaacccgtaacgttccgttacggtttaaccc

SEQ ID NO: 73936 - DNA, 529 bp, Homo sapiens
  misc_feature: GYAE6OF02I8PPP.49.46.E02.1.454.CMB.1.raw
  modified_base (309)..(309): a, c, t, g, unknown or other
  misc_feature (309)..(309): n is a, c, g, or t
  modified_base (394)..(394): a, c, t, g, unknown or other
  misc_feature (394)..(394): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtggcagtggtctgtgacagacttcactctcaccatcagcagcctagagcctagaagnttcgtgcgtaagtttattacttgtcagtacagcgtagacaacgtggccctctcctacgtttcggcggacggaccgagggtcggagacgtaccaaacggtacgtaggtggctcggaccaccgtatccgtgttaccg

SEQ ID NO: 73937 - DNA, 536 bp, Homo sapiens
  misc_feature: GYAE6OF02IASZZ.49.46.E02.1.454.CMB.1.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
  modified_base (354)..(354): a, c, t, g, unknown or other
  misc_feature (354)..(354): n is a, c, g, or t
  modified_base (372)..(372): a, c, t, g, unknown or other
  misc_feature (372)..(372): n is a, c, g, or t
tcagagtcgagagacacgaccggtgctcgatttagactcatctacagggaaagggggaggaactgctcagttaggacccagagggaacatggaagccccagctcagcttctcttcctcctgctactctggctcccagataccaccggagaaattgtgttgacacagtctccggccaccctgtctttgtctccaggggcagtgccaccctctcctgcagggccagtcagagtgttagtagcttcttagcctggtaccaacagaacctggccaggctcccaggctcctnatctatgatgcatccaaacngggccacgtggccactcccagccaggttcaggtggctaggtgggtcngtgactagacttcactcncaccatcagcagcctagacgctagaagtacttctgtacttagtttactttacttgtctagtcacgacgtacgacgtactcggtcctctacgtaccgttcgggcggtacgggaccgtagggtaggacgagtacgaaacgacgttagtggctcgctaccatctgtc

SEQ ID NO: 73938 - DNA, 632 bp, Homo sapiens
  misc_feature: GYAE6OF02II577.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgagggccacgtggcatcccagccaggttcaggtggcaggtggtctggtgacagacttcgactctcaccatcagcacgtccctaaggacgtccctaggaaacgtacttcgtaggtacctaggttttttaacttaccgtgttaccagtaccgaaggtaccgttaacgacctaaccgtcgggtcccttaccgttaccgttaaccggtttccgggaacggggtaacggggtaacccgtaagggggtcggaaacggtacgttaaccggaaaaccggtacgttcgggtacggtaccttaggccctaaccgtagttcccgttaggttaccc

SEQ ID NO: 73939 - DNA, 562 bp, Homo sapiens
  misc_feature: GYAE6OF02I29QJ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagacgcctagaagtacttcgtgctagttttattactgtcagcagcgtagacctaacgtcggtcctcgtcctacgtttccgggacggtacgggaacccgtaagggtcggaacggtaacgtaaccgaaaacggtaacgttggtacggtacgtcggacctaccgtaagttccgtgtttacccg

SEQ ID NO: 73940 - DNA, 543 bp, Homo sapiens
  misc_feature: GYAE6OF02FM0EU.49.46.E02.1.454.CMB.1.raw
  modified_base (261)..(261): a, c, t, g, unknown or other
  misc_feature (261)..(261): n is a, c, g, or t
  modified_base (312)..(312): a, c, t, g, unknown or other
  misc_feature (312)..(312): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaanacgaaacctggccaggctcccaggctcctcatctatgatgcatccaaacgngggccacgtggcatcccagccaggttcagtggcaggtgggtctgtgacagtacttcactctcaccatcagcacgcctagacgcctagaagtacttctgtacttagtttacttacttgtacacgtcagacgtagactacgtcgtcctctctacgtttcggcggtacgggaccgagggtggacgtacgtacgaaaccgaacgttcggtagcgtcgaccacctatccgtgttcc

SEQ ID NO: 73941 - DNA, 508 bp, Homo sapiens
  misc_feature: GYAE6OF02GGTI6.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagacactcgcctctctacgtttcggcggagggaccgtagggtggaggaactacgaaacgaacgtgtggcgtgccacactctgtcc

SEQ ID NO: 73942 - DNA, 525 bp, Homo sapiens
  misc_feature: GYAE6OF02FQFX5.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggcccagtggcatcccagccaggttcagtggcaggtgggtctggtgacagtacttcacttctcacccatcagcagcctagacgcctagaagtattcctgacttagttttattacttgtcagcagtcgtagctaacgtcgcctctctacgtttcggcggagggaccagggtggagatacgaaacggtaactgtcggctcgaccacattcgtgttcc

SEQ ID NO: 73943 - DNA, 550 bp, Homo sapiens
  misc_feature: GYAE6OF02GI851.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcactccaacgacgggcccacgtcgggccactccccagcccaggttcaggtggcaggtgggtctggtgacagtacttcactctcaccatcagcacgcctagacgcctagaagtattctgctagtttactacttgtcagcagtcgtagactaacgtcgcctctactacgtttcggacggagggaccgtagggtggacgagttaacgaaacggtaactggtacggactcggacctaccgacttcgtgttacc

SEQ ID NO: 73944 - DNA, 534 bp, Homo sapiens
  misc_feature: GYAE6OF02GQA45.49.46.E02.1.454.CMB.1.raw
  modified_base (313)..(313): a, c, t, g, unknown or other
  misc_feature (313)..(313): n is a, c, g, or t
  modified_base (362)..(362): a, c, t, g, unknown or other
  misc_feature (362)..(362): n is a, c, g, or t
  modified_base (528)..(528): a, c, t, g, unknown or other
  misc_feature (528)..(528): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcgagggccagtcagagtgttagagcttcttagcctggtaccaacacgaaacctggcccaggctcccaggctcctcatctatgatgcactccaacngggcccagtggcactcccagccaggttcagtggcaggtggtctgtgacngacttcactctcaccatcagcagcctagacgcctagaagtattctgactagtttatactgtcagcagcgtagcaacgtcgtcctctctacgtttcggcggacgggaccagggtagacggtataaccgaaacggtactggtaggcgtcggaccaccgtagttacgtnttaccg

SEQ ID NO: 73945 - DNA, 653 bp, Homo sapiens
  misc_feature: GYAE6OF02FW38H.49.46.E02.1.454.CMB.1.raw
  modified_base (418)..(418): a, c, t, g, unknown or other
  misc_feature (418)..(418): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagagtgttagtagcttcttagcctggtaaccaacaagaaacctggacccaggcctcccgaggcctcctcatctatgatgcatccaacgcgggccacgtggcactcccagccaggttcagtcggcaggtggtctgtgacagtacttcactctccacatcagcagcctagacgtcctagaagtacttcgngtcttaagttttacttacgttgtaccgagacgtaggtacgttagaccgtaaccgtcgggtaccccttaccgttaccgttaaccggttttccggggaccggggtaaccggggtaacccgtaagggggttacgggaacggtaacgttaaacccggtaaaaccgggtaaccggttagggtaccggggtacgtttaccgggaccctaacccgtacggtttcccgttacggttttaaccc

SEQ ID NO: 73946 - DNA, 498 bp, Homo sapiens
  misc_feature: GYAE6OF02GBQQ4.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaaacagggccactggcatcccagccaggttcagtggcaggtgggtctgtgacagacttcactctcaccatcagcagcctagagcctgaagattctgctagtttattactgtcagcagcgtagcaactgcctctcactttcggcggagggaccaggtggagatacaaacgaacgtgtggcgtcgccacatctgtc

SEQ ID NO: 73947 - DNA, 507 bp, Homo sapiens
  misc_feature: GYAE6OF02I5VY2.49.46.E02.1.454.CMB.1.raw
  modified_base (400)..(400): a, c, t, g, unknown or other
  misc_feature (400)..(400): n is a, c, g, or t
  modified_base (482)..(482): a, c, t, g, unknown or other
  misc_feature (482)..(482): n is a, c, g, or t
  modified_base (503)..(503): a, c, t, g, unknown or other
  misc_feature (503)..(503): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggctcccaggctcctcatctatgatgcatccaacagggccactggcatcccagccaggttcagtggcagtggtctgtgacagcttcactctcaccatcagcagcctagacgcctagaagacttcngtctagttttatacttgtacagcagtcgtagcaacgtcgcctctactcgtttcggcggacggacaggtgagatacaaacgtntggtgctcgacacctatcgtntacc

SEQ ID NO: 73948 - DNA, 507 bp, Homo sapiens
  misc_feature: GYAE6OF02HYABB.49.46.E02.1.454.CMB.1.raw
  modified_base (417)..(417): a, c, t, g, unknown or other
  misc_feature (417)..(417): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagccctggtaccaacagaaacctggccaggctcccaggctcctcatctatgatgcatccaacagggccactggcatcccagccaggttcagtggcagtggtctgtgacagtactcactctcaccatcagcagcctagagcctagaagtattctgctagtttatactgtcngcagcgtagcaactggcctctctcgtttcggcggaggaccgtaggtggaaggctacgaacgacgtagtggctggccaccattctgttacc

SEQ ID NO: 73949 - DNA, 552 bp, Homo sapiens
  misc_feature: GYAE6OF02FLP7I.49.46.E02.1.454.CMB.1.raw
  modified_base (356)..(356): a, c, t, g, unknown or other
  misc_feature (356)..(356): n is a, c, g, or t
tcagagtcgagagacacgaccggtgctcgatttagactcatctacagggaaagggggagggaactgctcagttaggacccagagggaaccatggaagccccagctcagcttctcttcctcctgctactctggctccagataccaccggagaaattgtgttgacacagtctccggccaccctgtcttgtctccaggggacagtgccaccctctcctgcagggccagtcagagtgttagagcttcttagcctggtaccaacagaacctggccaggctccaggcctcctcatctatgatcgcatccaacgacgggccacgtggcagtcccagccaggttcagtgcaggtggtctggtanacagacttcaacttctaccaccatcagcagcctagcgcctagaacgtacttcagacttagtttactacgtgtcagcagtcgtaagcctaacgtcgccttctaccgtaccgtttacgggcgggtacgggtaacctaagggtcggaagtaacgtacgaaacgtacgttggacgtctacgaccaccgtattcgtgttcc

SEQ ID NO: 73950 - DNA, 638 bp, Homo sapiens
  misc_feature: GYAE6OF02G5APN.49.46.E02.1.454.CMB.1.raw
  modified_base (266)..(266): a, c, t, g, unknown or other
  misc_feature (266)..(266): n is a, c, g, or t
tcagagtcgagagacacgaccggtgctcgatttagactcatctacagggaaagggggaggaactgtctcagttaggaccctaagagggaaccatggaagccccagctcagcttctcttccgtcctgctactctggcgtcccagataccaccggagaaattgtgttgacacagtctccggccaccctgtctttgtctccaggggacagtgccacctctcctgcagggccagtcgagagttgttagagcttcttagcctggtaccaanagaaacctggaccaggcctcccaggcctccgtcatctatgatgcataccaacgacgggccaacgtggcctactccccagcccgtaggttccaaggtcggacaggttcgggtactggtagaccgtaacggtactttacgaccttctaccaaccattccgaacgtacctacgtaccgttagggacgtacccgtaggaaacggtacggttacgtacgtacttagtttaacgttacgttcggtcgacgcaacgccgtagacctacgtccgtcctaccgttcgtaccgtttccggacggacgggaccgacggtcgaacgtacgtaaccgaaaccgtacgtcgtacggcgtcgacctaccgtagttccggtcttaccg

SEQ ID NO: 73951 - DNA, 594 bp, Homo sapiens
  misc_feature: GYAE6OF02HZEQE.49.46.E02.1.454.CMB.1.raw
  modified_base (236)..(236): a, c, t, g, unknown or other
  misc_feature (236)..(236): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggaataaattgtgttgacacagtctccggccacctgtcttgtctccgaggggacagtgccacctctcctgcaggccagcagagtgttagancttcttagcctggtaaccaagagaaacctgaccaggcctccgagctctacatctatgaactcgacctactaccgaacgacgggaccaagtcggaccactcccgaatccgaggttccagtcggacctggtcggtctggacacgtanccttacnctacgactacactcgacgacgagactagacgtacgtagacgtatctacgtattacgttactacgtactactacgtacgtacgtacgtacgtacgtacgtacgtacgtacgtacgtacgtacgtacggtacgtacgtacgtacgtacgtaacgtaacgtaacgtaacgtacgtacgtacgtacgtaccgtacgtacgtacgtatacg

SEQ ID NO: 73952 - DNA, 542 bp, Homo sapiens
  misc_feature: GYAE6OF02GCXTG.49.46.E02.1.454.CMB.1.raw
  modified_base (211)..(211): a, c, t, g, unknown or other
  misc_feature (211)..(211): n is a, c, g, or t
  modified_base (356)..(356): a, c, t, g, unknown or other
  misc_feature (356)..(356): n is a, c, g, or t
  modified_base (403)..(403): a, c, t, g, unknown or other
  misc_feature (403)..(403): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggcagtgccaccctntcctgcagggccagtcagagtgttagtagcttcttagcctggtaccaacagaaacctggccaggctcccaggctcctcatctatgatgcatccaacagggccacgtggcatcccagccaggttcagtggcagtgggtctgtgacngacttcactctcaccatcagcagcctagacgtcctgaaagtattccngctagtttattactgtcagtcaggcgttagactaacgtggtacctctctactttcggcggtaggacccgtagggtcggaagaacgtacgaaaccggtaactcggtacggcttacggacctaacacttacgtcgttaccg

SEQ ID NO: 73953 - DNA, 791 bp, Homo sapiens
  misc_feature: GYAE6OF02JGA6N.49.46.E02.1.454.CMB.1.raw
tcagagtcgagagacacgaccggtgctcgatttagactcatctacagggaaagggggaggaaagtgctcagttaggacccagagggaaccatggaagccccagctcagcttctcttcctcctgctactctggctcccagataccaccggagaaattgtgttgacacagtctccggccaccctgtctttgtctcccgaggggacagtcgcccaccctctcctgcacgggccagtccagagtgttaagtagcttcttacgccttggtaccaacagaaacctggccaggcctacccgaggtctcctcactctatgatcgcatccaaacgcgggaccacgtcggcacgtccccgaggaccctagggttccaaggttcgggacctaagggttccggggttccgtaggttacggaacgtagtaccgtttccaacgtttccgaccaaaccctagttacccgagtaccgaacggtacccttaacgggaaccgtaccccgtaagggtaaacgttaaacgtttccgtacgggtttacccttaaagggttttttaactttaaccgtttacggttaccgtaacggtccgtaaacggttaccgggttaacggtaacccgtaaaccggtttcgggttaacccttaccgttaccgttaaccggttttcccggggtaaccgggaacgggggtaaccccgtaagggggttacgggtaacggtaaccgttaaccggaaaaccggtaacgttacgggtacgggtaccgttaccgggaccgtaacccgttacggtacccttggtttacccg

SEQ ID NO: 73954 - DNA, 606 bp, Homo sapiens
  misc_feature: GYAE6OF02G7TMB.49.46.E02.1.454.CMB.1.raw
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttctagcctggtaccaacagaaacctggaccaggcctcccgaggcctcctcatctatgatgcactaccaacgacgggccacgtcggactactccccagcccgtaggttccaggtcgctagggtgggtctgtagacagtaccttcacttctacacctatcagcacgccgtagacnccgtagaatnttcgtagtacttaagtttacttactcgttacagtacgtaggacgtagacctaacgtcgtacccttcgttaccgttaccggtttcgggaaccgggtacgggtaccgtagggtaggaacgtaacgtaaccgaaacggtactaggtacggctacggacctaccgtacgttacgttacgttacc

SEQ ID NO: 73955 - DNA, 661 bp, Homo sapiens
  misc_feature: GYAE6OF02JEWHK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcgttagcctggtaccaacacgtaaacctggccaggcctcccaggctcctcatctatgatcgcatccaacgagggcccacgtggcaacgtcccagtccgaggttcagtcggcgtaggtggggtctggtacgacgtacgacctttcgaaccttccgtaccaccagttaccgaaggtaccaacgtccgtaacggtccgacccgttaggaacgttacgttcgtacggtaccgttaagttttacgtttaacgttcgtacccgtaaggtacctaggtaccgttaacgtaccgtaaccgtcggtacccttcgtaccttaccgggtttcggaccgggtaacggaacccggtagggtcgggaacgtacgtaaaccgaacggtaacgtgggtacgtaacggtcgtactaaccgcgttacgtcgtaccg

SEQ ID NO: 73956 - DNA, 599 bp, Homo sapiens
  misc_feature: GYAE6OF02F4UOQ.49.46.E02.1.454.CMB.1.raw
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
  modified_base (479)..(479): a, c, t, g, unknown or other
  misc_feature (479)..(479): n is a, c, g, or t
tcagagtcgagagacacgaccggtgctcgatttagactcatctacaggggaaagggggaggaactgctcagttaggacccgagagggaaccatggaagccccagctcacgcttctcttcctcctgctactctggctcccagataccaccggacgaaagttgtgttgacacagtcctccggccaccctgtcctttgtctccaggggacagtgccaccctctccgtgcagggccagtcagagtcgttagagcttcttagtcctggtaccaacagaaacctggacctaggctcccaggtcctcctcatctancgatgcatccaacgnggccacgtggcagtcccagcctaggttcacgtgctagtcggtctgtcgacgtaggacttcgactctccacctatcacgcagtccagcgacctagaacgtattcgtgactagtttactacgtgtacagtctagtcgtagactaacgtcgtaccttntaccgttacgtttcggaccgggaacgggtacccgtagggtacggaacggtaacgttaacggaaaaccggtacgtggtaacggaccttacggaacctaccgtaacttccgtagttaccccg

SEQ ID NO: 73957 - DNA, 498 bp, Homo sapiens
  misc_feature: GYAE6OF02GWJML.49.46.E02.1.454.CMB.1.raw
  modified_base (492)..(492): a, c, t, g, unknown or other
  misc_feature (492)..(492): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggcaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcaggtgggtctgtgacagtcttcactctcaccatcagcagcctagacgcctagaagtattctgctagtttacttacgtgtcagcagcgtagcacgtgcctctctacgttcggcggacggaccaggtgagatacgaaacgactgtgctgccacntctgtc

SEQ ID NO: 73958 - DNA, 645 bp, Homo sapiens
  misc_feature: GYAE6OF02JMJGD.49.46.E02.1.454.CMB.1.raw
  modified_base (308)..(308): a, c, t, g, unknown or other
  misc_feature (308)..(308): n is a, c, g, or t
tcagagtcgagagacacgaccggtgctcgatttagactcatctacagggaaaggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatcgatgcatccaacncgggccactggcatcccagccaggttcagtggcagtggtctgtagactagacttcactctcaaccatcaagtccaagtcctaacgacgcccttagaaaggttacttctacgtcgtaaaggtttttacttaaccgttacgttactagtaccgaacggtcggttaacggtaccctaaaccgttcggggtaccctttccgttaccgtaccggtttttacccgggaccggggaacgggtaaccccgtaagggtttacgaacggtaacgttaaccggaaccgttaaaaccgttggtacggttacgtcggtacccgtaaccgtacgtttccgtacggtttccg

SEQ ID NO: 73959 - DNA, 532 bp, Homo sapiens
  misc_feature: GYAE6OF02HQZMV.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcagtggtctgtgacagacttcactctcaccatcagcacgcctagacgacccgaagattctgctagtttattacttgtcagacagcgtagactaacgtggactatctactacgtttcggacgggtagggaccgagggtggaagacgtaacgaaacgtaacgtggtggtactcgaccaccgtacttcgtgttacc

SEQ ID NO: 73960 - DNA, 540 bp, Homo sapiens
  misc_feature: GYAE6OF02HFZ1T.49.46.E02.1.454.CMB.1.raw
  modified_base (309)..(309): a, c, t, g, unknown or other
  misc_feature (309)..(309): n is a, c, g, or t
  modified_base (391)..(391): a, c, t, g, unknown or other
  misc_feature (391)..(391): n is a, c, g, or t
  modified_base (402)..(402): a, c, t, g, unknown or other
  misc_feature (402)..(402): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccacgtggcatcccagccaggttcagtggacaggtgggtctgtagacagacttcactctacacatcagcagcctagacnccgtagaacgnttctgtacttagttttaacttactgtacagcagcgtagcctacgtcggtccttcgtctacgtttccggacggtagggaccagggtcggagactacgaaacgtacgtcgtaggctacggactaccgtattcgtgttacc

SEQ ID NO: 73961 - DNA, 550 bp, Homo sapiens
  misc_feature: GYAE6OF02GEUWS.49.46.E02.1.454.CMB.1.raw
  modified_base (310)..(310): a, c, t, g, unknown or other
  misc_feature (310)..(310): n is a, c, g, or t
  modified_base (402)..(402): a, c, t, g, unknown or other
  misc_feature (402)..(402): n is a, c, g, or t
tcagagtcgagagacacgaccggtgctcgatttagactcatctacagggaaagggggaggaactgctcagttaggacccgagagggaaccatggaagccccagcctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaangggccatggcatcccagccaggttcagtggcagtgggtctgtgacagacttcactctcaccatcagcagcctagacgcctagaagtattcgngactagtttatacgtgtacagcagtcgtagcaacgtcggccttcgtcctacgtttcgggacggacgggaccgtaagggtggaacgtaacgtaacgaaaaccggtacgttaggtcggacttcggacctacctagttccttaggttaccc

SEQ ID NO: 73962 - DNA, 573 bp, Homo sapiens
  misc_feature: GYAE6OF02ILF5R.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgagggccacgtggcatccccagccaggttcagtggcaggtgggtctgtgacagacttcactctcaccatcagcagcctagacgcctaggaagtattctgtacttaagttttacttactgtcagcagtcgtagacaacgtcgccttcgtctaccgtttcgggaccgggtaacgggaccgtaaggggtggaggtaacgtaaccgaaaacggtaacgtcggtacggtacgttacggacctaaccgtacgtttccgttagttttacccg

SEQ ID NO: 73963 - DNA, 556 bp, Homo sapiens
  misc_feature: GYAE6OF02H5ED5.49.46.E02.1.454.CMB.1.raw
  modified_base (311)..(311): a, c, t, g, unknown or other
  misc_feature (311)..(311): n is a, c, g, or t
  modified_base (416)..(416): a, c, t, g, unknown or other
  misc_feature (416)..(416): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagtcttcttagcctggtaccaacagaaacctggccaggctcccaggctcctcatctatgatgcatccaacngggccactggcatcccagcaggtcagtggcaggtggtctgtgacagacttcactctcacatcagcagcctagacgcctagaagattctgcttaagtttatttacngttcagtacagtcgtaagcaaccgtggcccttctcgtaccgtttccgggacgggaacgggtacccaaggggttggaacgtacgtaacaaaccggtagtcggttggacttcggaccaacccgttatcccgtaggtttaccc

SEQ ID NO: 73964 - DNA, 628 bp, Homo sapiens
  misc_feature: GYAE6OF02GFSLI.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagagcttcttagcctggtaccaacagaaacctggccaggcctccaggctcctcatctatgatgcatccaacgacgggaccacgtcggcactccccagcctaggttcaggtcggctaggtcggggtctggtagacgacgtacttcactctaccacctatcgacgcagtccgtagacgacctagaatacttcgtgacttaaggttttacttacgttcgtacacgtacacggtcgtaacgtacctaaccgtcgtacccttcgttacgtaccggtttccgggaacggggtacgggaacccggtaagggtcggtaacggtaaccgtaacggtaaaacccggtacgttacggtacggtaccgtacggtacctaaccgtacgttccgtacggtttaacc

SEQ ID NO: 73965 - DNA, 549 bp, Homo sapiens
  misc_feature: GYAE6OF02HQYHH.49.46.E02.1.454.CMB.1.raw
  modified_base (263)..(263): a, c, t, g, unknown or other
  misc_feature (263)..(263): n is a, c, g, or t
  modified_base (362)..(362): a, c, t, g, unknown or other
  misc_feature (362)..(362): n is a, c, g, or t
  modified_base (407)..(407): a, c, t, g, unknown or other
  misc_feature (407)..(407): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaaanagaaacctggccaaggcctcccgaggcctcctcatctatgatgcatccaaacgagggccactggcactcccagccaggttcagtggcaggtgggtctgngacagacttcactctcacatcagcagcctgcagttctagtaagtnttttagcttaagtttattactgtcagtctaagttataagtcggtccggtcgtccggtacgtacgtttcggggacgaacgggacgaagggtggagtaagtacgaaacgtaacgtggtacggctacgcaactatcttgtctccg

SEQ ID NO: 73966 - DNA, 508 bp, Homo sapiens
  misc_feature: GYAE6OF02HHUY8.49.46.E02.1.454.CMB.1.raw
  modified_base (488)..(488): a, c, t, g, unknown or other
  misc_feature (488)..(488): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacagggccactggcatcccagccaggttcagtggcagtgggtctgtgacagacttcactctcaccatcagcagcctagacgcctgaagattctgcagtttatactgtcagcagcgtagcaactggccttctactacgtttcggcggagggaccaagggtggagaataccgaaaacgaactggnggctgacctaccatctgtcc

SEQ ID NO: 73967 - DNA, 638 bp, Homo sapiens
  misc_feature: GYAE6OF02JW246.49.46.E02.1.454.CMB.1.raw
  modified_base (404)..(404): a, c, t, g, unknown or other
  misc_feature (404)..(404): n is a, c, g, or t
tcagagtcgagagacacgaccggtgctcgatttagactcatctacagggaaagggggagggaacgtgctcagttaggacccagagggaaccatggaagccccagctcagcttctcttcctcctgctactctggctccagataccaccggagaaattgtgttgacacagtctccggccacctgtctttgtctccgaggggacagtgcccaccctctcctcgcagggccagtcagagtgttagtagcttcttagccttggtaccaacacgaaacctggaccaggcctccccaggcctccgtacatcctagcgtatcggaccactccaaacgacgggccctacgtggcaacgtcccaacgcctaagggtttcccaaggttcggcctagggtcggtcctggtcgaaancgtacttcactcgtccacctatcagacacgtacctagcgacctagaacgtacttcgtacgtacgtagtttactttacgtcgtactacgtacgacgtacgtagaccgtaaccgtacgtcccgttacttcctaccgtttcggacgggtaccgggtaaccgagggtacggtaagtacgtaacgtaacgtaacgttcggtacggtcgtacgtaccgaaccgtacgttactcgttaccg

SEQ ID NO: 73968 - DNA, 561 bp, Homo sapiens
  misc_feature: GYAE6OF02HQ5W7.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctggtgacagacttcactctcaccatcacgcacgcctagacgcctagaagtattctgctagtttattactgtcagcagcgtagacaacgtgtcctcgtcctacgtttcggcgggtaacgggaccgtaggggtcggaacgtaacgtaccgaaaaccggtaacgttacggtcgggtaccgtacggacctaacccgtacgttcgttccgtttaccc

SEQ ID NO: 73969 - DNA, 503 bp, Homo sapiens
  misc_feature: GYAE6OF02GJTZV.49.46.E02.1.454.CMB.1.raw
  modified_base (212)..(212): a, c, t, g, unknown or other
  misc_feature (212)..(212): n is a, c, g, or t
  modified_base (289)..(289): a, c, t, g, unknown or other
  misc_feature (289)..(289): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctntcctgcagggccagtcagagtgttagtagcttcttagcctggtaccaacagaaacctggccaggctccaggctcctnatctatgatgcatccaacaggccatggcatcccagccaggttcagtggcaggtggtctgtgacagacttcactctcaccatcagcagcctagagcctgaagacttctgctagtttacttacttgtcagcagcgtagacaacgtcgccttctctacctttcggcggaggaccagggtggagatacaaacgactgtggctgacaccgatctagttc

SEQ ID NO: 73970 - DNA, 568 bp, Homo sapiens
  misc_feature: GYAE6OF02F258Z.49.46.E02.1.454.CMB.1.raw
  modified_base (312)..(312): a, c, t, g, unknown or other
  misc_feature (312)..(312): n is a, c, g, or t
  modified_base (416)..(416): a, c, t, g, unknown or other
  misc_feature (416)..(416): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggcctcctcatctatgatgcatccaacgnggccacgtggcactccccagccaggttcaggtcggcaggtgggtctggtagacagtacttcactcctcacctatcagcagcctaaggcgcctagaagtacttcngtacttaagttttactacttgtacagtcaggtcgtacgactacgtcgtccttctcgtacgtttcgggacgggaacgggaccgtagggtacggagaacgtaacgaaacggtacgttgggtacggtcttcgacccgaacctagttcctgttacc

SEQ ID NO: 73971 - DNA, 599 bp, Homo sapiens
  misc_feature: GYAE6OF02JFFFL.49.46.E02.1.454.CMB.1.raw
  modified_base (376)..(376): a, c, t, g, unknown or other
  misc_feature (376)..(376): n is a, c, g, or t
  modified_base (388)..(388): a, c, t, g, unknown or other
  misc_feature (388)..(388): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtcctccgaggggacagtgcccaccctctcctgcagggccagtcagagtgttagtacgcttcttagcctggtaccaacacgaaacctggccaggcctcccgaggcctcctcactctatgatgcactccaacgacggccacgtggaccactcccagccgtaggttcaggtcggcgaggtggtctgtgacngtacttcactcncacatcgagcacgaccgtagacgtacctgaacgtacttcgtacgtacttaagtttacttacgtcgtaccagtccgaggtacctaggtaccaacggttccggaccttccgttacgtaccgggtttcggacggtacggggaacctaggggtaacggagtaaccgtaacgaaacggtacgtggacggtcacggcctaacgcgttcgtcgttacc

SEQ ID NO: 73972 - DNA, 539 bp, Homo sapiens
  misc_feature: GYAE6OF02HJYTX.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcactcccagccaggttcagtggcagtgggtctgtgacagtacttcactctacaccatcagcagcctagacgcctagaaagtattcgtgactagtttaacttacgtcgtcagcagcgtagcaacgtgcctctctacgtttcggcggtacggaccgagggtggagtaacgtaccgaaacgtaacgtggtacggtctacggccaaccgtagttcctggttacc

SEQ ID NO: 73973 - DNA, 535 bp, Homo sapiens
  misc_feature: GYAE6OF02IXMV6.49.46.E02.1.454.CMB.1.raw
  modified_base (246)..(246): a, c, t, g, unknown or other
  misc_feature (246)..(246): n is a, c, g, or t
  modified_base (382)..(382): a, c, t, g, unknown or other
  misc_feature (382)..(382): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
  modified_base (433)..(433): a, c, t, g, unknown or other
  misc_feature (433)..(433): n is a, c, g, or t
  modified_base (530)..(530): a, c, t, g, unknown or other
  misc_feature (530)..(530): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttnttagcctggtaccaacagaaacctggccaggctcccaggctcctcatctatgatgcataccaacgacgggccacgtcggcactcccacgccaggttcaggtggcaggtgggtctgtgacagtacttcactctcacntcagcancctagcgctagaatnttctgacttagtttacttactgtacacgnaggtctagctaacgtcgccttctcgtacgttcggacggtacggaacgaggtaggacgaatacgaaacgtacgtaggtgacgtcgaccacctatcgtnttacc

SEQ ID NO: 73974 - DNA, 622 bp, Homo sapiens
  misc_feature: GYAE6OF02HIWON.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatcgcactccaacgacgggccacgtggcactcccagccaggttcaggtggcagggtgggtctgtcgacgacgtacttcactctaccgacctatccaacgccagcccgtaagacgtaccgttaggaaacgtagttcgtagtacttaaggttttaacttacgtcgtcaagcgtacggcgtaagaccaacgtcggccttccgttaccgtaccggtttccggacggggtaacgggacccgtaagggtacggtaacggtaagttaaccgaaaacgggtaccgttaggtacggacgttacgaccgtaacccgtacgttcgtcggtttacc

SEQ ID NO: 73975 - DNA, 590 bp, Homo sapiens
  misc_feature: GYAE6OF02I1X5Y.49.46.E02.1.454.CMB.1.raw
  modified_base (321)..(321): a, c, t, g, unknown or other
  misc_feature (321)..(321): n is a, c, g, or t
  modified_base (374)..(374): a, c, t, g, unknown or other
  misc_feature (374)..(374): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcancccagccaggttcagtggcagtggtactgtgacagtacttcactctacacctntcagcagcctagatcctgaancttcncgattagtttaattacgtgttacagtcagtcgtagacctaacgtccgggccttctacccgttaccggttttccgggaacggggtaacgggtaaccgtaaggggttcggaacggtaacgttaaccgaaaaacgggtacgttacgggtacggtaccgttcggaacccgtaaccctagttccttcggtttacc

SEQ ID NO: 73976 - DNA, 550 bp, Homo sapiens
  misc_feature: GYAE6OF02HHLPL.49.46.E02.1.454.CMB.1.raw
  modified_base (395)..(395): a, c, t, g, unknown or other
  misc_feature (395)..(395): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaacctggccaggctcccaggctcctcatctatgatgcataccaacagggccacgtggacactcccagccaggttcaggtggctaggtgggtctgtgacagtacttcactctcacctatcagcacgctagacnctagaatacttctgactagtttactactgtcagcacgcgtagacaacgtcggtcctcgtcctacgtttcggacggtacggtaccgagggtcgaggtaactaccgaaacgtaacgtagtacggtacgtacggacctaccgtactaccgtcttaccg

SEQ ID NO: 73977 - DNA, 559 bp, Homo sapiens
  misc_feature: GYAE6OF02JCNKF.49.46.E02.1.454.CMB.1.raw
  modified_base (414)..(414): a, c, t, g, unknown or other
  misc_feature (414)..(414): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaagagaaacctggccaggctcccgaggctcctcatctatgatcgcatccaacagggccaacgtggcactcccagcctaggttcagtggcaggtgggtctgtcgacagtacttacacgtctaccaccatcagtcgagccttagactccgtagaagtnttctagcttagtttacttacgtgtacagcagtcgtagactaacgtcgtcctcgtctacggtttccggacggacgggtaaccgagggtcggagtaactaccgaaacggtactggtgaccgtcgacctaccgataccgttgttaccg

SEQ ID NO: 73978 - DNA, 553 bp, Homo sapiens
  misc_feature: GYAE6OF02GKQZD.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtgcaggtggtctgtgacagacttcactctcaccatcagcagcctagacgcctagaagtattcgtgactagttttacttacgttgtcagcagcgtagacaacgtggcctcgtcctacgtttcggacggtacgggacctagggtacggagtacgttaaccgaaaacggtaacgttggtacggtaccgttcggaccgtacccgtagttcctaggttacc

SEQ ID NO: 73979 - DNA, 548 bp, Homo sapiens
  misc_feature: GYAE6OF02HFNBR.49.46.E02.1.454.CMB.1.raw
  modified_base (310)..(310): a, c, t, g, unknown or other
  misc_feature (310)..(310): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgngggccactggcatcccagccaggttcagtggcaggtgggtctgtgacagtacttcactctcaccatcagcagcctagacgcctagaagtnttcgngtctaagttttattacgttgtacagtcaggtcgtagccagtcgccttcgtctcggttcgggacggtacgggaccgtagggtcggaagacgtaaccgaaacggtaacgtggtacggcgtacggacctaccgtattccgtgttcc

SEQ ID NO: 73980 - DNA, 533 bp, Homo sapiens
  misc_feature: GYAE6OF02GA6RE.49.46.E02.1.454.CMB.1.raw
  modified_base (311)..(311): a, c, t, g, unknown or other
  misc_feature (311)..(311): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctcatctatgatgcatccaacgngggccacgtggcactccccagccaggttcaggtcggctaggtgggtctggtgacagtacttcactctcaccatcagcagcctagacgcctagaagtattctgcttagtttattactgtcagcagtcgtagcaacgtcgccttctctacgttcggcggacggacgtagggtggagtacgtacgaaacgtacgtggtacggctcgacctaccgacgttctgttc

SEQ ID NO: 73981 - DNA, 575 bp, Homo sapiens
  misc_feature: GYAE6OF02I7UNI.49.46.E02.1.454.CMB.1.raw
  modified_base (387)..(387): a, c, t, g, unknown or other
  misc_feature (387)..(387): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgacgggccacgtggccactcccagccaggttcagtcggcaggtgggtctggtcgacacgtcttacaccttctacaaccntacacgcacgcctagacgcctagaacgtacttcacgtctaagttttacttactcgttactacgctacgcgtagactaaccgtcgtcccttactcgttaaccgtttcgggaccgggtaacgggacgtaacgggtggaacgacgtaaccgaaacgtactggtcgactcggtaccaccgtattctcgttac

SEQ ID NO: 73982 - DNA, 661 bp, Homo sapiens
  misc_feature: GYAE6OF02JN0TW.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcttagccttggtaaccaacgagaaacctggacccaggctccgaggctcctcatctatgatgcactccaacagggccatcggcactcccaagcctaggtcagtcggcagtgggtctgtagacagtacttcactctacgtaccatacagtccaggccctagacgtccgtagtaaacgtacttcgtagaccttaggtttaactttacctggtaccgagtactaacggtcgttaacgctaaacccgtcggtccctttaccgtcgttaaccggtttccgggaccggggtaacgggtaacccttaggggtacggtaaaaccggttcggtaaaccgttaaaaccgggtaaaccgttcggggtaaccgggttccttaaccgggtaaccttaacccggtaacgttttcccgtacggttttaaccccg

SEQ ID NO: 73983 - DNA, 552 bp, Homo sapiens
  misc_feature: GYAE6OF02IGSRS.49.46.E02.1.454.CMB.1.raw
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (350)..(350): a, c, t, g, unknown or other
  misc_feature (350)..(350): n is a, c, g, or t
  modified_base (394)..(394): a, c, t, g, unknown or other
  misc_feature (394)..(394): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttctagcctggtaccaacagaacctggccaggctcccaggctcctnatctatgatgcatccaacngggccactggcatcccagccaggttcagtgcaggtggtctgtnacagacttcactctcacatcagcagcctagagcctgaatcttcngtactaagttttatactgtcagcaagcgtagacctaatcggtcctctcgtaccgtttcgggaccgggtaagggaccaaggggtggaacggtaactaaccgaaaacggtaccgttggtcggaccgttacggaccctaacctagttccctaggtttaccc

SEQ ID NO: 73984 - DNA, 584 bp, Homo sapiens
  misc_feature: GYAE6OF02H4EJN.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtccagagtgttagtagcttcttagcctggtaccaacagaaacctggccaggctccccgaggctcctcatctatgatgcatccaacaggggcccacgtcggccactccccgagccgaggttccaggtcggcaggttggggtctggtcgacagacttcactctacacatcacgcacgcctagacgcctagaagtacttctgtcttagttttactttacgttagtcagacagacgtagacctaacgtcggtaccctcttcctaccggtttcggacgggacgggtaccgagggtaggacgaacgtaccgtaaacggtacgttaggtcggccttacggaccacccgtattccgtacggttacc

SEQ ID NO: 73985 - DNA, 508 bp, Homo sapiens
  misc_feature: GYAE6OF02FZPMD.49.46.E02.1.454.CMB.1.raw
  modified_base (212)..(212): a, c, t, g, unknown or other
  misc_feature (212)..(212): n is a, c, g, or t
  modified_base (384)..(384): a, c, t, g, unknown or other
  misc_feature (384)..(384): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctntcctgcagggccagtcagagtgttagtagcttcttagcctggtaccaacagaaacctggccaggctcccaggctcctcatctatgatgcatccaacaggccactggcatcccagccaggttcagtggcagtgggtctgtgacagacttcactctcaccatcagcagcctagngcctgaagattctgctagtttatactgtcagcagctagcaactggcctctcactttcggacggagggaccaggtggagtaactacgaaacgactgtacggctggcctaacgattccgtgttacc

SEQ ID NO: 73986 - DNA, 561 bp, Homo sapiens
  misc_feature: GYAE6OF02F2M5K.49.46.E02.1.454.CMB.1.raw
  modified_base (392)..(392): a, c, t, g, unknown or other
  misc_feature (392)..(392): n is a, c, g, or t
  modified_base (400)..(400): a, c, t, g, unknown or other
  misc_feature (400)..(400): n is a, c, g, or t
  modified_base (404)..(404): a, c, t, g, unknown or other
  misc_feature (404)..(404): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagagcttcttagcctggtaccaacagaaacctggccaggcctcccaggctcctcatctatgatgcatccaacgacgggccactggcactcccagccaggttcaggtggcaggtgggtctgtgacagtacttcactctcaccatcagcagcctagcnctgaagtnttcngactagtttactacttgtcagcagtcgtagactaacgtcggaccttcgttacctaccgtttcgggacggtaacgggaacccgtagggtcgggaagtaacgtaaccgaaacggtaaccgttggtacggtctacggcctaacctagttcctagtttacc

SEQ ID NO: 73987 - DNA, 527 bp, Homo sapiens
  misc_feature: GYAE6OF02GTC95.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctcatctatgatgcatccaacagggccatggccatcccagccaggttcagtggcaggtgggtctgtgacagacttcactctcaccatcagcacgtcctagacgcctagaagattcgtgctagtttacttactgtcagcagcgtagcaacgtcgtcctctctacgttcggacggacgggaccgtagggtgagtaatacgaaacgtacgttagcggtactcggacaccgtattcgtgttcc

SEQ ID NO: 73988 - DNA, 535 bp, Homo sapiens
  misc_feature: GYAE6OF02HNF4Q.49.46.E02.1.454.CMB.1.raw
  modified_base (350)..(350): a, c, t, g, unknown or other
  misc_feature (350)..(350): n is a, c, g, or t
  modified_base (395)..(395): a, c, t, g, unknown or other
  misc_feature (395)..(395): n is a, c, g, or t
  modified_base (529)..(529): a, c, t, g, unknown or other
  misc_feature (529)..(529): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacaggccactggcatcccagccaggttcagtgcagtggtctgtnacagacttcactctcaccatcagcacgcctagacgcctagaagtnttctgctaagtttattactgtcagtcaggctagactaacgtcgtcctactcgtaaccgttggaccggtaagggaccgtagggtggaacgtaataccgaaaggtaccgttggtaggctcgacctaccgtattcgngttacc

SEQ ID NO: 73989 - DNA, 541 bp, Homo sapiens
  misc_feature: GYAE6OF02G9Y1Q.49.46.E02.1.454.CMB.1.raw
  modified_base (309)..(309): a, c, t, g, unknown or other
  misc_feature (309)..(309): n is a, c, g, or t
  modified_base (351)..(351): a, c, t, g, unknown or other
  misc_feature (351)..(351): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggcctcctcatctatgatgcatccaancgggccatcggcatcccagccaggttcagtgcagtggtctgngacagcttcactctcaccntcagcagcctagncctgaatacttctgctaagtttattacgtgtcagcagcgtagactacgtcgtcctctaccgtacggtttcggcgggtacgtaccggaggtcggaacggtactaaccgaaacggtacgttcggttacgcgttcgacctacctacgttccgttattcccg

SEQ ID NO: 73990 - DNA, 539 bp, Homo sapiens
  misc_feature: GYAE6OF02GFXDE.49.46.E02.1.454.CMB.1.raw
  modified_base (309)..(309): a, c, t, g, unknown or other
  misc_feature (309)..(309): n is a, c, g, or t
  modified_base (432)..(432): a, c, t, g, unknown or other
  misc_feature (432)..(432): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccactggcatcccagccaggttcagtggcaggtgggtctgtgacagacttcactctcaccatcagcagcctaagacgcctagaagtacttctgactagtttattactgtcagcagcgtancaacgtcggccttctctaccgtttcgggacggacgggacctagggtcggaagaactaaccggaaacgtacgtaggtacggctacggaccaccgtattccgtgttacc

SEQ ID NO: 73991 - DNA, 600 bp, Homo sapiens
  misc_feature: GYAE6OF02JJFPG.49.46.E02.1.454.CMB.1.raw
  modified_base (400)..(400): a, c, t, g, unknown or other
  misc_feature (400)..(400): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggctcccagctcctcatctatgatgcatccaacgcgggccacgtggcactcccagcctaggtcagtcggcaggtgggtctgtgacagtacttcactctccacctatcagcacgcctagcgcctanaagtacttcgtgacttagtttacttacgtcgtacagtcacgtcgtacgccaaaccgtcggtacccttccgttactaccggtttcgggaccgggtaacgggaaccgtacggggttacggaacgtaacgtaaccgaaaacggtacccgttagggtacccggtacgtccggtacctaacccgaccgtttacgttcggttaccg

SEQ ID NO: 73992 - DNA, 683 bp, Homo sapiens
  misc_feature: GYAE6OF02HYTZK.49.46.E02.1.454.CMB.1.raw
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
tcagagtcgagagacacgaccggtgctcgatttagactcatctacagggaaaggggaggaacgtagctcagttaggacccagaggaaccatggaagcccagctcagctctctcctctgctactctggctcccagactaccaccggagaaattgagttgacacagtctccggccaccctgtcttgcctccgagggacagtgccctacctctcctgcagggccagtcaggacgtgttagagtcttcttagcccttggtaccaatacgaaaccgtcggaccaagggcctacccgaggcctccgtcatcctatgaatcgcactaccaacgacggtacctacgtggcctaactccccgagacccgtaacggttcaacggttcgggactacgggtacggggttcctaggtcgtaacgacggtaacctttcgaaccttccgtaccaccgaatttccgaagccgaacgtccgtaacgtacgcctacggtaaanacgtttaaccgngtaacgttaagtttaacttacgtagttacgaacgtcgaagtaccgtaacgtacctaacggtcgtacctaccttacgttaccggttaggaccgggtacgtaaccggtaagggtccggaagtaaccgtaacgtaaaccggtacgttacggtacgtcggtacacccgtaacgtactaccgtgttacccg

SEQ ID NO: 73993 - DNA, 570 bp, Homo sapiens
  misc_feature: GYAE6OF02HYI51.49.46.E02.1.454.CMB.1.raw
  modified_base (288)..(288): a, c, t, g, unknown or other
  misc_feature (288)..(288): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccagcctccaggctccncatctatgattcatccaagacgggccacgtggacatcccagcctaggttcagtggctaggtgggtctgtgacagtacttcactcacaccatcagcacgcctagacgtcctagaacgtattcgtgtactaagttttacttaactgtacagacacggtcgtagacaacgtcgtcctcgtctaccgtttcggacggtacgggaccgaagggtaggagtaacgtacgtaaacgaacgtcggtacggtacgtcggacctacctaacgttcgttacgttaccttaccg

SEQ ID NO: 73994 - DNA, 617 bp, Homo sapiens
  misc_feature: GYAE6OF02IKCZZ.49.46.E02.1.454.CMB.1.raw
  modified_base (290)..(290): a, c, t, g, unknown or other
  misc_feature (290)..(290): n is a, c, g, or t
  modified_base (308)..(308): a, c, t, g, unknown or other
  misc_feature (308)..(308): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctnatctatgatgcatccaanagggccatggcatcccagccaggttcagtggcaggtggtctgtgacagacttcactctcaccatcagcagcctagacgcctagaaacgtnttcgnggtacttaagttttacttacgttcgtacgagcctaaggtccgttaagactaaaccgttcgggtacccttcgttaccttaaccgggttttaccggggaccggggtaaacgggtacccggtaaaggggttcgggaacggtaacttaaccggaaaaacggtacgttgggtacgggtaccttacgggacctaacccgtagttccgttacggtttaccc

SEQ ID NO: 73995 - DNA, 901 bp, Homo sapiens
  misc_feature: GYAE6OF02H0SSQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagataccaccggaagaaattgtgttgacacagtcctccggccacccttgttctttgtcctaccgaggggacagtcgcccaccctctcctgcgacgggccagtcagtagtgttagtagtcttacgttagccgtaggtaaccaaacgaacgtaaacctcggaccaacgggtcctcccgaaggcctaccctcaacttcctaagtcggaatcgacctaacgtacccgaaacggacgggtaccctacgtacgggacctaccgttacccgaacggtccgtaacgggtttaccacggttacgggacgttacggggttcggggttccgttaggtacggaaccgtaacgtttacccttaccgtaaccgttaccctaccgtaacccgaagtttaccgaaccgtacgtaaccggtaacccgttaacgggaacccgtacggtttaaacggaaaacgtttacgttacggttccgtaacgtttaaacgttttttaacgtaccgttacggttaacgtaaccgggtacgtaaccgggtacggtttaaaccgaacccgtttaaaccgggttcccgggttaaccctttaccggttaacccgtttaacccgggtttacccggggaaaccggggtttaaccggggtaaaacccgggttaagggggtaacggtaacgtaaaccgggttaaacccgtaaaaaccgggttacgtttaacgggggacccggttaacgtacccgggtaaccccttaaaccgtaacggtttacccttacgggttttaccc

SEQ ID NO: 73996 - DNA, 654 bp, Homo sapiens
  misc_feature: GYAE6OF02IIRBT.49.46.E02.1.454.CMB.1.raw
  modified_base (261)..(261): a, c, t, g, unknown or other
  misc_feature (261)..(261): n is a, c, g, or t
  modified_base (291)..(291): a, c, t, g, unknown or other
  misc_feature (291)..(291): n is a, c, g, or t
  modified_base (313)..(313): a, c, t, g, unknown or other
  misc_feature (313)..(313): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgagggacagtgcccacctctcctgcagggccagtcagagtgttagtagcttcttagcctggtaccaanagaaacctggccaggctcccgaggctcctnatctatgatgcactcgaaacgnggcctacngccaatccccagccaggttcagtgcaggtgggtctgtanacagactttccaactctacaccctaancgaacgcagaccgtagacgtccgtaagaaggtaacttccgtagtacctaaggttttaactttaaccgtgttaccgaagaccgtaagccggtttaaagacccgtaaacgttcggtcccttacgttaccgttaacccggttttccggggaaccgggaaaggggtaaccccgtaaggggttgggtaaaccgaacggttaacccaaaaacgggtaaacccgtttggacgggtccgttaagacccgtaaccgttacgtaccttgttaacccg

SEQ ID NO: 73997 - DNA, 584 bp, Homo sapiens
  misc_feature: GYAE6OF02I4C8J.49.46.E02.1.454.CMB.1.raw
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctccgaggctcctcatctatgatgcatccaacgnggccacgtgccactcccgagccgtaggttcaggtcggctaggtcgggtctgtagacagtacttcactcncactatcagcacgactagacgtctagaaatnttcgngtacgttaattttacgtactgtactaacgtctaacggccgttaagacctaaccgttcggacccttcgttacctacggtttccgggaacgggtacggtaaccgaggggttagaacgtaataaccgaaacggtactggtacggctcggacctaccgtagttctacgttcg

SEQ ID NO: 73998 - DNA, 555 bp, Homo sapiens
  misc_feature: GYAE6OF02GD2Z8.49.46.E02.1.454.CMB.1.raw
  modified_base (399)..(399): a, c, t, g, unknown or other
  misc_feature (399)..(399): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccagctcctcatctatgatgcatcccaacagggccactggcactcccagcccaggttcagtggcaggtggtctgtgacagtcttcactctcaccatcagcagcctagacgcctagaagtnttctgacttagtttacttacttgtcagcagacgtagaccaacgtcgtaccctctccgtacgtttcgggacgggaacgggaccgagggtggaacgtacgtaaccaaaaccggaacgttggtacgggtccttacggaccctacctactcgtgttaccc

SEQ ID NO: 73999 - DNA, 541 bp, Homo sapiens
  misc_feature: GYAE6OF02HDTWP.49.46.E02.1.454.CMB.1.raw
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
  modified_base (375)..(375): a, c, t, g, unknown or other
  misc_feature (375)..(375): n is a, c, g, or t
  modified_base (400)..(400): a, c, t, g, unknown or other
  misc_feature (400)..(400): n is a, c, g, or t
  modified_base (436)..(436): a, c, t, g, unknown or other
  misc_feature (436)..(436): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcttgtctccaggggacagtgccaccctctcctgcagggccagtcagagtgttagtagcttcttagcctggtaccaanagaacctggccaggctccagctcctcatctatgatgcatccaacngggccacgtggcactcccagccaggttcagtcggctaggtggtctggtgacagcttcactcgtacaccgntcacgcagcctagacgctagaagtnttctgctagtttactactcgtcagtcaggtacgtanacctaacgtcgccttcgtactacgttcggacggacggtacgtagggtcggtacgtactaacgtaacgtacgttggaggtctagacccaacgtacttccagttacc

SEQ ID NO: 74000 - DNA, 607 bp, Homo sapiens
  misc_feature: GYAE6OF02G0GK7.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacagggccacgtggcactcccagccaggttcagtggcaggtgggtctgtgacagacttcactctacaccatcagcagcctagacgcctagaagtacttcgtgtaccttagttttaacttacgttgtacagtcgaggcgtagacctaaacgtcggtacccttctaccgtaccgtttccgggaccgggtaacggggaacccgtaaggggttacggaacggtaacgtaaccggtaaaaccggtaacgttcgggttaacggtacgttacggaccctaacccgtacgtttccgttacggtttacccg

SEQ ID NO: 74001 - DNA, 571 bp, Homo sapiens
  misc_feature: GYAE6OF02GOXQN.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggcaccctgtctttgtctccagggacagtgccaccctctcctgcagggccagtcagagtgttagtagcaacttagcctggtaccagcagaaacctggccaggctccccaggctccctcatctatggtgcatccaccagggccactggtactcccagccaggttcagtcggcgagtgggtctgggacagtgttcacttctccaccatccaggccagcctcgcagtctgaagtatttgctagtttattactgtctagctagtattaattacgtggtcttcgttttgaccggtacgggtaactaacgcgtaggtaacgtagtacgaaggtacgtaacgttaggtcggtacgtacgtccgtaccgtacgttaccgttacggtttctttaccgtacgttccccg

SEQ ID NO: 74002 - DNA, 539 bp, Homo sapiens
  misc_feature: GYAE6OF02HXA7A.49.46.E02.1.454.CMB.1.raw
  modified_base (414)..(414): a, c, t, g, unknown or other
  misc_feature (414)..(414): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgcccaccctctcctgcagggccagtcagagtgttagtagcttcttagcctggtaaccaacagaaacctggccaggctccaggctcctcatctatgatgcatccaacacgggccactggcactccccagccgaggttcagtcggcaggtgggtctgtgacagacttcaccttctccaccgatcgagcacgcctaagagcctagaagtacttcngactagtttattactcgtatagctagcgtagcacgtgcctctcctcgttcggcggagggaccgaggtggagagtacgaaacgtagttacggcggtcgtcgaccgtacctacgttcttagttaccg

SEQ ID NO: 74003 - DNA, 550 bp, Homo sapiens
  misc_feature: GYAE6OF02I052M.49.46.E02.1.454.CMB.1.raw
  modified_base (246)..(246): a, c, t, g, unknown or other
  misc_feature (246)..(246): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
  modified_base (439)..(439): a, c, t, g, unknown or other
  misc_feature (439)..(439): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagtaaattgtgttgactacagtctccggccacctgtctttgtctccagggacagtgccacctctcctgcagggccagtcagagtgttagtagtcttntagcctggtaccaacagaactgccaggctccagctcctacatctatgatcgcatccaacgcgggccacgtgcactcccagccgtaggtcaagtcggcagtcggtctgtagacagtacttcnctcncaccactcgacncacgtctagcgtctagaatacttctgactaagtttatactgtctagtctagcgtanctaagtcgtccttcgtcctacgtttcggacggtacggaccgtaggtaggacgtcgttaaccgaaacgttacgcggtacggtactccgtaccgtcgtattccggttattccg

SEQ ID NO: 74004 - DNA, 808 bp, Homo sapiens
  misc_feature: GYAE6OF02GACL0.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggcctcctcatctatgatgctactccaacgacgggcctaacgtcgggacaacttccccgaagcccgtaagggtttccgaaggttcggggacctaagggttcggggggttccttgggttacgggaaccgtaacggtacctttaccgtaaccgtttacccgttacccctaaaccccgtaactttaccgaacggtacccgtaaacggtaccccgtttaaagggaacccgggtaccccttaagggtaaaacgttaacgtttccttaacgtaccgtttaaggttttttaactttaacgttacgtttaccgaacgtaccgtacgggtaccggttaaggaaccgttaaaccggttcgggttaccccgtttaccgttacccgttaaccggtttttccgggggaaccggggttaacggggtaaacccggttaacggggttacgggtaaacgtaacggttaacccgaaaaaccgggttaacgttacgggttacggtaccgttacggaccctaccgtacgttaccgtttcgttacccg

SEQ ID NO: 74005 - DNA, 724 bp, Homo sapiens
  misc_feature: GYAE6OF02JCQJZ.49.46.E02.1.454.CMB.1.raw
tcagagtcgagagacacgaccggtgctcgatttagactcatctacagggaaagggggaggaactgctcagttaggacccagagggaaccatggaacgccccagctcagcttctcttcctcctgctactctggctcccagataccaccggagaattgtgttgacacagtctccggccaccctgttctttgtctccgaggggacagtcgcccacctctcctgcgagggccagtcagagtgttagtagctttctagccttggtaaccaacagaaacctggaccaggcctacccgaggcctcctcattctatcgattgactatccaacgagggacccagtcggacctactacccgagccgtacgggttccaaggtcggaccgtaagggttcggggtacttcggtacgaaccgtacggttaaccttccgaaccgttccgttacccaacctaacttcgaacgaccgaacgtccccgtaaggtaccgtacccgttaaggaacggttactttacgtcggtaacgtttaacgttttaacgttaaccgtcgtaactacggtccaagggtaccgtagacctaaccggtcggtcccttcgttacccgttacggtttacgggaccgggtaacgggtaaccgtaggggtacggaacggtactaaacccggaaaacggttaccgttacgggtacggtaccgtacggaaccctaaccggttacttccgttaccgttaccg

SEQ ID NO: 74006 - DNA, 678 bp, Homo sapiens
  misc_feature: GYAE6OF02F5EL0.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagagtcttcttagcctggtaccaacagaacctggccaggctcccaggcctcctcatctatgatcgacatccaacgcgggtccacgtacggcactacccgagtaccgtaggttccgaggtcggacgtagggttcgggtctaggtacgacacggtacttccgaccttcgtccaacctataccgacgcgtaacgtcccgtaacggacgtaccgtaggtaacgttacttcgtacggttaacttaaggtttttaactcgttacgtcgaacgtcgaacggtccgttaaacgaccgttaacgtcccggtacccttacgttaccgttaccggtttaccggggacgggtaaccgggtaccgtaaggggttcggaacggttaaccaaccggttaaacggacgttcggtacggtactacggtaccctaaccgtacgtttaccgtgtttaaccc

SEQ ID NO: 74007 - DNA, 574 bp, Homo sapiens
  misc_feature: GYAE6OF02GX26X.49.46.E02.1.454.CMB.1.raw
  modified_base (536)..(536): a, c, t, g, unknown or other
  misc_feature (536)..(536): n is a, c, g, or t
  modified_base (566)..(566): a, c, t, g, unknown or other
  misc_feature (566)..(566): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaattgtgttgacacagtctccggccaccctgtctttgtctccaggggacagtgccaccctctcctgcagggccagtcagagtgttagtagtctttcttagcctggtaccaacacgaaacctggccaggctcccaggctcctcatctatgatgcatccaaacgacgggtccaacgtcggcaacgtccccaaggcccgtaggtttccaggtcggactagggtggggtcttggtagaactaggtacctttacaacttccgtaccaacccatccagcacgtcctaggacgcctaggaagtattcgtagtacgttagtttacttactacgtcagtcagcgtagaccaagtcgcctcgtctacgtttcggacggacggacgagggtgacgtanaacgaacgtagtgtacgtctacggcacgtntcgtgtcc

SEQ ID NO: 74008 - DNA, 594 bp, Homo sapiens
  misc_feature: GYAE6OF02I9ZI8.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgagggacagtcgccaccctctcctgccagggccagtcagagtgttagtagcttcttagcctaggtaccaacagaaacctggaccaggcctacccgaggcctcctcatctatgatcgcactaccaacgcggccacgtcggacaactcccgagaccgtacggttcgacggtcggacgtagggttcgggtctaggtacgactacgtacttccacttcctaccacctagtcacgacacgtacctagacgacgtagaacgtcttcgtacgacgttactttatacgttgtactacgtcgaacgtcgtagacctaacgtcgtacctactccgtacggtcggacgtacgggacgtagggtcgaacgtaacgaacgtacgacgtgacgcgtacgcaactgtactgtaccg

SEQ ID NO: 74009 - DNA, 626 bp, Homo sapiens
  misc_feature: GYAE6OF02IXXHQ.49.46.E02.1.454.CMB.1.raw
  modified_base (204)..(204): a, c, t, g, unknown or other
  misc_feature (204)..(204): n is a, c, g, or t
  modified_base (243)..(243): a, c, t, g, unknown or other
  misc_feature (243)..(243): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccactggagaaatagtgatgacgcagtctccagccaccctgtctgtgtctccgaggggaaangtccaccctctcctgcagggccaggtcagagtgttaggngcaacttagcctggtatcagcagaaacctggccaggcctccaggctcctcatctatgatcgcatccacagggcccatggtactcccagcctaggttcaaggtggacctaggttgggtcttggggaacctaaggtcgtttaccaacgttcctcctaacccgattaccaacggccaacggccgtacgactacgttcgtagtaaacgttacttttagaccttaagttttaatttaccgttgtacacgtacgtaagttaactaagttcggtaccgggtaccgttccggaacttacgtttccgggacgggtacgggaacgtaacgggtggaacggtacgtaacgaaacgtaacgtaggtacggtacgtaccgacgtacctagttaccg

SEQ ID NO: 74010 - DNA, 724 bp, Homo sapiens
  misc_feature: GYAE6OF02I8SHV.49.46.E02.1.454.CMB.1.raw
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
tcagagtcgagagacacgaccggtgctcgatttagactcatctacaggggaaagggggaggaactgctcagttacggacccagagggaaccatggaacgccccagctcagcttctcttcctcctgcttactcgtggcctccagactaccaccggagaaattgtgttgacacagtctccggccaccctgttctttgtctccgaggggacagtcgcccaccctctcctgcgagggccagtcagagtgttagagcttnttacgcctaggtacccaanacgaaacctggccaggcctcccgaggtctccgtnactctatgactgactactaccgaacgtacggggccctaacgtcggacctacgtaccccacggcccgttaaggggttccaagggtcggacgtaggggttcgggtacgtcggtacgtaaccgacggttaccctttactaaccctacccttaccgaacctaacgtcccgaacgcctaaacggtcccttaagggaacgtcccgttaaggtaacgtacgtttcgtacgttacttaacggttttatacgttcgtacgacgtacgtacgtacgtacgtaccgtacgtccgttcccttcgtacccggtttccggtacgggaccgggtaacggtacggtacgggtacgtaacggtaactaacggtaaaccgtcggtacgtacggtaccgtacgtaccgtaccgtacgttccgtttacttaacccg

SEQ ID NO: 74011 - DNA, 614 bp, Homo sapiens
  misc_feature: GYAE6OF02IY9Q0.49.46.E02.1.454.CMB.1.raw
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
  modified_base (420)..(420): a, c, t, g, unknown or other
  misc_feature (420)..(420): n is a, c, g, or t
  modified_base (570)..(570): a, c, t, g, unknown or other
  misc_feature (570)..(570): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctcgccacctgtcttgctccagggacagtgccacctctcctgcaggccagtcagagtgttagagcttcttagcctggtaccaanagaaacctggccaggccncccgaggcctcctnatctatagatcgcactaccaacgtcggccaacgtcggacactcccagccgtaaggttcaggtcgcaggtcgggtactggtacacgtagtacttcgacttacgccactagcagcaacgtctagacgtcctaggaactnttcgacgtactatttacgttacgacgttacagtcaacggtacgttaacgcttaacggttcggtcccttacttaccgttaacggtttacccgggacgggttaacggtaaccgtaggggttacgtaacggtaaccgtaaacctaacggtacngggtttacgcctaacgggcccttaacgacgtttcgtattaccgg

SEQ ID NO: 74012 - DNA, 535 bp, Homo sapiens
  misc_feature: GYAE6OF02F144R.49.46.E02.1.454.CMB.1.raw
  modified_base (404)..(404): a, c, t, g, unknown or other
  misc_feature (404)..(404): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacagggccacgtggcatcccagccaggttcagtggcaggtgggtctgtgacagtacttcactctacaccatcagcagcctagacgcctagaagtattcngctagtttatctgtcagcagcgtagctaacgtcggcctctcgtacgtttcgggcggtagggaccgtagggtgaggtaactacgaaacggtacgttggtaggacctaggaccaccgtacgttcgtcgttacc

SEQ ID NO: 74013 - DNA, 583 bp, Homo sapiens
  misc_feature: GYAE6OF02HXO24.49.46.E02.1.454.CMB.1.raw
  modified_base (423)..(423): a, c, t, g, unknown or other
  misc_feature (423)..(423): n is a, c, g, or t
  modified_base (455)..(455): a, c, t, g, unknown or other
  misc_feature (455)..(455): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagatacccaccggagaaattgtgttgacacagtctccggccaccctgtctttgtcctccgaggggactagtcgcccaccctctcctgccgagggcccagtcaggtagtgttagtagccttcttagtccgtggtaaccaacagaacctggccaggcctccgagcctctcatctatgatgctactaccaacgcggcccacgtgacctactcccagcccgaggttcaggtggcctagggttggctgacgactagaccttcacttcaccactatccgagcacgtacagcnctagaagtctctgtctagtttactctgtaccngcagcgttaagacctagtcgacctccgttactcggttcggacgggaacggtaccgtagggttacggagtaactaaccggaaacgtacgtcggtacggtcgtacgacctacggtaactcggtaccttcg

SEQ ID NO: 74014 - DNA, 642 bp, Homo sapiens
  misc_feature: GYAE6OF02ITCWH.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaattgtgttgacacagtctccggccacctgtctttgtctccgaggggacagtgccaccctctcctgcagggccagtcagagttgttagtagtcttctagcctggtaaccaacacgaaacctggccaggcctacccgaggcctccctcatcgtatgtatcgcactaccaacgacggggccacgtcggctactcccgacgccgtaggttcgaggtcggctaggttcgggttacttggtacgacgtacggtaccttaccgtaacttcttaccaccgtactcgaacgaccgtacggacccgtaaggacgtaccgtacgaaagtacttcgtacgtacttacggttttaacttacgttgttaccagtcgagtcgtacgactaacgtcgtcctccgtacgttccgttcggacgggtacggacgtagggtaggacgtagtaaccgaaacggtacggtcggtacggtaccgtacggtaccgaccttacgttcgtcgttaccc

SEQ ID NO: 74015 - DNA, 678 bp, Homo sapiens
  misc_feature: GYAE6OF02HBUM9.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccacctctcctgcagggccagtcagagtgttagtagcttcttagcctggtaccaacgagaaacctgccaggctcccaggctcctcatctatgatgcatcccaacgacgggccagtcggaccacgtccccagtcccgaggtttccaggtcggctagggttcgggtcttggtacgtacaaggtacctttaccaccgttcctacgaccctatccgagcccgtacgacccgtaaggacgtcccgttaaggaaacgtactttctacggttacttaacgtttttaacttaaccgtttcggtaccgtaacgtcccaaggttacccggttaagaccgtaaaccgttcggggtaccctttcttaccgtttaccggtttccgggaaccgggtacggggtaacccgtaggggttcggaacggtaactaacggaaacggtaacttgggtacggtacctacggtacccacgtacgttccgtgttaccc

SEQ ID NO: 74016 - DNA, 598 bp, Homo sapiens
  misc_feature: GYAE6OF02I6J7Y.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcttgtctccgagggacagtcgcccaccctctcctgcagggccagtcagagttgttagtagcttcttagcctggtaccaacagaaacctggccaggcctacccgaggcctcctcatctatcgatgcatccaacgacggccactggcctactccccgagcccgtaggttcaggtcgcgtaggtgggtctggtagacacgtacttcacgttcctccgacctagtcacgcaacgtccgtagacgtcgtagaatacgttcgtacgtacttaaggtttactacgttcgtaccgagctacggtcgtagacctaacgtcgtaccttctacgtacgttcgggacggtacgggtaccgtagggtaggaacgtaactacgaaacggtacgtggttacgacgttcgacctacgtagtcctaggtacc

SEQ ID NO: 74017 - DNA, 615 bp, Homo sapiens
  misc_feature: GYAE6OF02F8V28.49.46.E02.1.454.CMB.1.raw
  modified_base (393)..(393): a, c, t, g, unknown or other
  misc_feature (393)..(393): n is a, c, g, or t
  modified_base (396)..(396): a, c, t, g, unknown or other
  misc_feature (396)..(396): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggccaggcctcccaggcctcctcatctatgatgacatccaacgacgggcccacgtggcactccccgagccgtaggttcaggtcggctaggtcgggtctgtagacagtaccttcactctcaccntcncgcacgcctagacgccgtagaacgtacttctcgtacttaaggttttacttacgtcgttacagtacgacggtccgtaacgaccgtaacgttcgaccttccttaccgttaccgtttccgggacgggtacgggaaccgtaggggttaggaacggtaacgtaaccgaaaccggtaacgttggtacggtcgtacggtaccctacgtacccttacgtctttaccg

SEQ ID NO: 74018 - DNA, 764 bp, Homo sapiens
  misc_feature: GYAE6OF02IU160.49.46.E02.1.454.CMB.1.raw
  modified_base (481)..(481): a, c, t, g, unknown or other
  misc_feature (481)..(481): n is a, c, g, or t
tcagagtcgagagacacgaccggtgctcgatttagactcatctacagggaaagggggagggaacgtgctcagttaggacccagagggaaccatggaagccccagctcagcttctcttcctcctgctactctggctcccagataccaccggagtaaacttgtgttgacacagtctccggccacctgtctttcgtcctccgaggggacagtcgccctaccctctccgtgccgagggccagtccaggtagtcgttagtacgtctttcgttacgtccgtaggtaacccaaactacgtaaacctcgggccaaacgggccccttacccggagggtcccttccccgtacgtacttaccctagtacggtacttacgacctaccttacccgaaaacggcgggtacccctaacgtcgggaaccttaccgaccccgacggtaccgtaggtttaccacgggttggaaccttggggttacggtcctggttaacncgaacgtcttacaccgtttccacctacgacttcgcgacacgtaccctaagccgacgtacgtaagttcgtactacggtacttaagttttactaccgtttgtacctacgtactaccggtacgttaaccgaccgttaacgtccgtcccttacgttaccgttaaccggtttccggaacggggtaacgtacccgggtaagggtccggtaagtaacccggttaacctaacgggtaaccgttggggtcccgacggtacaccggttacccgtagtacccgtttacgttccg

SEQ ID NO: 74019 - DNA, 780 bp, Homo sapiens
  misc_feature: GYAE6OF02JPJ8V.49.46.E02.1.454.CMB.1.raw
tcagagtcgagagacacgaccggtgctcgatttagactcatctacagggaaagggggagggaactggctcagttaggacccagagggaaccgatggaagccccagctcagctctcttcctcctgctactctggctcccagataccaccggagaaacttgtgttgacacagtctccggccacctgtcttgctccgagggacagtcgccacccgtctccgtgccgtaggggcctaaggtcaacggagttcgttaagtacggcttccttaggcccttagggtaaccctaactacggaaacctgggacccagggccttaccccgagggtcctccttaccgactctaactgaaccgttgcctagtaccccgaaacgtacggggaccctaacgttccgggactaactcccccgaaggtccgtaacgggtttaccgaaggttccggacgtaaggtccggggttctagggtacgtacgaacggtctttacgaccttacggttaccaaccctagtcccgtaagccgtacgtccgttaacgacgtccctagggaaacgtactttcggacgttaccgtaaatttactttaacgttcggtaacgcgttaccaaggtcgtaaccgtaacgtaacgtcgggtacccttacgttccgttaaccgggtttcgggaaccggggttaaccgggtaaccggtaggttaacgggaagttacccggtaaaccgtaaacgtaacgttcggggttacgaccggttcgtaacccgtaaccgtacgttccgttacgggttaaccc

SEQ ID NO: 74020 - DNA, 645 bp, Homo sapiens
  misc_feature: GYAE6OF02GV75O.49.46.E02.1.454.CMB.1.raw
  modified_base (203)..(203): a, c, t, g, unknown or other
  misc_feature (203)..(203): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccagtccacctgtctatgtctccgaggggaaancgccaccctctcctgcagggccagtcagaatgtggcagctacttagcctggtaccagcagaaacctggaccaggcctcccagtcctcctctattcttgactcgcactcccgcgacgggcccnctacgacctacnccccgagccgagggttccaggtcggacgtagggttcggggtttaggacaggtactttccgacgtctacaccactcaacgcagcctaagagtccctagaagttactttcgacttagttttacttacgtacgttacaaacgtcggtacctaaccgacgtaacggttctttaccgtaccgtttccggacccttacggggaaccctaaggtacgggtcgtaactacgttaaccgaaacggtaaccgttggtacgggtaccttacggacctaaccgtgttaccgttaggtttccctttaccgactttcccccg

SEQ ID NO: 74021 - DNA, 728 bp, Homo sapiens
  misc_feature: GYAE6OF02JTMH9.49.46.E02.1.454.CMB.1.raw
  modified_base (444)..(444): a, c, t, g, unknown or other
  misc_feature (444)..(444): n is a, c, g, or t
  modified_base (593)..(593): a, c, t, g, unknown or other
  misc_feature (593)..(593): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaacttgtgttgacacagtctccggccaccctgtcttgtctccagggacagtgccacctctcctgaccacgggccagtcagacgttgttagtacgcttcgttacgccttaggtaccaacgacgaacctggaccacggccttacccgaggtccctaccgtcgtaacttccttaagcgtacttcggacctaacgttcccgaaaacacgggtccctaccgtacgggacctaaccgtcccgtaacgccgttaaagggtttcaacgggttggaccgtaggtccggggttctacgggtanaccgtacggtactttcgaaccttccgttaccaacccgtataccgagtccgtaacggccctttaaggacgtaccctaggaaacgttctttaccgagtcgtttaacggttttactacccgtttagaaccgtgtaccgaaggtccgttaacnccgttaaccgtacgtccttaacctacgttacccgtttcgggacccggttaagggtacccagggtacgtggtaaactaccgaaacgtcgttcggacggtactcgggtaccctaacggtacttcggtaccctttacg

SEQ ID NO: 74022 - DNA, 634 bp, Homo sapiens
  misc_feature: GYAE6OF02IMJGA.49.46.E02.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (255)..(255): a, c, t, g, unknown or other
  misc_feature (255)..(255): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctccagataccaccggagaaattgtgttgacacagtctccggccacctgtctttgctcagggacngtgccaccctncctgcaggccagtcagagtgttagtagcttctagcctggtaaccaanagaaacctggaccaggcctccgaggcctacctcattctagtgactcgctactaccaaagcggcctaacgtcggaccactacccacggacctaggttcagggttcgacgtagggtcgggtctggtacgacgtacgtacttcacgttctaccacctagtcgaacgcacggtacctaagcgtccgtagaaacgtacttcgagtacttaagtttaacttacgtgtacctaggctacggtccgtaagcctaaaccgtcgtccttacctcggttaccggttacgggaccgggtaacgggtaccgtaacggggttagacgtaaaccgttaacggaaaccgttaacgtgggtcgtaccgtacgaccgaacgtcttacgtcgtttacc

SEQ ID NO: 74023 - DNA, 532 bp, Homo sapiens
  misc_feature: GYAE6OF02GIUIG.49.46.E02.1.454.CMB.1.raw
  modified_base (279)..(279): a, c, t, g, unknown or other
  misc_feature (279)..(279): n is a, c, g, or t
  modified_base (291)..(291): a, c, t, g, unknown or other
  misc_feature (291)..(291): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggtcncccaggctcctnatctatgatgcatccaacaggccacgtggcatcccagccaggttcagtggctagtcgggtctggtgactagacttcactctcaccgatcagcagcctagcgactgaagtacttctgctagtttattactgtacagcagcgtagacacgtgcctctctacgttcggcgtacgggaccgaggtggacgaacgtaccgaaacgtaacgtacgtacggactcggtaccaaccgtatcgtgtaccg

SEQ ID NO: 74024 - DNA, 698 bp, Homo sapiens
  misc_feature: GYAE6OF02H8YZ4.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcacgggccagtcagtagtgttagtacgcttcgttagcctaggtaccaacacgaaacctggaccaggcctcccgaggctcctcatctatgaatcgacatacccgaacgacgggtcctacgtacggcacgtcccgagtacccgtaggttccaaggtcggctaggttcgggttacgtggtacgacgtacgtaactttcccgaacttccctcgacctacgttacccgagtacgacggtccttaaacggacgtacccgttagtaaacgtcttaccgttagtacgttaacggttttaatttacgttacggtacctaaggacctaacggtacgtaacgaccttaacgtaccggtcccttaccgttacccgttaaccggtttcgggaaccgggtaacgggtaaccgtaagggtcggtaaggaacgtaacggaaaccgtaacgttcgagggtaccgtacggacccgtaaccgtaattccgttgttaaccc

SEQ ID NO: 74025 - DNA, 746 bp, Homo sapiens
  misc_feature: GYAE6OF02JXVP8.49.46.E02.1.454.CMB.1.raw
  modified_base (267)..(267): a, c, t, g, unknown or other
  misc_feature (267)..(267): n is a, c, g, or t
  modified_base (444)..(444): a, c, t, g, unknown or other
  misc_feature (444)..(444): n is a, c, g, or t
  modified_base (520)..(520): a, c, t, g, unknown or other
  misc_feature (520)..(520): n is a, c, g, or t
tcagagtcgagagacacgaccggtgctcgatttagactcatctacagggaaagggggaggaactgctcagttaggacccagagggaaccatggaagccccagctcagcttctcttcctcctgctactctgctcccagataccaccggagaaattgtgttagacacagtctccggccaccctgtctttgtctccgaggggacagtcgccctaccctctcctgcagggccagtcagagtgttagtacgcttcttagcctaggtaccaanagaacctggccaggctcccgaggcctcctcattcctatgactgacctatacccgaaacgcgggccctacgtcggacctaacctcccgaagcccgtaagggttccaggtccgggactagggttcggggttctacggtacgaaccgtaggtaccctttacgaccttccgtacccaactntaccgacgcaccgtaccgtaagaccgtactagggtaactattccgacgtcttaacgtttaactacgttgtaaccgngtaccagggtaccgtaagtacctaacggttccgttacccttacgtttaacccgttaccggtttaccggggaacccgggtaagggtaaccccgtaagggggtttcgaaacccgggttaaacgtaaaccggttaaaccggtaaccggggttttcggttaaccgggacccgttttacggaacccccgtttaaaccggtttcggttacccgttttaaccggttaacccgg

SEQ ID NO: 74026 - DNA, 605 bp, Homo sapiens
  misc_feature: GYAE6OF02G7ZU7.49.46.E02.1.454.CMB.1.raw
  modified_base (364)..(364): a, c, t, g, unknown or other
  misc_feature (364)..(364): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacagggccactggcatcccagccaggttcagtgcaggtggtctgtgacagcttcactcncacatcagcacgcctagacgcctagaacgtattcgtgtactagttttaactacgttgttacagtacaggtacgtacgacctaacgtcggacccttccgttaccgttacccggttttacgggccggggtaacggggtaacccgtaaggggtcgggtaacggtaacgttaaccggaaaaccggtaaccgttagggtacggaccgttacggacccgtaacctacgttaccgttacggtttaccc

SEQ ID NO: 74027 - DNA, 656 bp, Homo sapiens
  misc_feature: GYAE6OF02JW22Z.49.46.E02.1.454.CMB.1.raw
  modified_base (497)..(497): a, c, t, g, unknown or other
  misc_feature (497)..(497): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgcccaccctctcctgcacgggccagtcagagtgttagtagcttcttagcctggtaccaacacgaaacctggaccaggcctccgaggtcctccgtcatctatgatgcactccaacgacggccacgtggccacgtcccgaggtccgtaggttaccgaggtcggacgtagggtcgggtctggtacgactagtaccttcaccgtctccaccaatccagccaacgtcctagccgtacctagaaagttacttcgtacgtacttagttttactacgtgtaccagtccgtaggttccgtanaccgtaacgttcccgggtcttaaccgtccgtttaaccgggtaccgggacggggtaaccgtaaccggtagggtcggtaaacgtacggtaaacccgtaacggtaccggttcggtaccggttaccgtaccggaccctacgtacgtttccgttaccgttaccg

SEQ ID NO: 74028 - DNA, 609 bp, Homo sapiens
  misc_feature: GYAE6OF02GUEZ1.49.46.E02.1.454.CMB.1.raw
  modified_base (308)..(308): a, c, t, g, unknown or other
  misc_feature (308)..(308): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctctcatctatgatgcatccaacncgggccacgtggccatccccagccaggttccagtggacaggtgggtctggtgacgaggtaccttcaacttctaccgaacctattccgagtccaacggtccctaaggacgtccgtagtaaacgtatttcgtgacttaaggttttacttacgttaggttccaagtcaagtcgtagactaacgtcggtcccttcttaccgttacgtttccgggacgggtacggacccggtaaggtggacgtaacgtaaccgaaacgtacgtaggtcggacttacgggacccacctaagttccgttagttacccg

SEQ ID NO: 74029 - DNA, 707 bp, Homo sapiens
  misc_feature: GYAE6OF02IIGZA.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctcccggccaccctgtctttgtctccgaggggtacagtcgccacccttctcctgcgagggccagtcagagtgttagtagcttcttagcccttggtaaccaacgaacgaaaccgtcggaccagggcctaccccgaggccttcctctacttctagtcgtatcggccagtcccaaaccgtacggggcctacgtcggaccactaccccgagtacccgtaggttaccaggtcggacgtagggttacggggtcgttcggtcgtaaccgtaggtaacctttcgaaccgtttacgtacccaacccgtaacttaccgaacggcccgtaacggtcccgtaaacggacgtacccgttaagtaaacgtactttaccggtacgttacgttaacgttttaactttacgtacgttcagtccgaagtccgtacgactaacgtcgtacctctacgtaccgttcggacgggtacggaccggtaggtcggtaacgtacgtaacggaaacgtacgtacggtacggtacgtacgacctacgtacgttccgtacgttccg

SEQ ID NO: 74030 - DNA, 517 bp, Homo sapiens
  misc_feature: GYAE6OF02F1213.49.46.E02.1.454.CMB.1.raw
  modified_base (290)..(290): a, c, t, g, unknown or other
  misc_feature (290)..(290): n is a, c, g, or t
  modified_base (309)..(309): a, c, t, g, unknown or other
  misc_feature (309)..(309): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctnatctatgatgcatccaacngggccactggcatcccagccaggttcagtggcagtggtctgtgacatactcactctcaccatcagcagcctagacgcctagaagtattctgactagttttatactgtcagtcaagttataagtggtacccgggcttaccggacttacgtttcggcggaggaccgaggtggagacgtacgaaacgacgtgtggctgcaccatctgtctc

SEQ ID NO: 74031 - DNA, 622 bp, Homo sapiens
  misc_feature: GYAE6OF02IXECD.49.46.E02.1.454.CMB.1.raw
  modified_base (427)..(427): a, c, t, g, unknown or other
  misc_feature (427)..(427): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagagcttctagcctggtaccaacagaaacctggccaggcctcccaggctcctcatctatgatgacatccgaacgacggggccaacgtggacaccgtccccgagacccgtaggtttccaaggtcggacaggttggggtctggtacgacagtacttcactctcactatcagcacgctagcgtccgtagaacgtnttcgtgtacttaagtttaactttagtcgtacgtacgtaccgaggtcgttaacgaccgtaagtcggtacccttactaccgttaccggtttacgggacgggaacggttaaccggtaggggtggtaaccgtagttaaaccggaaaccggtacgtacgggtcggtacttcggacctaccgtacgttccgtcgtttaccc

SEQ ID NO: 74032 - DNA, 678 bp, Homo sapiens
  misc_feature: GYAE6OF02ITSNT.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcttgtctccagggacagtgccacctctcctgcagggccagtcagagtgttagtagcttcgtacgcctggtaccaacagaaacctggaccaggcctcccgaggcctcctcatctatgatcgcatccaacgcggccacgtgcactcccgagcctaggttcaggtcggcgtaggtgggtctggtacgacgtagtcttaccacgtcctaccacctactcacgcacgtaccgtagacgtcctaaggaagtactttcgtacgtaccgtttaagttttaacgttacccgttaggtacctaacgggtcctaacgggtaccgttaaccgaccgttaacccggttcgtaccccctttgtaccccgttaacgggttttcccggggaacggggtaacccggggtaccgtaaggggtccgggaacggtaacttaaacccggaaaccggttaaggttccggggtgtaaccgtcggtaacccgtacgtaacgtttccggtacgtttaccc

SEQ ID NO: 74033 - DNA, 620 bp, Homo sapiens
  misc_feature: GYAE6OF02GEWD5.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacgagggccacgtggcactcccagcctaggttcaggtcggctaggtgggtctggtacgactaggtacttccacttcctccaaccctatccaaggacctacgcccttaaggaccgtcctagaaacggtactttcgcgtacttaagttttaacttacttcgacacgcgtaaggtccgttaagaccgttaacgtccgtaccttccgttaccgttaaccgtttccggggacgggtaacggggtaccgtagggtacgacggtaactaacgaaaccgtaacgtggtaacggctacggacctactacgttcgtagttacccg

SEQ ID NO: 74034 - DNA, 686 bp, Homo sapiens
  misc_feature: GYAE6OF02GVLNM.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccaggggacagtgccaccctctcctcgcaggggccctagtccagtacgtgttagtagcttcttagcctggtacccaacagaaacctggccaggcctcccgaggcctcctcactcgtatcgatcgcaattccaacgtacgggccaacgtcggactactccccgaagccgtacggttacacggtcggaccgtagggtcgggtcgtaggtcgacgacgtacttcaccgtctacgaaccactccgaacgccaacgtccctaaagccgtacccgtagtaaacggtactttcgacggtaccgttaaggtttacttaccgttggaccctagtaccgtaacggtacgttaaccgacggtaaccgttcggttaccctccgttacgttaaccggttcgggaaccgggttagggaacccgttagggtccggaaggtaacccttaacggaaaacggtaccggttagtaggtacccgtcggacccgtaacctcggtttacgtgttaccc

SEQ ID NO: 74035 - DNA, 695 bp, Homo sapiens
  misc_feature: GYAE6OF02GAO5J.49.46.E02.1.454.CMB.1.raw
  modified_base (200)..(200): a, c, t, g, unknown or other
  misc_feature (200)..(200): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccagtccacctgtctatgtctcgagggaancgccacctctcctgccaggccagtcagtaatgtgcagctactagcctgtaccagcaagaaccgtggaccaggcctaccccgtagtcctaccctacattcctttagacgtcgacctacgccccgcgtacgggcccgacttacggacctaccgttcccaacggtccctaggggtttaccacgggtttcggaccgtaaggggttcggggtttacgggacgtaaggtaccgttcccacggtaccttaccggaacctacgtccagtaccaacggacctaacgggtactaccgtaaggtacgtaatttggacttaggtttaacttcgtacgtacctaacgtcgtaccgtaaccacggtagtaactttccgaaccgtttcccgggaccgttacggaccctaaggtacggtacgtaactacgttaaccgaaacgtcggttaggtcggtacgtaccgtaccgtaaccttacgttccgtagttccctttacgaccgtttaccccg

SEQ ID NO: 74036 - DNA, 762 bp, Homo sapiens
  misc_feature: GYAE6OF02JY8K8.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctcggccaccctgtcttgtctccgagggacagtcgccacctctcctgcacgggccagtcagagtgttagtagctttcttagccttaggtaaccaacgagaaacccttggaccctaggccttacccgaggtcctcctcattctatgatcgacactccaacgcgggccctaacgtggccctaacgtccccaagtccccgtaaggtttccaggttcggacctagggttgggtcttacggtagaccgtaagttccgttacctacgttccaccgaacctacttacgacgacccgacgtaccccgttaagtaccggaccgttaggaaaaccgttactttcgtaccggtacgtttaacgtttttagtttaacccgtcggttaccaacggtacgacggttaccgttaacgaccttaaaccggttcgtacccgtttacctaccgtttaaccggtttacccggggaccgggtaacgggttaacccggagggttaccggaacggtttaaccgttaacccgggaaaaacgttacccgggtttaaggcccgggttaacgttaacggaccccgttaacgtaaccgtttcgttacccgttttaaacccg

SEQ ID NO: 74037 - DNA, 644 bp, Homo sapiens
  misc_feature: GYAE6OF02GFD2E.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgagggccacgtggacactcccagccaggtttcaggtggactaggtcgggtctggggaactaggtacgttcaacgttctaccaaccgtatccaagccacgccctgacgtagtctagtaagttacgttttgacgttagttttattaacgtgttacctagtactaagttaactttaaattacgttcgggttaccttttcgggtttttacgggtaccggtaacggggtacccgtaaaggtccgttagggtacgtacgtacggaacggtaccggtaacgttcgggtacggtcgttacggaccgtaccgtacgttccgttcggtttacccttacgttacccg

SEQ ID NO: 74038 - DNA, 660 bp, Homo sapiens
  misc_feature: GYAE6OF02F152M.49.46.E02.1.454.CMB.1.raw
  modified_base (421)..(421): a, c, t, g, unknown or other
  misc_feature (421)..(421): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagcttcttagcctggtaccaacagaaacctggaccaggcctcccgaggtcctcctcatctatgatgcatccaagcgggccagtggcatcccagcctaggttcagtggcaggttgggtctggtgacacgtacttcacctctccaacctatccagcacgcctaagacgtccgtaggaaacgtnttacgtgtacttaacgttttaattaccgttagtcgtagacgtaacggtacgtacgtaaccgtaagtccggtacccttcgttacccttaacggtttccggggaaccgggtaacggggtaacccggtaaggggttacgggtaacggtaaaccgttaaaccggaaaaacccggtaacggttacgggtcgggttaccttacgggacccttaacccggttacgtttaccgttccggtttaaccc

SEQ ID NO: 74039 - DNA, 606 bp, Homo sapiens
  misc_feature: GYAE6OF02G10O1.49.46.E02.1.454.CMB.1.raw
  modified_base (395)..(395): a, c, t, g, unknown or other
  misc_feature (395)..(395): n is a, c, g, or t
  modified_base (595)..(595): a, c, t, g, unknown or other
  misc_feature (595)..(595): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtctccaggggacagtgccaccctctcctgcagggccagtcagagtgttagtagcttcttagcctggtaccaacagaaacctggccaggctcccaggctcctcatctatgatgacatccaaacgacgggccacgtggcagtccccagccaggttcaaggttggacaggtcgggtctggtagacgagtacgttcaacttctaccaccctntacagtcacgtccgtaagacgcccttagaaacgtacttcgtacgccttaaggtttactttaacgtcgtacgacggtcacggtcgttaacgacctaacgtcggacccttcgtccgttaccgtttacggaccggggtaacgacccgtagggtcggaagtacgtaaccgaaacgtacgtaggttacgacgtcgaccaaccgtntactgttaccc

SEQ ID NO: 74040 - DNA, 597 bp, Homo sapiens
  misc_feature: GYAE6OF02FPIDJ.49.46.E02.1.454.CMB.1.raw
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgnggccactggcatcccagccaggttcagtggctaggtgggtctggtgacagtaccttcacttctaccaccatcagccagcctaggacgtccctaggaacgtatttctaggtacttaaggtttttaactaccgttgttaccacgtaccgaggtaccgtaagaccgtaaccgtcgggcccttaccgttccgtaaccgtttccgggacgggtaacgggaaccgtagggtcggaagtaacgtaacgaaaacggtacgtggtcggactcggacctaccgacttcgtgttaccc

SEQ ID NO: 74041 - DNA, 710 bp, Homo sapiens
  misc_feature: GYAE6OF02ITODZ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagaaattgtgttgacacagtctccggccaccctgtctttgtctccgaggggacagtcgccaccctctcctgcagggccagtcagtagtgttagtagtcttcttagcctggtaccaacagaaacctggaccaggcctccgaggcctcctcatctatgatgctactaccaacgacgggcccacgtcggaccacctcccgacgccgtaggttcgacggttggaccgtagggttcgggtcttggtacgtacgacgttaccttaccaaccgtttccaccctacctactcgaacgtccgtacgtacccgtaggacgtacctaggtaaacttacgttccgtagtacgtttaagtttacttaacgttcgttacgagtctaggtaccgttaacgaccgttaaccggtcggttacccttaccgttaccgttaacccgggtttccggggaaccggggtaccggggtaaacggtaaggggttacgggaacgtaaccggtaacccgtaaaacggtaccgttcgggtacggtaccgtacggtaccctaacccgttacgttcccgtagtttacccg

SEQ ID NO: 74042 - DNA, 686 bp, Homo sapiens
  misc_feature: GYAE6OF02IP35F.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgagggacagtgccacctctcctgcagggccagtcagagtgttagtagcttctagcctggtaaccaacagaaacctggccaggcctacccgaggctcctcatctatgatcgcactaccaacgacgggtccacgtcggacacgtaccccaggacctacggttccgaggtccggacgtaagggtgggttactcggtagaaccgtagtaaccgtttcgaacctcctaccgaacctactacgaacgccgtaacggtacccgtacggaacgtacccgtaggaaacgtcgttacgtacgtaccgttagttttaaccgttacgttacgtaccgtaacgtaccacggtaccgtacgaaccgttaacgttcggtacccttccgtaccgttaccggtttaccggggaacgtaaccgggtaacggtagggtacggtaacggtccgtaaacgtaaacgtaaccggtagtacggtcgtacggaccacgtaacgtccggttagttccc

SEQ ID NO: 74043 - DNA, 552 bp, Homo sapiens
  misc_feature: GYAE6OF02ISDPU.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccaccctctcctgcagggccagtcagagtgttagtagctttcttagcctggtaccaacagaaacctggccaggctcccaggctcctcatctatgatgcatccaacacgggccactggcactcccagccaggtcagtgcaggtggtctgtgacagtacttcactctacaccatcagcacgtctagacgcctaggaacgtattcgtcgtactaggtttaacttactcgttacacgcacgtcgtacgcaacgtcgcctctccgttacgttcggacggacgggtaaccgagggtaggacgtaataccgaaaacggtaccgtggtaggcgtacggctaccgtacttcgtgttcc

SEQ ID NO: 74044 - DNA, 655 bp, Homo sapiens
  misc_feature: GYAE6OF02IAG4G.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtcttgtctccgaggggacagtgccaccctctcctgcagggccagtcagagtgttagtagtcttcgttagcctggtacccaacgacgaaaccgtcggaccagggcctcccgaggtcctcctcatctatcgatgacactccgaacgcgggaccacgtggccacgtccccaggacctaggttccaggtcggaccgaggtcgggtctggtacgacagtacttccgaaccttcgtccaactacgtacgacgtacacgtaccgtaaggacgtcctaggaactcgttactcgtacttaagttttacttacgtcgtacgagtacgacggtacgtaacgacgtaccgtcggtcccttactaccgttaccggtttcgggaccgggtaacgggtaccgtaggggtacggaacgtacgttaaaccgaaacggttacgttaggtaccggtacgtaccggacctacccgtagtttccgtggtttaccc

SEQ ID NO: 74045 - DNA, 588 bp, Homo sapiens
  misc_feature: GYAE6OF02ING7A.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccaggctcctcatctatgatgcatccaacgagggccacgtggcactcccagcctaggttcagtggcaggtgggtctgtgacagtacttcgactctacacctatcagcagtaccctagacgtacctagaaacgtacttcgtcgtacttaagttttattacgtgtactaaggctaaggtcgttaagaccgtaacgtcggtacccttcgttaccttaccggtttcgggaccgggtacgggaacccgtagggtaggacgtaataaccgaaacgtaacgtggtacggctacgcctaacctacttcgtagttcc

SEQ ID NO: 74046 - DNA, 750 bp, Homo sapiens
  misc_feature: GYAE6OF02IP8A9.49.46.E02.1.454.CMB.1.raw
  modified_base (248)..(248): a, c, t, g, unknown or other
  misc_feature (248)..(248): n is a, c, g, or t
  modified_base (269)..(269): a, c, t, g, unknown or other
  misc_feature (269)..(269): n is a, c, g, or t
  modified_base (308)..(308): a, c, t, g, unknown or other
  misc_feature (308)..(308): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagatacccaccggagtaaattgtgttgacacagtcctccggccaccctgtctttgtctccgagggactagtcgcccaccctctcctgcagggccagtcagagtgttagtancttcttagccttggtaccaanacgtaacctggaccaaggcctacccgaggcctccgttanaactctaacgtgtatacggcacttaccaaaccgacgggccctactcggaccaccgttcccaacggcctacggtttacacgggttaggacgtacgggttgggtaccttggacgtaccgtaacggtacctttacgtaaaccctccttaacccacccgtaacttaccgaccggaacctacggtacccgtaacgtaacgtcccgtaagtaaaggtactttaccgtacgtaccgttaagttttactttaccgtttagtacttacggaactacggttaccgttacgtaacctacggtacccggtacccttccgtaccgttaccgggtttaccggaccgggtaaccgggtaccggtaacgggtacgggtactaacggttaaccaaacgggttaaccgtaagggttccggaacgttccggaaccgtacgtacgtaccgttcggttaaccc

SEQ ID NO: 74047 - DNA, 527 bp, Homo sapiens
  misc_feature: GYAE6OF02FW187.49.46.E02.1.454.CMB.1.raw
  modified_base (362)..(362): a, c, t, g, unknown or other
  misc_feature (362)..(362): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaaccctggccaggcctcccaggctcctcatctatgatgcatccaaacgagggccacgtggctatcccagccaggttcaggtgcagtgggtctgtcganagtcttcactcaccactatcagcagacctagacgcctagaatcttcagcttagtttatactgtacagcagcgtagacacgtgccttatccgtacgttcgggacggtacgggacctagggtgagtaactacgaaacggtctggngtctgcctaacngtctagttcc

SEQ ID NO: 74048 - DNA, 572 bp, Homo sapiens
  misc_feature: GYAE6OF02JCMVB.49.46.E02.1.454.CMB.1.raw
  modified_base (302)..(302): a, c, t, g, unknown or other
  misc_feature (302)..(302): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgacntccaacagggccactggccatccccagcctaggttcagtggctaggtgggtctggtacgacgacgtacttcactctaccacctatcagccagcctagacgcctagaagtattctgactaagttttattactgtctagacagtacgttagacctaacgtcggtcccttcgtccgtacgtttccgggacggtacgggactacgggtggaacgtagtaaccgaaacggtaacgtggtacggcgttcggacctaccgtacgttcttacgttccc

SEQ ID NO: 74049 - DNA, 685 bp, Homo sapiens
  misc_feature: GYAE6OF02G326Q.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccaccctctcctgcagggccagtcagagtgttagtagtcttcgttagcctggtaaccaacagaaacctggccaggcctacccgaggcctcctcactctatgatgcctactccgaagacgggccaacgtggcctactcccagccgtaggttacaggtcggactagggtgggttctgtacgacagtacttacaccttctaccaccctatacccagccaacgtcctaagacgtaccgtagtaaagttacgttacgtcgtactttaaggtttttacttaccgttcgtctaacgcgtaggtacgtaacgtacctaacgttccggcctttaccgtacgtttaccgggttaccggggaaccggtaacggggaacccgtagggggttcggaaacggttaacccgtaaaccggtaaaacggttaaccgttacgggtacgggtacccttcggtaacccgaaccgtttacgttccgtttacgtttaacccg

SEQ ID NO: 74050 - DNA, 691 bp, Homo sapiens
  misc_feature: GYAE6OF02HIAVK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaacctggcaggctccgaggcctcctcatctatcgatgcactaccaacgacgggccacgtcggctaactcccgacgtccgtaaggtttcgaggttcggacgtagggttcggggtctggtgaactacggtaccttacgaccttacctccgaacctacgtaccaacgcctaacgaccccgttaaggaccgtaccgtaagaaacggttacttccgtacgtaccgtaaggtttttaacttacgtgttaccacgtacgtacggtcgtaacgtaaccgtaacgttcggtacccttaccgttccgttacggtttaccggggacgggtaacggggtaaccgtacgggggttacggaacggtaacgttaaacccggaaaacgtaaccggttgggtacgtacgtacggaccctacccggtaattcccgttgtttaaccc

SEQ ID NO: 74051 - DNA, 568 bp, Homo sapiens
  misc_feature: GYAE6OF02FRQJC.49.46.E02.1.454.CMB.1.raw
  modified_base (398)..(398): a, c, t, g, unknown or other
  misc_feature (398)..(398): n is a, c, g, or t
  modified_base (433)..(433): a, c, t, g, unknown or other
  misc_feature (433)..(433): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgaggccactggcatcccagccaggttcagtggcaggtgggtctgtgacagtacttcactctcacatcagcagcctagacgcctagaagtnttctgactagtttattacttgtacagccagcgtanaccgtaacgtgacccttctcgttaccgtttccgggacgggaacggggacctaagggtcggaagtaacgtaaccgaaaaccggtaacgttcggtacggtaccgtacggtacccaaccctacgttccgtagttaccc

SEQ ID NO: 74052 - DNA, 753 bp, Homo sapiens
  misc_feature: GYAE6OF02FMXM1.49.46.E02.1.454.CMB.1.raw
  modified_base (442)..(442): a, c, t, g, unknown or other
  misc_feature (442)..(442): n is a, c, g, or t
  modified_base (738)..(738): a, c, t, g, unknown or other
  misc_feature (738)..(738): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggaagaaattggtgttgacacagtcctccggccaccctgtccttgtctccgaggggacagtcgcccaccctctcctgacgacgggccaggtccaggagttgtacgtacgtcttctacggccttaggtacctaacagtaaacctggacccaaggtcctacccgaaggtccctacccgtgtactacgttaactcgaacttcgacctacttacccgaagacgggccctaggtcgaccgtaacgtcccaacggtccctaaggggtttcccaggtccggtagacggttgggccttacggngtaacgtacgtacttcgaacttccacgtacacgtaccgtagaccgtacgtacgtacgtaccggtacgttaagaaaccgttacgttaccgtaacgtaacgtttacgttttaacgaaccgtttgtaacccggttaacgaccgtaacgggtacgttaacccggaacgttaccgttaccggggttaaccctcttaacccgggtaacgttttaccgggacggttaaaccccgggttaggtacgtacgtacggtaccgttaaacggaacgtaccgtacgcgtaactccggactacccgggtnttaccgttgtacccg

SEQ ID NO: 74053 - DNA, 770 bp, Homo sapiens
  misc_feature: GYAE6OF02IR1VF.49.46.E02.1.454.CMB.1.raw
  modified_base (294)..(294): a, c, t, g, unknown or other
  misc_feature (294)..(294): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccacctgtctttgtctccaggggacagtgccaccctctcctgcagggccagtcagagtgttagtagcttcttacgcctaggtaccaacgacgaaacctggaccaggcctcccaggctcccncatctatgatgctactccaacgcgggccacgtcggacactacccgacgcctaaggttcaggtggacgtaggtgggtcgtggtagtacgagtaccgttactaccgtcctacacctactccgaacgaccacggtccctaaaggaccgttaccgtaaggtaaacggttactttcgtaacggttaccgttttaagtttttaaccgtttaacgtttacggtaccgtaacgtaccgtaagggtaacccgttaagggaaaccccttaacggtttcccgggttacccgtttaccgtttaacccggttacccgggtttttacggggaaccgggggggtaaacccgggtaacccggggttaaagggggtttacgggtaaacccggtaacggttaaaacccggtaaaaccgggttaacggttacggggttacggtaccgttaacgggtaacccgtaacccttacgttaccggtttcggtttaacccc

SEQ ID NO: 74054 - DNA, 659 bp, Homo sapiens
  misc_feature: GYAE6OF02I7KHY.49.46.E02.1.454.CMB.1.raw
  modified_base (242)..(242): a, c, t, g, unknown or other
  misc_feature (242)..(242): n is a, c, g, or t
  modified_base (311)..(311): a, c, t, g, unknown or other
  misc_feature (311)..(311): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgcccaccctctcctgcaggccagtcagagtgtagagcttnttagcctggtaaccaaacagaaacctggaccaggtcctacccaggtctcctcattctatgatgacctanacccaaacgcggaccaactggaccactaccccaagcctaaggttcaggtggactagggtcggtactaggtgacgagttacctactaacgtcctaccgaactagtacacgcgtaaccaccgtaaggaacctcgttaaactaaaggttacttaccggtataccgttaacgtttttaaattacgttacgtacacgtcgagacgtaagacctaacgtccggtccttacgttacttacgggttacccggaagggaaccgggtactaagggggttacgaacgtaagtaacccgtaaaacggtaccgttaggtaccggacttacggtacctaaccgtagttacccgttaggttcc

SEQ ID NO: 74055 - DNA, 601 bp, Homo sapiens
  misc_feature: GYAE6OF02I62AI.49.46.E02.1.454.CMB.1.raw
  modified_base (231)..(231): a, c, t, g, unknown or other
  misc_feature (231)..(231): n is a, c, g, or t
  modified_base (401)..(401): a, c, t, g, unknown or other
  misc_feature (401)..(401): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccacctctcctgcagggccagtcagngtgttagtagcttcttacgcctggtaccaacagaaacctggacccaggcctcccgaggcctcctcattctatgatcgacactccaaagcgggccagtcggcactcccaggccaggttccaggtcggctaggtgggtcctgtgactaggtacttcacgtctacacctaatnacgcacgtaccgtagcgtacctaggaacgtacttcgcgtacttacgtttaattacctcgtcaagtcaggttcgacgtacctaacgtcggtccttactaccgttacgtttaccgggacggacggtaaccgtagggttacggacgtgtaaccgaaaggtaccgttggtacggacgtcgtacctaccgctttacgtgttaccc

SEQ ID NO: 74056 - DNA, 646 bp, Homo sapiens
  misc_feature: GYAE6OF02HG7W1.49.46.E02.1.454.CMB.1.raw
  modified_base (299)..(299): a, c, t, g, unknown or other
  misc_feature (299)..(299): n is a, c, g, or t
  modified_base (389)..(389): a, c, t, g, unknown or other
  misc_feature (389)..(389): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccaggggacagtgccaccctctcctgccagggccagtcagagttgttagtagctttcttagccgttaggtaccaacagaaacctggaccaggcctcccgaggcctcctnactctatgatgctactaccaaacgacgggccacgtggccactcccgaagccgtaggttcacggtcggacctagggttgggttcctggtanaccgaggttaccttccactctacccacctagtcgaacgcaacggcctaaggaccgaccgttagaaacgtcgttctgtaccgttagttttaacttacgtagttccgagtacgacgtcgttacgacctaacgtcgttacccttcgtccttaaccgggttcggaccgggtacgggacgtagggtaggaccgtaacgtaccggtaaacggtacttagggtacgttccgtacggtaccgacccttaggttccttacgttacc

SEQ ID NO: 74057 - DNA, 581 bp, Homo sapiens
  misc_feature: GYAE6OF02F4WL5.49.46.E02.1.454.CMB.1.raw
  modified_base (351)..(351): a, c, t, g, unknown or other
  misc_feature (351)..(351): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctcatctatgatgcatccaacagggccactggcatcccagccaggttcagtggcagtgggtctgngacagtacttcactctcacctatcagcacgcctaggactcctaggaaagtacttcgtgtccttaaggttttacttaacttggtactagcctaggccgttaagacctaacgttcggccttctcctacgtttcggaccgggaacgggacctaaggggtcggaaggtaactaaccgaaaacgggtaccgttaggtaggccttacggcctaaccgtacttccgtaggtttaccc

SEQ ID NO: 74058 - DNA, 583 bp, Homo sapiens
  misc_feature: GYAE6OF02FTY6H.49.46.E02.1.454.CMB.1.raw
  modified_base (310)..(310): a, c, t, g, unknown or other
  misc_feature (310)..(310): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacgnggccactggcatcccagccaggttcagtggcaggtgggtctgtgacaggtactttcacttctccaccctatcaagccaacgcctagacgtccctagaacgtattctaggctaaggttttactacttgtccagctacgcgttagacctaacgtcggtaccttctacctacgtttccgggacggtaacgggaccctaaggggtcggtaacggtaacgtaaccgaaaaccggacgttggtacggaccttcggacctaccgtattcccgtagttccc

SEQ ID NO: 74059 - DNA, 588 bp, Homo sapiens
  misc_feature: GYAE6OF02H1BO4.49.46.E02.1.454.CMB.1.raw
  modified_base (354)..(354): a, c, t, g, unknown or other
  misc_feature (354)..(354): n is a, c, g, or t
  modified_base (356)..(356): a, c, t, g, unknown or other
  misc_feature (356)..(356): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtagcttcttagcctaggtaccaacgagaaacctggccaaggctcccaggctcctcatctatgatgcatccaacagggccactggcatcccagccaggttcagtggcagtggtctgtnanagactcacgtctacaccatcagacacgactagacnctagaaactnttcngtcttaatttacttacgngttaccagtcaaggtcgtacgactaaaccgtcggtacccttcttaccgtacggttttccgggaccgggtaaacgggacccgtaagggtcggaagtaacgtaccgaaaacggtaacgtggtacgtccgttacggacctaacccgtaacgttcgtacgtttaacccg

SEQ ID NO: 74060 - DNA, 900 bp, Homo sapiens
  misc_feature: GYAE6OF02GLAA6.49.46.E02.1.454.CMB.1.raw
  modified_base (289)..(289): a, c, t, g, unknown or other
  misc_feature (289)..(289): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctccaggctccncatctatgatgcatccaacgcgggcccacgtgggaccactccccaagcccgtaggttccaggttcggactagggttcgggggttccttgggtacggtaaccgaacggttacctttaccgaacccgtttccctaccctaacccctaagttcccgaaacgggtccctaaaccggtaccccgttaaacgggtaaacccggtccccgtttaaagggaaaaccggttaccgtttacccgttaacgggtacccgtttaaacgggtttttttaaacttttaacccggtttacggttaaacccttaaaaccgtaccgggttaaccccggttaaacccgtaaaccggttaaacggggttaactttttaccccgttaacccggtttttttaccccgggggaacccccccggttttaagggggggtaaacccccttaaaagggggttaaaccgggtttacggggaaaccgttttaaaccgtttaaaccccggtaaaaaccgggtttaaacccgtttacggggtttaaccgggttacccggtttaacggtaacccccgttaaccccggttaaacgttttaccccgggtttcggtttttacccgtttaaccccgttaaccccgg

SEQ ID NO: 74061 - DNA, 604 bp, Homo sapiens
  misc_feature: GYAE6OF02GCZFI.49.46.E02.1.454.CMB.1.raw
  modified_base (288)..(288): a, c, t, g, unknown or other
  misc_feature (288)..(288): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccacctctcctgcagggccagtcagagtgttagtgcttcttagcctggtaccaacagaaacctggccaggctcccaggctcctnatctatggtgcatcccaccgacgggccacgtggtactcccagcccgaggttcaggtggcaggtgggtctggggacaggtagttcacgtctcaccatcaagcagcctgctagtctagtaagtattttgacttagtttaattacgttgtcagtactaacgttaattaaactttacgtaggttccgtttagtttttcgggaccgtaacgggggtaacctaagggtacctagggtacgtacgtacgtacggacggtaacgtggtacggtcgtcggacctacgtacgttcttcgttcctttacgtacttcccgttaccccg

SEQ ID NO: 74062 - DNA, 767 bp, Homo sapiens
  misc_feature: GYAE6OF02IYYTK.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccacccttcctccgtcgcgacgggccagtcgaggtagttagttagtacgttcctttacgtacgccgtacggaaccaaacgaacgaaaccgtcggaccgacggtccttccccgacgggcctccccgtactacttctagtgtagtcgactactaccgaacggtaccgggaccaacgtcggacctacgtaccccgacggtaccgtaggttcgacgtcggacgtagggtcggttacgtgtacgaacgacgttaccttcgtaaccttccgtaccaacctacgttacgacggacctacggtaccgtaacgaccgtacgtacgaaagttacgttcgtacgtaacgtttacgttttaacgtttaccgttactacgtacgtaccgtagacggttaaccgacgtaacgtccggtcccttaccgttaccgtttacggttcccggggaaccgggtaacggggaaccgttaacggggtacggtaacggaaccggtaaaccgtaaaacgggttacgtaacggttcgggtacgttacgggacccttaaccggtacgtttccgttaccgtttacccg

SEQ ID NO: 74063 - DNA, 628 bp, Homo sapiens
  misc_feature: GYAE6OF02JY7HD.49.46.E02.1.454.CMB.1.raw
  modified_base (222)..(222): a, c, t, g, unknown or other
  misc_feature (222)..(222): n is a, c, g, or t
  modified_base (270)..(270): a, c, t, g, unknown or other
  misc_feature (270)..(270): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactacccaccggaagaaattgtgttagacacagtctccggccaccctgtctttgtcctccgaggggactagtcgcccacccttntcctgcgagggccagtccagtagtgttagagcttctagcctggaccanacgaacctgccagcctaccaggcctcctacatcgtactgatcgcatacccaacgacggccacgtcggactacgtacccaggacctagggttcagggttacggcttagggtcgggtctacggtacgacaggtaccttacacgttccactacctatcgaactccgagacccgtagaccgacgtacgtaagtcttcgtcgtactagtttataccgtagtcagctaggactgacctacgcgtacctcgtacttaccgggttaccggagtacgggtacccgaggtcggtaaccgtaagtaacccgaaggttaacgcggttacgggaccttcggtaacccacgttacgttccgtaggttaaccg

SEQ ID NO: 74064 - DNA, 672 bp, Homo sapiens
  misc_feature: GYAE6OF02HYT61.49.46.E02.1.454.CMB.1.raw
tcagagtcgagagacacgaccggtgctcgatttagactcatctacagggaaagggggaggaactgctcagttaggacccagagggaaccagtggaagccccagctcagcttctcttcctcctgctactctggcctcccagataccaccggagaaattgtgttgacacagtctccggccaccctgtcttgtctccgaggggacagtgccaccctctcctgcagggccagcacgagtgttagtagcttcttagcctggtaccaacagaacctgccagctaccaggctccgtcagtctaatgactcgacgtatacccgtaacgacgggccctaacgtcggacaacctccccgacggcccgtaagggtttccaacggttcggaccgtaaggggttccgggtacgttcgggtacggtaacccgtacgtaaccggtttccaaccgttccgtaccctaaccgtacgtacgtaaccgtccgtaaccgtacccggttaagaaccggtacctaggtaaaacgtgtttcccgaggttacctaagttttacgtactgttaccgagtcgaacgtcacggtacacgtcgtacctctaccgttcgtggacgtacgggtaccgaggttcgagactaaccgaacggtcgtacgtagtcgccggtaaccaccgagttcccgagtttaccg

SEQ ID NO: 74065 - DNA, 538 bp, Homo sapiens
  misc_feature: GYAE6OF02H82J4.49.46.E02.1.454.CMB.1.raw
  modified_base (263)..(263): a, c, t, g, unknown or other
  misc_feature (263)..(263): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (403)..(403): a, c, t, g, unknown or other
  misc_feature (403)..(403): n is a, c, g, or t
  modified_base (416)..(416): a, c, t, g, unknown or other
  misc_feature (416)..(416): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtgcccaccctctcctgcagggccagtcagagtgttagtagcttcttagcctggtaccaanagaaacctggccaggctcccaggctcctnatctatgatgcatccaacngggcactggcactccagcctaggttccagtcggcaggtggtctgtagactagacttcactctcaccatcagcagtcctagacgcctagaatntctgataagtttntactgtacagcagcgtanactacncgcctcgttactccggttcggacggacggacgtagggtacggagaactaccgaaacggtacgttggtacggtactcggacctacgatttcgagttacc

SEQ ID NO: 74066 - DNA, 701 bp, Homo sapiens
  misc_feature: GYAE6OF02H3UX5.49.46.E02.1.454.CMB.1.raw
  modified_base (268)..(268): a, c, t, g, unknown or other
  misc_feature (268)..(268): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtcctccggcccacccttgtctttgtctccgaggggacagtgcccaccctctcctgcgagggccagtcagagtgttagtagtcttcttagcctggtaccaanagaaacctggccaggcctccccgagcctcctcatctatgatcgcatccaacgacgggcccagtcggacaccgttacccgagcccgtaggttcgaggtcggcgtagggttcgggtaccttgggtacgtacgtacggtacctttccgaccttcctaccgaccctagtaccgacgaccgacgtacccgtaagtaccggtaccttaggaaacgtacgtttacgtcggtactttaacggttttactttaacgttcgttacagtacgtaggttaccgtagaccgtaacgttcggtacccttaccgttaccgttaccggtttaccggggaccgggtaacgggtaaccggtaacggggttcgggaacgtacgttaaccggtaaacgttacggtaggttaccggtacgtacggtaccctaaccgtacttcgttaccgttacc

SEQ ID NO: 74067 - DNA, 757 bp, Homo sapiens
  misc_feature: GYAE6OF02I3723.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagttgttagtgcttcttagcctggtaaccaacagaaacctggccagctcccaggctcctcatctatgatcgcacgtccaacgtcgggccacgtcggaccacgtcccagccctagggttcaggtggcgtacgttcggggtacctggttacgaacgaacgttacgtttacccaacgttccttaacccgaaccgtactttaccgaacgtacctaaccggttacccgtaaaagggaccggtacccgttaggtaaaagggtaacttttaccggcgttaaccgtttaacgggtttttaacttttaacccgtttcggttaacggaacgttacccgaagggtacccggtttaacgaaaccgttaaccggtccgggttacccttaccgttccgtttaaccggttttacccggggaccggggtaacgggacccggtaaggggttcggtaacggtaaccgttacccggaaaacggtaacgtttaccgggacggttccgtaccggtcgtaacccctacgtttccgttacctttacccgg

SEQ ID NO: 74068 - DNA, 571 bp, Homo sapiens
  misc_feature: GYAE6OF02I16JT.49.46.E02.1.454.CMB.1.raw
  modified_base (426)..(426): a, c, t, g, unknown or other
  misc_feature (426)..(426): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggtacagtgccaccgtctcctgcagggccagtcagagtgttagtagtcttcttagctggtaccaacagaaacctgccaggctccgaggctcctcatctatcgatgcatcccaagacggccagtggcactcccgagccaggttccaggttcgcaggtcggtactggcacgtagaccttcgactccgtcaacctatcacgtccacggacctaggacgtcctagaagcttacngacctagtttaactgttgacatcgagtcgtacgctaagtcgaccttcgtactcgtttacggagggttacgaaccgtagggacgtaagaacgtaccgaaacgtacggttggtacggcttacggacctaccgtagtcttcgttaccg

SEQ ID NO: 74069 - DNA, 783 bp, Homo sapiens
  misc_feature: GYAE6OF02F72VO.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgccatccaacgcgggccacgtggccactcccagccgtaggttcaggtcggctagggtcgggtctggtcgaacacggtacttcaaccgttcctacctacctatcgacgcacgtcctaggacgtcccgttaggaacgttcgtttaccgtacggtacccgtttaaagttttactttaccgtttacggttacccgtaacgtaccgtacgggtaacccgttaacggtacccgttaaaccggttccgggttacccctttaccggttacccgtttaaacccgggtttttacccgggggaacccggggttaaaccggggttaacccgggtaagggggtttaacgggtaaccggggtaaaccgtttaaaaccccgggttaaaaaccgggttacccgggttttaacggggtacccgggttaaccgtttaacccggggtaaccccgttaaccccgttaaccgggttttccccgttaacggttttttaacccccgg

SEQ ID NO: 74070 - DNA, 673 bp, Homo sapiens
  misc_feature: GYAE6OF02F4X4L.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccaggggtacagtgcccaccctctcctgcagggccaggtcagagtgttagtagcttcttagcctggtaccaacagaaacctggccaggcctcccgaggctccctcactctatgatggacatccaacgacgggcccacgttcggccactccccgagcccctagggttccaggtcggccgaaggttcggggtctccgtacgacgtacggtaccttcaccgttcttcccaacccgtattaccgacgtaccgaacgtacccgtaaggaccgtaccgttacggaaacgttactttcgtacgtacccgtttaaggttttaacttaacttcgggtaacctaaacgacggtacccgttaaccacgtacggttactttaccgtaccgtttcccggacccggttggaacccgtaggtacgtagtactactaacgtaaacgtaacgtggtacggacgtagacctacgtacttcttacggttacctacttacccg

SEQ ID NO: 74071 - DNA, 763 bp, Homo sapiens
  misc_feature: GYAE6OF02IRMUO.49.46.E02.1.454.CMB.1.raw
  modified_base (208)..(208): a, c, t, g, unknown or other
  misc_feature (208)..(208): n is a, c, g, or t
  modified_base (239)..(239): a, c, t, g, unknown or other
  misc_feature (239)..(239): n is a, c, g, or t
  modified_base (422)..(422): a, c, t, g, unknown or other
  misc_feature (422)..(422): n is a, c, g, or t
tcagagtcgagagacacgaccggtgctcgatttagactcatctacagggaaaggggaggaactgctcagttaggacccagagggaaccatggaagccccagctcagcttctcttctcctgctactctggctccagataccaccgagaaattgtgttgacacagtctccggccaccctgtctttgctccagggacagtcgcctaccctntacctgacagggccaggtcagtacgtgttanagtcttctaggccttacggaaccaacacgtaaacctggccaggtcctccgaaggtcctccctacgactactagaggtaactcgacctaactacccgaaaccgagggccctaaacgtcggactaaccgttcccgaaacggtccgtaacggtttacgacggttggaccgtaagggttccgggttntacggtaacgtaccgtacggtacctttacgaaacccttccggtaccctaaaccgaacgtttacccacggtaccgtaacgtacccggtaacgtaccgtaccgtaacggtaacgtaacgttccgtacgtacgttaagtttaaccttacgttacgtacgtcgacgtacgtacggtaacgtaccgtaaccgtcgtacccttaccgtaccgttaccgtttaccgggaccgggttaacgggtaccgtaacggttacggtaacggtaccgttaacggaaacccgtaacgttacggtaacggtaccggttccgtaacccgtacgttaacccgttacgttacgttacccg

SEQ ID NO: 74072 - DNA, 813 bp, Homo sapiens
  misc_feature: GYAE6OF02GP5L6.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagagtgttagtagcttcttagcctggtaccaaacagaacctggccaggcctcccgaggcctcctcatctactgatgcactccaacgcgggacccacgtgggacctaccgtacccgaacgtacccgtaagggtttaccgaacgggttcgggaccgtaacggggttcgggggttacgttggggttacgggtaaccgtaacggtaaccgttttacctaaccgtttcccttaacccctaacccgtaacgtttaacccgaacggtacccgtaaaccggtacccgtaaccggtaacggtacccgtacggtaaacgggttaactttccggttacggtaccgtttaaagtttttaactttacccggttacggtttaccgtaacggtaccgtaacgggttaccgtaacggtaaccttaaaccggtccggttaccctttccgttaccgttacccggtttccgggaccggggtaaccgggtaaccggtaacggggtacggaacggtaaccggttaaacggtaaaacccggtaacgttccgggttaaggtaccgttacgtacccgtaacgtaaccgttcgtttaacgttaccccg

SEQ ID NO: 74073 - DNA, 593 bp, Homo sapiens
  misc_feature: GYAE6OF02INZHU.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagtcttcttagcctggtaaccaacagaaacctggccaggcctccccgaggcctcctcactctatgatgcactaccaacgcgggccacgtggacactcccagccaggttcagtggctaggtgggtctgtgacagtaccttcactctacaccatcgagcagacctagacgccgtagaacgtacttcgtgtacttagtttattactcgtcagtcagtcgtacgacgtaacgtcgtccttacttctaccggtttcggacgggtaacgggtaccgagggtaggacggtaacgtaaccgaaacggtaaccggttcggtacggtacgtacggtaccaacccgtacgttccgtacgttaccg

SEQ ID NO: 74074 - DNA, 595 bp, Homo sapiens
  misc_feature: GYAE6OF02I4JY5.49.46.E02.1.454.CMB.1.raw
  modified_base (373)..(373): a, c, t, g, unknown or other
  misc_feature (373)..(373): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggcctcccgaggcctcctcattctatgtatgctataccaacgacgggccacgtcggccactccccaagcctaggttcaggtggactaggtgggtctggngactagtacttcactctaccacactcagcacgtcctagcgtcctagaacgtcttcagcttagtttacttcgtgtacagcagtcgtagaccgtaagtcggactacttcctaccgttacggttcgggacgggtaacggaccggtaagggtacggtaacgtacgtaaccgaaacggttaccgttaggtacggtctaccggacctacccgttagttccgttaccgg

SEQ ID NO: 74075 - DNA, 621 bp, Homo sapiens
  misc_feature: GYAE6OF02HMW8T.49.46.E02.1.454.CMB.1.raw
  modified_base (289)..(289): a, c, t, g, unknown or other
  misc_feature (289)..(289): n is a, c, g, or t
  modified_base (438)..(438): a, c, t, g, unknown or other
  misc_feature (438)..(438): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggcaggctcccaggctcctnatctatgatggcactaccaacgacggggcccaacgtgggacctactccccgagtaccaggtttccaggtggcaggtgggtctgtagacagtacttcactcacacctatcagcacgtacctaagagtccctaaggaaacgtacgtttacncggtactttaacggtttttaacttaacgttcgttacagtcctaacggtccgtaagtaccgttaaacgtccggacccttacgtaccgtaccggtttccggacgggtaacggaccgtaagggtggaaacggtactacgaaacggtacgttcggtgtactcggacctacctattacccgtgttacc

SEQ ID NO: 74076 - DNA, 627 bp, Homo sapiens
  misc_feature: GYAE6OF02FORD8.49.46.E02.1.454.CMB.1.raw
  modified_base (612)..(612): a, c, t, g, unknown or other
  misc_feature (612)..(612): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagagtgttagtagtcttcttagcctggtaccaacagaaacctggccaggcctcccgaggcctcctcatctatgatcgctactaccgaacgacgggccacgtggccactcccagtaccctaggttccaggttcggctagggtcgggttctggtacgaacgtacggtaccttcgacctctaccacctatccagaccacgcctagacgtacctaggaagtacttcgtgtacttagttttacgtaccttggtacagtactagtaccgtacgacgtaacggtcgtcccttacgtaccgttacggtttccgggacgggtaacggaccggtaaggtcggaagtaacgtaacggaaaccgtacgtggtacggtacgtaccgacctaccgnttccgttgttacccg

SEQ ID NO: 74077 - DNA, 801 bp, Homo sapiens
  misc_feature: GYAE6OF02GCNWM.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaaccaacagaaacctggccaggctcccaggctcctcatctatgatgcactacccgaaacgacggggcccaacgtcgggccctaagtcccccaaggcccgtaaggggtttcaagggtcggggacctagggttcgggggttctggttcggaactacggtactttaccaaccttccttaccgaacccttaatccaaacggtcccaacggtacccgtaaggaacggtccctaaagggtaaacgtactttcccggtaggtacctttaaaggtttttaactttaccgttagggttaaccaacgggtccgtaagggaccggttaacggaccgttaaacccggtccgggttaccccttacccggtttaccgttaacccgggttttaccccggggaacggggggtaaacccggggtaaccccggtaaaggggggttaccggtaaacgggtaacggttaaaccggtaaaaacgggttaaacccgttagggggttacccggtacggttacccgggaaccgttaacccgtaacgtttccggttaccggttttaacccg

SEQ ID NO: 74078 - DNA, 559 bp, Homo sapiens
  misc_feature: GYAE6OF02GD5UA.49.46.E02.1.454.CMB.1.raw
  modified_base (447)..(447): a, c, t, g, unknown or other
  misc_feature (447)..(447): n is a, c, g, or t
  modified_base (547)..(547): a, c, t, g, unknown or other
  misc_feature (547)..(547): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagtcttcttagcctggtaaccaacgagaaacctggccaggcctcccgaggcctcctcatctatgatgcactccaacgacgggccacgtggccactccccagccgtaggttcaggtcggctaggttcgggtctggtagacagtacttacactctacacctatcagcacgctagcgctagagtcttcagtctatttatactgtacgagcngtcgtagacgacgtcgaccttctccgttaccgttcggacggtacggaccgtaggtcgagtacgtaacgaacggtacgtggtacggtacctacgaccactnttccgtgttacc

SEQ ID NO: 74079 - DNA, 848 bp, Homo sapiens
  misc_feature: GYAE6OF02IZLGQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctcccggccaccctgtctttgtctccgaggggacagtcgcccaccctctcctgccagggccagtcagtagtgttagtagtctttctacgccttaggtaacccaacgtaacggaaaacctcgggacccgacggtcctaccccgaacgggtccttaccccgttacgtaacttaccgttaagttcgggtaattacggaccctaaacgtttaccccgaaaaccggtaccgggggtacccctaaacggttcggggacctaaccgttacccccgaaggtaccccggttaacggggtttacccgtaagggtacccggggtacgttaacggggttcggggggtttacctttacggggtaaccgtaaccggtaacggtttaacccgtttacctaacccggtttccccttacccgaaaacccttacgtacggaccgtaccgtaaccggtaccgtaaacggtaccgtaccgttaagggtaaacgttacttccggtaacgtacgtttaacggttttattacgtcgttacgtacgaccgtacgtacgtaccgacgtaacgtccgtcctaccgttcgttaccggttccggaacggtaacgggtaccgtaaggggtacgtaacgtaacgttaaccgaaacggtacgttcggaccggtacgtccggtaaccacgtaccgttaccgttgttaacccg

SEQ ID NO: 74080 - DNA, 661 bp, Homo sapiens
  misc_feature: GYAE6OF02IMIOS.49.46.E02.1.454.CMB.1.raw
  modified_base (651)..(651): a, c, t, g, unknown or other
  misc_feature (651)..(651): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccaggggacagtgccaccctctcctgcgagggccagtcagtagtgttagtagtcttcgttagccttaggtaaccaacgaagtaaacctggaccaggcctcccgaggcctcctcattactatgatcgactactaccaacgacggccacgtcggctacgtcccagtcctaggttcgaggtcggcgtaggtgggtctggagactacgtacttacacgttcctaccacctacgtacacgactaacgtaccgaaggacgtaccttaggtaaacgtactttccgtagtacgttaacgttttaacttacgttcgtacagtcgtacgtacgtaacgtacgtaacgtcggaccctttcgtaccgtttaccggttcgggaaccggtagggtaaccgtaagggtcggaaacggtctaaaccgtaaacgtacgttacggtcgtaccgtacggaccgtaaccgtagttttccgngtttaacccg

SEQ ID NO: 74081 - DNA, 641 bp, Homo sapiens
  misc_feature: GYAE6OF02IKR77.49.46.E02.1.454.CMB.1.raw
  modified_base (226)..(226): a, c, t, g, unknown or other
  misc_feature (226)..(226): n is a, c, g, or t
  modified_base (296)..(296): a, c, t, g, unknown or other
  misc_feature (296)..(296): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccgccacctgtcttgtctccgagggacagtgccaccctctcctgcaggccagtcagngtgttagagtcttcttagcctaggtaccaacgagaaacctgggaccaggcctaccgacggtcctaccctnactcctatggatcgcaactccgaacgacggccctacgtcggctaactcccgagcctaggtacagtcgcgaggtgtcngtanacncgtactccaactccgtcaccgtatacgactcgacgtacgttagacgtccgtagtaagtacttccgtagtaccgttaagtttaccgttacgtcgttacgacgttacgacggttacgtaacggtaccgtaacggccgttccctaacggttccgttacggtttcccgggaacggtacgtaacccgggtaggtacggtaacgtaacggtaacctaaacggttaggtacggtcgtaccgtgtaccacgtactttcggtacttaccg

SEQ ID NO: 74082 - DNA, 784 bp, Homo sapiens
  misc_feature: GYAE6OF02JW2TG.49.46.E02.1.454.CMB.1.raw
  modified_base (677)..(677): a, c, t, g, unknown or other
  misc_feature (677)..(677): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagatacccaccggagaaattgtgttgacacagtcctccggccaccctgttcttgtctccgagggaccagtcgccctaccctctcctgccgacggggtccaggtcaggtaggttcgtttaaggtagtctttacgttaacggtcccgttagggttaaacccaaacgtaacggtaaacccgttggaccctaacggccttaccccggaacggtccttaccctcgtacttctaacgtgactacgaccgtaacttacccgaaaccggacgggtccctaacggttacgggtccaaccgtaccccgagtaccgtacggtttcgacgggttacggacgtacggtttgggtaccgttggtaccgaacgtaacggttacctttccgacgttaccctaccgtaaacccgtacgttaccacgaccgtacgtaacccggagttaacccgccgttaagtaacgttccgtttaacgtcgttaccgttaaggttttaacctttaccgtgttaaccgacgtcgtaacggtaacgtccgtaacggtacgtcgtaccgtnttacccgttaggtacccggaagggtacggacgtagggttacgaccgtaaggtaaccaagggtaacgtcggtaagccgtacaaccggttcctaacggtctacggttac

SEQ ID NO: 74083 - DNA, 556 bp, Homo sapiens
  misc_feature: GYAE6OF02IKP01.49.46.E02.1.454.CMB.1.raw
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
  modified_base (407)..(407): a, c, t, g, unknown or other
  misc_feature (407)..(407): n is a, c, g, or t
tcagagtcgagagacacgaccggtgctcgatttagactcatctacagggaaagggggaggaactgctcagttaggacccagagggaccatggaagccccagctcagcttctcttcctcctgctactctggctcccagataccaccggagaaattgtgttgacacagtctccggccaccctgtctttgtctccaggggacagtgccaccctctcctgcagggccagtcagagtgtagtagcttcttagcctggtaccaanagaaacctggccaggctcccaggctcctnatctatgatgcactccaacgagggccacgtggacactcccgagccaggttcagtggcaggtggtctgtgacagacttcactcacaccatcagcagcctagagacctggtaactacttcngtacttagtttacttacctgtacagcacgtcgtacgacaacgtgcctactactaccggtttcggcgtacgggactagggtacggaacgtagtaaccgtaaacgaaccgttgtacggccttaggacctaactacgtccgttacgttaccg

SEQ ID NO: 74084 - DNA, 762 bp, Homo sapiens
  misc_feature: GYAE6OF02IEROK.49.46.E02.1.454.CMB.1.raw
tcagagtcgagagacacgaccggtgctcgatttagactcatctacagggaaagggggagaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcgagggccagtcagagtgttagtagcttctagcctggtaccaacgtagaaacctggaccaaggcctcccgaggtcctccttacaattccaagttcgatcggacctaattacccgaaaaccgaggggacccctaacgtcgggacctaacgtcccccgaggtaccccgtaaggggtttccaaacgggttggacccgtagggttggggttcctggtacgaactaaggaacttttccaaacttcctaccaaccgtaattccgaacgcaacggtaccccgttaaggaacgggtaccccttagggaaaacgtacgtttacccgttaggttacccttaaagggttttttaacctttaacgtacggtttacccgaaggtacctaaacgggtcggtttaaacggaccttaaacggtcgggtcccttcttaccgtaacgttttcgggaccggggaaacggggtaccgtaacggggtggaacggtaaccttaaccggaaaaaaccggtaccgttaggtccgggaccttacgggccaacctacttaccgtgtttaccc

SEQ ID NO: 74085 - DNA, 738 bp, Homo sapiens
  misc_feature: GYAE6OF02I4PSA.49.46.E02.1.454.CMB.1.raw
  modified_base (152)..(152): a, c, t, g, unknown or other
  misc_feature (152)..(152): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagactaccaccgganaattgtgttgacacagtctccggccaccctgtctttgtctccgaggggacagtcgccaccctctcctcgacgcggccagtcagagttagttagtagtctttcgtacgccgtaggtaacccaacgaacgtaaccgtcggaccgacggtcctacccgcgtccctaccgtacctacttcgtaactgtatcgaccactaccgaacggcggtaccacggtacgacctaccgtcccgaacgtccgtaggttccaacgggtcgtacggtacgggttcggggtcttacgcggaacgtaagtcctttaccgctttacccaccgtaccagtaccacgtacgactaccggaagccgtactagtactcgttcgtacgtctttaacgtttctaacgttcgactaacgtcgtacgggtactaaccgttacgtaccgttccggtacctttacccggttaccggttaccgttccgggaaccgggtaacgggtacccggtagggtaccggtaacggaaacgtttaaaccgaacggggttacgtccgggtacggttaacccgtcggttaacccgacctttacgggttacccgttagtttcccgg

SEQ ID NO: 74086 - DNA, 725 bp, Homo sapiens
  misc_feature: GYAE6OF02GVUVP.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgcccacctctcctgcagggccagtcagagtgttagtagcttcttagcctaggtaccaaacacgaaacctggaccaggctcccaggctcctcatctatgatgctactccaacgacgggcctaacgtcggcgtaactcccgacgtccctaggtttcaacggtgggtcctaagggttcggggtaccgttggtacggtaacgacgtacgtttaccgaacctttcctaccgaaccctaacgtcaacgacgtaacgtaccgttaacgaccggtaccgtaggtaaacgtaccgttttaccgtacgtaccgtttaagttttaacgtttaacggttcgtttacgacgtaccgtaaggtaccggtagtacctaaacggtcgttcccgttacgttacccgttacgtttccggggaaccgggtaacgggaaccgtaaacgggggtcgtaacgggtaaactaaccggaaaaccggttaacgttacggtcgggtacccggtacggaccctacggtaacttcgttaccgtttaaccg

SEQ ID NO: 74087 - DNA, 696 bp, Homo sapiens
  misc_feature: GYAE6OF02J1AC2.49.46.E02.1.454.CMB.1.raw
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtcctccgaggggacagtcgcccaccctctcctgccagggccagtcaggtacgtgttagtagcttctacgtccgtggtaccaacaacgtaacctggaccacggcctacccgaggtcctccgtcatctatgatcgacactaccgaacgacgggcccacgtcggacctacgtcccgagtcccgtaaggttccgaggtcggacgtagggttcgggtcgtgtacgacgtacgtaccttcgacctcctaccncctactccgcgacncggtaccgtaggccgtactagaacgttacttcgacgtcgttaatttacttacgttcgtacacgtacacggtcgtaagacccttaaggtccgtaaccttcggttaccccgtaaggtttccggggaaccgggtacggggaacgtacgggacggtaacggttaaccggtaaccgtaaacggttaaccgtaggggtccggtaaccggtaccggaaccgttaccttaaccggttaccggtttacccgttaccg

SEQ ID NO: 74088 - DNA, 596 bp, Homo sapiens
  misc_feature: GYAE6OF02I349X.49.46.E02.1.454.CMB.1.raw
  modified_base (381)..(381): a, c, t, g, unknown or other
  misc_feature (381)..(381): n is a, c, g, or t
  modified_base (540)..(540): a, c, t, g, unknown or other
  misc_feature (540)..(540): n is a, c, g, or t
  modified_base (591)..(591): a, c, t, g, unknown or other
  misc_feature (591)..(591): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagctttcttagcctggtaccaacacgaaacctggccaggcctcccaggcctcctcatctatgatgctatccaagacgggccacgtcggactactcccgagcccgtaggttcaggttcggcgtaggtcgggtctgtcgaacgngtacttcacttcaccacctatccgagacacgcctagacgacccgtaggtaagtacttcgtcgtacttaggttttactacgttcgtacgacgtacacggtcgtacgacgtacgtcggtaccttccgtcttaacggttccgggacgggtacggacgtaggnggaagtactaacgaaacgtacggtgtcggtactacgcctaacgtcttcgtnttacc

SEQ ID NO: 74089 - DNA, 668 bp, Homo sapiens
  misc_feature: GYAE6OF02GR1F6.49.46.E02.1.454.CMB.1.raw
  modified_base (216)..(216): a, c, t, g, unknown or other
  misc_feature (216)..(216): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtcctccggccaccctgtctttgtctccaggggacagtgccaccctctccngcagggccagtcagagtgttagagcttcttagcctaggtaccaaacagaaacctggaccaggcctcccgaggctcctcatctatgatgacatccgaagacgggccagtggacactcccagcctaggttccaggtcggaccgtagggtcgggttctggtacgaacgtagtacccttacgaaccttcctaccgaaaccctagttaccgacgacaacgtaccgtaagacgtacccgtaaggaacttacttacgtgtaacgttaagttttaacttacgttcgtacgtaacgactacggtacggtaagaccgtaacgtccggtaccttcgttaccgttaccgggtttaccgggacgggtaccggggaaccgaacgggttacgaaggtaaactaaccggaaaccggttaacgtacgggtacggaccttacggaacctaccgtagttccgttagttacc

SEQ ID NO: 74090 - DNA, 757 bp, Homo sapiens
  misc_feature: GYAE6OF02GZYB9.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacacgaaacctggccaggcctcccaggcctcctcatctatgatgcatccaacgacggccactggcactcccagccaggttcaggtggcgtaggtgggtctggtacgacgtacgactttacaccttctacacccgtaattaccgacgaccacggtacccgttaacggacgtaccgttaggaaacgttacgtttaccgtggtaccgtttaaggttttttaactttaacgttacggttacccgtaagtaccggtacggttaaccggttacggaaccgttaaaccggtcccgggttcccgttacccgttacccggtttaacccgggttttacccggggacccggggtaaacgggggtaaccccggtaacgggggttacggggtaaacggtaaccgggtttaaacccggtaaaaaccgggtaaccggttaccgggttaaccgggtaccgttacgggaaccccgttaacccggtaaccggttttcccgttaggttttacccccg

SEQ ID NO: 74091 - DNA, 616 bp, Homo sapiens
  misc_feature: GYAE6OF02I5KQV.49.46.E02.1.454.CMB.1.raw
  modified_base (264)..(264): a, c, t, g, unknown or other
  misc_feature (264)..(264): n is a, c, g, or t
  modified_base (305)..(305): a, c, t, g, unknown or other
  misc_feature (305)..(305): n is a, c, g, or t
  modified_base (312)..(312): a, c, t, g, unknown or other
  misc_feature (312)..(312): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccaggggacagtgccaccctctcctgccagggcccagtcagacgtgttagagcttcttagcctgggtaccaacncgaaacctggccaggctccaggctcctcatctatgatcgcntccaacngggccacgtggcactcccagccaggttcagtcggactaggtcgggtctcggtgacgacggtaccttacaccgttctaccaccgtacttcgacgcacggtacccgttagacggtacctacggaagtacttcgtcgtacctaagttttacttacgtcgttacacgctaggaccgtagacctaacgtacgccctaccttccgtaccgtttccgggaacgggtaccgggaaccgtagggtacggaaggtaacgtaccgaaacggtaactacggtacggtcgacggcctaccacgttacgtcgttaccg

SEQ ID NO: 74092 - DNA, 750 bp, Homo sapiens
  misc_feature: GYAE6OF02JR2HX.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagactaccaccggagaaattggtgttgacacagtctccggccaccctgttctttgtctccgaggggacagtcgcccaccctctcctgcgagggccagtcagagttgttagtacgtcttcttacgccttgggtaaccaacgtaacgtaaacccgtggacccgacgggtcctacccgacggtcctaccgtctacttactagtcggtatcgactactaccaaaccgtacgggccacgtcggacctaccgtaccccgaggtccctaacgggttccgaaggttcggacgtaacgggttcggggtctcgggtacgaacgacgttaccttacgtaccttacccgtaaccacccgtaacgtccgaacggtcctaacggtcccgtaaggacccgtaccgtagtaaacgtcttccggaactcgttaacgttttacgtacgtcgtacctgacctcgtacgtacgtaccgaccgttacggcctttaccgtccgttaaccgggttaccgggacggtaaaccgggtacgtacgggtacggtaagtaaccggttaaacccaagggttaccttacgggtaccggtaaccgttcgtacccgtaacttaccggttcgtttaccgtaacccg

SEQ ID NO: 74093 - DNA, 619 bp, Homo sapiens
  misc_feature: GYAE6OF02HSCTQ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctcgaggggacagtgcccaccctctcctgcagggccagtcagagttgttagtagtcttcttagcctggtaccaacagaaacctggccaggctccgaggcctcctcatctatgatgacatccaacgacgggccacgtggccactcccagcctaggttcgagtggctaggtggtcttggtagactagtaccttcaccgttctaccgtaacctataccacgacacgaccgtaagcgtctaggaaatattccgtagtacgttaatttacgttaacgtgtacagtcgtacgtacgtacgacgtaccgtcgtcccttcgtaccgtaccgttaccgggacgggtacgggaccgtagggtacggaacggtaactaaccggtaaacgtacggtcggtacggtactaccggacctaacccgtacttccggttacttcccg

SEQ ID NO: 74094 - DNA, 579 bp, Homo sapiens
  misc_feature: GYAE6OF02INSI3.49.46.E02.1.454.CMB.1.raw
  modified_base (404)..(404): a, c, t, g, unknown or other
  misc_feature (404)..(404): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaagacgggccacgtggcatcccagccaggttcagtggcaggtggtctgtgacagtacttcactctcacatcagcagaccgtagacgtcctagaaacgtnttctgtacttagtttacttactgtacagtcagtactaacacgtcggccttctacttaccgtttcgggacggtacgggtaaccgtaaggggtcggaacggtacgtaacgaaaaccggtaacgttcggtacggtacgttacggaccctaccttacgttccgtcggtttaccttaccg

SEQ ID NO: 74095 - DNA, 591 bp, Homo sapiens
  misc_feature: GYAE6OF02GHSPE.49.46.E02.1.454.CMB.1.raw
  modified_base (211)..(211): a, c, t, g, unknown or other
  misc_feature (211)..(211): n is a, c, g, or t
  modified_base (416)..(416): a, c, t, g, unknown or other
  misc_feature (416)..(416): n is a, c, g, or t
  modified_base (457)..(457): a, c, t, g, unknown or other
  misc_feature (457)..(457): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcttgtctccaggggacagtgccaccctntcctgcagggccagtcagagtgttagtagcttcttagcctggtaccaacagaaacctggccaggctccaggctcctcatctatgatgcatccaacagggccacgtggcatcccagcctaggttcagtggctaggtgggtctggtacgacgagtacttcacgtctccaccatcgagcagcccgtagacgccttagaacgtattccngacttaagtttaacttacttgtacagtacaggtccgttaancgtaaccgtgggtacccttcgtacctacgtttccgggacggtaacgggtaccgtagggtaggtaacgtaagtaaccgaaacggttaacgttcggtacggtctacggacccgacctaacgttcgttagttacccg

SEQ ID NO: 74096 - DNA, 662 bp, Homo sapiens
  misc_feature: GYAE6OF02GJBQB.49.46.E02.1.454.CMB.1.raw
  modified_base (265)..(265): a, c, t, g, unknown or other
  misc_feature (265)..(265): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgagggacagtgccaccctctcctgcgagggccagtcagagtgttagtagcttcttagcctggtaaccaacanaaacctggaccaggctccaggcctcctcatctatgatcgcactccaacgacgggccacgtggaccactccccagccgtaggttcagtggctaggtggtctgtgacgacgtacttcaacttccgtaccaacctactaccgaacgccgtaccgtaccgttacgacgtaccgtagtaaacgttacgttccgtgaacgtttaagttttaacttacgtttacgtctacgtacgtaaggtcggtaacgtaccggtaaccgtccggtacccgttacgtacccgttaccggttccggggacgggtaaccgggtaaccgtaggggtaacggagtaaccggtaaactaaaccgggtaacgttacggtacggtacgtcgaaccctaacgtcttacggttcgttaaccc

SEQ ID NO: 74097 - DNA, 753 bp, Homo sapiens
  misc_feature: GYAE6OF02G3X8H.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcgacgggccagtcagacgtgttagtagctttcttagccttggtaccaacgagaaacctggaccaggcctccgaggcctcctcgatctatgatcgcatccaacacgggccacgtcgcactcccaggcctagggttcaggtcgacgtacggtcgggtctgtcggacacggtaccttcgaccttcgtaccacccgtacgtcacgtcgaacgtacccgttacggaacgtacccgttaggaaacgttactttccgtacggttacttaacggttttactttaacccgttcgttaaccgtacggtacaagggttacccgttaacggaccgtaaaccgggtttccgacccgtttaccgttacccgtttaacccgggttttaccgggacccggggttaacccggggaaaccgttaacgggggggttcgtaaacccggttacgtaaaaccccggtaaaaccgggttaacccgttccggggttaacggtcccggttaaccgggtaacccgtaacccgttacgtttccccggttagttttaaccccgg

SEQ ID NO: 74098 - DNA, 618 bp, Homo sapiens
  misc_feature: GYAE6OF02FSP2V.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcttgtctccaggggacagtgccaccctctcctgcagggccagtcagagtgttagtagcttcttagcctggtaccaacagaaacctggccaggctccaggcctctcatctatgatgcatccaacagggccacgtggcactcccgagcctaggttcaggtcggctaggtcgggtctggtgaacagtactctactctcaccgtatccagcctacgcccgtaagacgccgttagtaactacgttcctggacttaagtttacttaccgttgtaccgtacgtacagtcgttaacggcttaaaccggtcgtcccgttcctccgttaacgtttccgggagggtacccgggtaccgtaggggtcgtaacggtacgtaaccgaaaccggtaacgttcggcgggttacctacggtcccgtaaaccgtcttaccggttcgttacccg

SEQ ID NO: 74099 - DNA, 627 bp, Homo sapiens
  misc_feature: GYAE6OF02JGMOJ.49.46.E02.1.454.CMB.1.raw
  modified_base (382)..(382): a, c, t, g, unknown or other
  misc_feature (382)..(382): n is a, c, g, or t
tcagagtcgagagacacgaccggtgctcgatttagactcatctacagggaaagggggagggaactgctcagttaggacccagagggaaccatggaagccccagctcagcttctcttcctcctgctactctggctcccagataccaccggagaaattgtgttgacacagtctccggcaccctgtctttgctccaggggacagtgccacctctcctgcagggccagtcagagtgttagtacgcttcttagccctggtaccaacgagaaacctggccaggctcccgaggcctcctcatctatcgatgcaatcccaagagggccacgtggcatccccagccctaggttcagtcggcaggtcgggtctggtgacgacggtacttacnccgttactccaacctatccgagccacgtcctaaggaccgtcctaggaaactaactttctacgtacttaagttttacttaaccgttgtaccagtaccgtaacgtacggttaacgacgtaaccgttcggtcccttccgttacgtaccggtttacccgggacgggtaacggaacccgtaggggtgaacggtaataccgaaaggaccgttaggtcggtactaccggactaccgtacttcgttcgttacc

SEQ ID NO: 74100 - DNA, 587 bp, Homo sapiens
  misc_feature: GYAE6OF02GTYVB.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagtcttcttagcctggtaccaacagaaacctggccaggctcccaggctcctcatctatgatgcatccaacgacgggccactggccactcccagcccgaggttcaggtggcaggtgggtctgtgacagtacttcactctcacatcagcacgcctagacgccgtagaagtacttacgtgtaccttaagttttacttacgttgtacgagtacgagtcggtagaccgtaacgtcgtccttacttcctacggttccgggacgggtaacggggaccgtaacggggtcggaacgtaacgtaaccgtaaacggtacgtaggtcggtactacggccctaacgtcttacgtcttaccg

SEQ ID NO: 74101 - DNA, 570 bp, Homo sapiens
  misc_feature: GYAE6OF02IKV2Q.49.46.E02.1.454.CMB.1.raw
  modified_base (288)..(288): a, c, t, g, unknown or other
  misc_feature (288)..(288): n is a, c, g, or t
  modified_base (412)..(412): a, c, t, g, unknown or other
  misc_feature (412)..(412): n is a, c, g, or t
  modified_base (441)..(441): a, c, t, g, unknown or other
  misc_feature (441)..(441): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggcaggctcccagctcctnatctatgatgcatccgaaagacgggccacgtggacactcccagccgtaggttcaaggtggcaggtgggtctgtagacagacttcgactctacaccatcagcagccctagacgacctagaaagtntttcgagtacttaaggttttacttacgtntcgagtacagtacgttacgacgaacgtcggacccttcttcctacggtttcgggaccggagggaaccgagggtacggagaacgtacgaaacgtacgtgtacggtactggacctaaccattcctagttacc

SEQ ID NO: 74102 - DNA, 535 bp, Homo sapiens
  misc_feature: GYAE6OF02H8CYW.49.46.E02.1.454.CMB.1.raw
  modified_base (292)..(292): a, c, t, g, unknown or other
  misc_feature (292)..(292): n is a, c, g, or t
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (462)..(462): a, c, t, g, unknown or other
  misc_feature (462)..(462): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (527)..(527): a, c, t, g, unknown or other
  misc_feature (527)..(527): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccagggacagtgccaccctctcctgcgagggccagtcagagtgttagtagtcttcttagcctggtaccaacagaacctggaccaggcctcccgaggctcctnatctatgatgcataccaacgacgggccacgtcggacactcccagcctaggttcaggtggcgaggttggtctgtcgactagtacttcacttctaccactatcgacgcacgcctaggcnccgtagaagtnttacgtgtacttacgttttacttactgtacagcgtagcgtanactacgtcgcctcgtactcgttggacggagaccgtaggngantaacgagactgagtcagccactntcgtgtac

SEQ ID NO: 74103 - DNA, 805 bp, Homo sapiens
  misc_feature: GYAE6OF02J2KEE.49.46.E02.1.454.CMB.1.raw
tcagagtcgagagacacgaccggtgctcgatttagactcatctacagggaaagggggaggaactgctcagttaggacccagacgggaaccatggaagccccagctcagcttctcttcctcctgctactctggcctcccagactaccacggagaaattgtgttacgacacagtctcccggcctaccctgtccttgtcctccgaggggacacggtcgccctaccctctcctgccgagggtcccagtcagagttgttaaggtctccttcgttaacgccttacgggtaaccccaaaccgtaacggtaaaccccctgggacccgaacgggtccctaccccgaacgggtccctcccgtactaatccgttagtaccgattccgactaactaccgaaacggcggaccctagtacggtaccacctaacccgcgtaacccgtacgggttaccagggttacgccgtacgggttcgggtcttggtaaccacgtacggtacctttaccgaccttacccgtacaccctacgactaaccgtactacgtacccgacgtaccggaccgtaggtactacgttaccgtacgtaccgttaggtttaactaacgtcgtccgtaacgtcgtacggtaacgtaccgtaaccgtaccgttcgtaacctttacccgtaccgttaaccggtccccgggttaaacgggtaccgggtaaccgggtacgggtaacggtaaccggtaaaccgtaacgggtaaccgtacggtttaacgggtaaccggtccggttaaccggcccgttaaccgtaccgtttaccgttacggtttaccc

SEQ ID NO: 74104 - DNA, 638 bp, Homo sapiens
  misc_feature: GYAE6OF02JA8IY.49.46.E02.1.454.CMB.1.raw
  modified_base (403)..(403): a, c, t, g, unknown or other
  misc_feature (403)..(403): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggaccaggctcccaggctcctcatctatgatgcatccaacacgggccaagtcggcactcccagccgaggttcagtggctaggtcgggtctggtagacacgtacttctactcacacctatcagcacgctaagacnccgtagaaacgtattctcgacttagttttattacgttcgtacacgtacaggtacgtaagaccgtaacgtacggccttaccgtccttaccggttttacggggaccgggtaaggggaaccccggtaaggggtacgggtaacggtaaacgttaacccgaaaacgggtaaccggttacggttacgggtaccgttaccgggaaccctaaccgtaacgtttacccgttaggtttaaccccg

SEQ ID NO: 74105 - DNA, 560 bp, Homo sapiens
  misc_feature: GYAE6OF02IFACK.49.46.E02.1.454.CMB.1.raw
  modified_base (309)..(309): a, c, t, g, unknown or other
  misc_feature (309)..(309): n is a, c, g, or t
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacngggccagtggcatcccagcctaggttcagtcggcaggtgggtcngtgacagacttcactcctcaccatcagcagacctagacncctagaaagacttctgtactagttttacttactgttcagtcagtcgtagacacgtcggccttctcgttaccgtttcgggccggtaagggaccgtagggtacggacgaacgtaccgaaaaccggtacgttcggaggtcctaggacccaacctagttccgtgtttacccg

SEQ ID NO: 74106 - DNA, 785 bp, Homo sapiens
  misc_feature: GYAE6OF02I1RBQ.49.46.E02.1.454.CMB.1.raw
  modified_base (219)..(219): a, c, t, g, unknown or other
  misc_feature (219)..(219): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcngggccagtcagagtgttagtagcttcttagccgtggtaccaatacgaaacctggccaggctcccgaggcctcctcatctatgatgacctatacccaaacggacgggtaccctacgtgggacctacgtcccccagtacccgaagggtttccgaaggttcgggacgtaacggggtttgggttcgttagggttaacggacgtaacggtaccttttaccgaactcccttacccacccgtaactaccgacgtaccgtaacggacccgtaaggtaccgtcccgttaaggaaacggtactttccgtagttaaccgtttaagtttttaaactttaccgttacggttaaccggtaacgtacgtaaccgggtacgttaaccgaccgtaaacgtccggttacccttaccgttacccgttaccgggttttaccggggaacgggtaaccgggtaacccgggtaagggggttaacgggacggtaaacggttaaccggaaaaaccggttaaccggttaacggttaccgggtaccgtaacggtacccgttaaccgtaacccggtttccttacgggtttaccc

SEQ ID NO: 74107 - DNA, 584 bp, Homo sapiens
  misc_feature: GYAE6OF02GC9K1.49.46.E02.1.454.CMB.1.raw
  modified_base (475)..(475): a, c, t, g, unknown or other
  misc_feature (475)..(475): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaaccaacagaaacctggaccaggcctcccaggcctcctcatctatgatgcatcccaacgacgggcccacgtggccactccccaaggtcccgtaggttccaaggtcggctagggttcggggtctggtagacgtaggtacttcaaccttctaccacctatcagcacgtcctaagcgtacgtgaaagtcttcgagcttagtttatccttgcagctagtcgtanaccgtacgtcggtccttcgtccttacggtttcggacgggtacgaccgtaggtgacgtacgtaaccgaaacgtcgtaggtcgtactacgacctcctaacgttctagttcc

SEQ ID NO: 74108 - DNA, 810 bp, Homo sapiens
  misc_feature: GYAE6OF02HJ0D8.49.46.E02.1.454.CMB.1.raw
  modified_base (149)..(149): a, c, t, g, unknown or other
  misc_feature (149)..(149): n is a, c, g, or t
  modified_base (155)..(155): a, c, t, g, unknown or other
  misc_feature (155)..(155): n is a, c, g, or t
  modified_base (163)..(163): a, c, t, g, unknown or other
  misc_feature (163)..(163): n is a, c, g, or t
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (327)..(327): a, c, t, g, unknown or other
  misc_feature (327)..(327): n is a, c, g, or t
tcagagtcgagagacacgaccggtgctcgatttagactcatctacagggaaagggggagaactgactcagttaggacccagagggaaccatcggaagccccagctcagcttctcttcctcctgctactctggctccagataccacgganaattgngatgacgnagtctccagccacctgtctgtgtctcgaagggaaangtcaccctntccgtgcgaggccagtcngagtgtaaggancgtaattacgcctaggtactacgagacaacgtaaaccgttggaccagggccctaccgaagggcccttcgtacgaacttcgtagttcggngtacaacgtcccgaacggtacgggtaccctacgttacgggtaaccttccccggaaacgccgttaaacgggtttacaacgggtttcggaacctagggttacggggtctaagggaacgaacgttacggtttaccaaccgttaccgtaaccaacccgtataaccgtaacggacctaaccgtcccgttaacgtaccgtaaggttaccgtaaggttaaaaccgtaagtttttacgggtaacctttaaggtttttaaccgttacgttaacggttacgaacgtaaccggtaagtttaaacttaacgttccggggttacccgggtaccgttacccggtaacgttaaaccgggttttaccgggaaccgggtttaacgggaaaccgttaacggggtacgggtaacgtaacggttaaccgttaaaacggacccgtttagggtacggtaccttaccgggacttaacccgtaagttacccggttacgtttaccccg

SEQ ID NO: 74109 - DNA, 706 bp, Homo sapiens
  misc_feature: GYAE6OF02JZS33.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctctgctactctggctcccagatacccaccggagaaattgtgttgacacagtctccggccacctgtctttgctccaggggcagtgccacctctcctgcagggccagtcagagtgttagtagcttctagcctggtaccaacgtagaacctggaccaggcctacccgaggccttcctcaacttcctaagtacgtaagtcgcctaacttacccgaacgaccgggtcccaacgtcgggacctacgtccccaaggccgtaaggttccaacgggtcggacgtaaggttcggggtcctggtacgaacgtacgtacttccaaccgttctacccaacgtatccgaacgtccgacggtacccgtaggaccggtacctaaggaaacgtacgtttaccgtacggtaccgttaagttttaccgttaaccgttcgggttaaccacggtaaccgtaacggttaccgttaaagacccgttaaacggttcgtacccgttaccgtaccgttacggtttacccgggacggtacggaccggtaaggtacgtacgaacgttacaacggttaacgcggttaacgtcacggtcctaagtactcgttactaccg

SEQ ID NO: 74110 - DNA, 555 bp, Homo sapiens
  misc_feature: GYAE6OF02FPX4L.49.46.E02.1.454.CMB.1.raw
  modified_base (551)..(551): a, c, t, g, unknown or other
  misc_feature (551)..(551): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagagcttcttagcctggtaaccaacagaaacctggccaggcctcccaggtctcctcatctatgatgcatccaacgcggccacgtggcatcccagcctaggttcaggtggactaggtgggtctggtgactaggactttcgactcaccgaccatcacgtcacgtccgtagcgtaccgtaggaaagcttcgtgcttagtttaattcgtacgtcaaggctagtcgtacgctaacgtcggtcctaccgtactcgtttaccggcggacgggtacgaggtgacgtagtaccaagtaacgtgtacggctcgcacctatcgttntacc

SEQ ID NO: 74111 - DNA, 606 bp, Homo sapiens
  misc_feature: GYAE6OF02FKQ9N.49.46.E02.1.454.CMB.1.raw
  modified_base (470)..(470): a, c, t, g, unknown or other
  misc_feature (470)..(470): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaattgtgttgacacagtctccggccaccctgtctttgtctccaggggacagtgcccaccctctcctgcagggccagtcagagtgttagtagctttcttagccgtggtaccaacaagaaacctggaccaggcctcccaggcctcctcatctatgatgacatccaacgagggccacgtggactactcccacgcctacggttcaggttcggcgtaggggttcgggtcttggtagacgagtcctttaccgtacctctacccgacctacgtacacgcacgtacctagacgtcctagaagtattctgacttagtttacttacgttntcgagcacgcgttacgacgacctcggttaccctcttaccgtcgtttccgggacggacggtaccgaggtacggtagacctaacgaaacgtacgtacggtaggaccgttacggacctaaccgtcttacgttcgttacg

SEQ ID NO: 74112 - DNA, 628 bp, Homo sapiens
  misc_feature: GYAE6OF02G84V8.49.46.E02.1.454.CMB.1.raw
  modified_base (334)..(334): a, c, t, g, unknown or other
  misc_feature (334)..(334): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggcctccagataccaccggagaaattgtgttgacacagtctccggccaccctgtctttgtctccgaggggacagtcgcccaccctctctgcgagggccagtcaggagtgttagtagcttcttagcctaggtaccaacagaaacctggccagggcctacccgaggcctcctacatactatgatgcactaccaacgcgggccacgnggacactcccgagcctaggtcagtggcgaggtggctggtgactagtaccttcgtactactcactagtacagcacgacctaggacacgtagaagttactacgtagtacttaagttttaattacgttacgtacgaagtactaggtacgtaacgaccgttacgtccgacccttacgtaccgttacggtttacgggaccggggtacgggaaccggagggttacgggtaacgtacgtaaaccgaaacggtaacgttcggaggtcgtaacggacctaccgtaagttccgtagtttacccg

SEQ ID NO: 74113 - DNA, 602 bp, Homo sapiens
  misc_feature: GYAE6OF02JGOW6.49.46.E02.1.454.CMB.1.raw
  modified_base (290)..(290): a, c, t, g, unknown or other
  misc_feature (290)..(290): n is a, c, g, or t
  modified_base (369)..(369): a, c, t, g, unknown or other
  misc_feature (369)..(369): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttctagcctggtaccaacagaaacctggccaggcctcccaggctcctnatctatgatgacatccaacagggccacgtcggcactcccagcctaggttcagtgcagtggtctgtgacagcttcactcncacatcagtcagcctagacgtccgtagtaagtacttcgtacgtacgttaacggttttaattaccgttagttacccgaggtaccagggtacgtacgaccgtaacgtccggtacccttccgtttacctaaccgtttccggggaccggtaacgggaccgtagggtacggtaagacgtaaccgaaaacgtcgtaggttcggaccttaggaccctaacgtacgttcgtacgttacccg

SEQ ID NO: 74114 - DNA, 669 bp, Homo sapiens
  misc_feature: GYAE6OF02F32MX.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgcccaccctctcctgcacgggccagtcagagtgttagtagcttcttagccgtcggtaaccaacgaagaaaccgtggccgaggcctcccgaggcctcctcatctatgatgcactaccaacgacgggcccacgtggcctactcccgacggtcccgtaggttccaggtcggcgtagggttcggggtctggtacgaacgacgtacttaccgacttctaccgaacctataccgtacgccgtaacgtcccgttaaggacggtaccctaggaaacgttctttaccgtggtacttaagttttacgttacttacgtcacgacgtacgcgtaacgacctacgtcgtaccgttctaccgttacggtttaccggacgggtaacggaccggtagggtcggtaacgtaacgtaaccgtaaaccggtaacgttcggtacggtacgtcgaccgtaaccgtcgttaccgtccgtttacccg

SEQ ID NO: 74115 - DNA, 685 bp, Homo sapiens
  misc_feature: GYAE6OF02GX49N.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtcgccaccctctcctgcgagggccagtcagagttgttagtagtcttcgtagcctggtaccaaacacgtaaacctggcctaacggcctacccgaggccttaccgtactactcctatcgtactgtaccactaccgaaacgacgggaccacggtcggactacgtcccgagtcccgtaggttacacgggtcgacgtaggttcgggtactcggtagtaacacggtacctttacaaccgttccacaccgtattccgaacgtccaacgtacctaaggactacccgtaggtaacttacgttccgtataccgtttaaagttttacgtacgtacgttacgaggtaccgtaggtaccgtactaccgtaacgtcgtcccttcgtaccgttacgggttacggacccgggttaagggtaaccgtaagggtcgtaacggtaacgtaaccggaaacgtaagtcggtcgacgtcgtaaccgaactcgttctacggttacc

SEQ ID NO: 74116 - DNA, 605 bp, Homo sapiens
  misc_feature: GYAE6OF02GE7DG.49.46.E02.1.454.CMB.1.raw
  modified_base (314)..(314): a, c, t, g, unknown or other
  misc_feature (314)..(314): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagccgtggtaccaacagaaacctggccaggctcccaggcctcctcatctatgatgcactccaacgnggccacgtggccactcccgagccaggttcaggtcgcgtaggtcggtctggtcacgagtaccttcactctaccactactcagctacgccgtaagcgtacctagaacgttacttgacgtacttaagtttacgttacgtcggttacacgacctaggtccgttaacgaccttacgtcgggtcccttacgttaccgttaccggttcgggacgggtacggaaccgtagggtacggacgtacgtaaccgaaccgtacggttggtcggacctacgaccgtaccgtcttacgtcgttacc

SEQ ID NO: 74117 - DNA, 637 bp, Homo sapiens
  misc_feature: GYAE6OF02F473I.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagagcttcttagcctggtaccaacagaaacctggccaggcctcccgaggtcctcctcatctatgatgcagtccaacgagggccacgtggacactcccgagcctacggtcaggtggcgtaggttcgggtctggtacgacgtagtacttctactcctaccgacctactacgcgacacgacctaacgacgtaccgtagtaaacgtacttcgtacgtcgttaagtttaacgttacgttacgttcgtagtacgtacgtcgtagaccgtacgtcgtccttcttaccgtacggtttccggaccgggtaacgggaccggtaacgggtaggtaaggtaacggtaacgtaaaccggtaacgttacggttacggtacgtacgtaccgtaccgtacttacgttcgtttacccg

SEQ ID NO: 74118 - DNA, 669 bp, Homo sapiens
  misc_feature: GYAE6OF02HEPIB.49.46.E02.1.454.CMB.1.raw
  modified_base (662)..(662): a, c, t, g, unknown or other
  misc_feature (662)..(662): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgtagtagcttcttagcctggtaccaacagaacctggccaggcctccgaggcctcctcatctatgatgcactccgaacgacgggcccacgtcggacacgtccccgagcccgtaaggttccaggttcggacgtacgggttgggttctaggtagaacctaggtaccttcgtaaccttccgtaccaacccgtatccgaacggtaccaacggtacccgttaaggaccgtacccgtaggaaacgttacgtttaccgtacggtaccgtttaaggtttttaaccttaaccgtttcgtaccgtaagtccgtaacgtaccggttaacgaccgtaacgttccggtacccttccgtaccgttacggttaccgggacggtacgggtaccgagggtacggagtaacgtaacgaacgtagtggtcgcgtacgccacgtacgttntgttacc

SEQ ID NO: 74119 - DNA, 580 bp, Homo sapiens
  misc_feature: GYAE6OF02IZNCE.49.46.E02.1.454.CMB.1.raw
  modified_base (264)..(264): a, c, t, g, unknown or other
  misc_feature (264)..(264): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgttctttgtctccgaggggacagtcgcccaccctctcctgcagggccagtcagagtgttagtagcttctagcctggtaccaanacgaaacctggccaggctcccgagctcctcatctatgatgcctatccaacgacgggccacgtggccactaccccagccgtaggttcaggtggacgtagggtggtctgcgacaggtacttcaccttcacaaccgtatccagcacgtacctagacggtcctagaaacgtacttacgtgtactttaagtttattacgtgtacagtcagtacgtagactacgtggccttactctacgttcggacggtacgggaaccgtaggtcggacgtaataccgaaacgtcgttaggcgtacgtgaacctacctagttcctcgttacc

SEQ ID NO: 74120 - DNA, 692 bp, Homo sapiens
  misc_feature: GYAE6OF02HJEPC.49.46.E02.1.454.CMB.1.raw
  modified_base (298)..(298): a, c, t, g, unknown or other
  misc_feature (298)..(298): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtagttgacacagtctccggccaccctgtctttgtctccgaggggacagtgcccaccctctcctgccagggccagtcagagttgttagtagcttcttagccgtaggtaccaacagaaacctggaccaggcctccaggcctcctnactctatgatcgcatacccaacgacggcccaacgtggcctacgtcccgagtcccgtaggttcgacggtcggacgtaggttgggtctggtacgacgtacgtaccttcaaccttctacctaccgattacgacgaccgacgtaccgtaagaaccggtcctaggtaaacgttacttcgtaaggtactttaaggttttaacctttacggtgtacctacgacgtacggtacgttacgaaccgttaacggtccggttacccttaccgttaccttaaccgggtttcgggaaccgggtaccgggaaccggtacgggttaggaaccgtaagtaacccgggtaaaccgtaggtaccggttacggaccgttacgaccccgtaaccgttagtccgtttacgtacccg

SEQ ID NO: 74121 - DNA, 673 bp, Homo sapiens
  misc_feature: GYAE6OF02IZ1CB.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgtctccgaggggacagtcgccaccctctcctgcgacgggccagtcagacgtgttagtacgtcttctagcctaggtaccaacgacgaaacctggaccaggctcccgaggtcctcctcatctagtgatgcactccaacgacggggccacgtcggctaacgtccccgacgccgtaggttccaggtacggcgtagggtacgggttctcggtagaacgtaggtaccttcaaccttccgtacaccataccgaacgccgtaacgtaccgtaacggaccgtacgtagtaacgtacttcgtacgtacgttaacgttttaacgttaccgttcgttaccgaagccgtaaggtacgtacgaccgtaacgtcggtacctaccgttcgttaaccggttcgggaaccgggtacgggtaaccgtaggggtacgtaacggtacgtaaaccgtaaacggagttcggtacgacgtacgacccgtacgtacgttccgtacgttaccg

SEQ ID NO: 74122 - DNA, 664 bp, Homo sapiens
  misc_feature: GYAE6OF02HH0MA.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtcctccggccaccctgtctttgtctccaggggacagtgcccaccctctcctgcagggccagtcagagtgttagtagtcttcttagcctaggtaccaacacgaaacctggccaggcctcccgaggcctcctcatctatgatgcactccaacgagggcccacgtcggaccactccccagtcccgtaggttacaggtggctagggtcggggtctggtacgaacagtactttcacttcctacaccctatccgagcacgacctagacgtcctagaaacgtcttcgtgacgttaagttttaacttaccgttggtactacgtcgtaggtaccgtagtaccctaacggtcggtaccccttacgttacccgttaacgggtttccggggaaccgggtaaccggggttaaccgtaacggggtagggtaacggtaacgtaaccgtaaaacggttaccgtagggtacggtccgttaaccggaccttaacccgtagttccgttacgttacc

SEQ ID NO: 74123 - DNA, 770 bp, Homo sapiens
  misc_feature: GYAE6OF02HCM32.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagactaccaccggaagaaattgtgttgacacagtctccggccaccctgtctttgtctccgaggggacagtcgccaccctctccgtgcgacggccagtcgagtagttgttagtagtctttcgttacgccgtaggtaacccaaacgaacgaaacccgtggacccgacggcccttaccccggaaggtccttccctctacttcgtatggatcgctactccaacgcgggccacgtcgaccactcccgagtccgtaggttacaggtcggacgtagggtcgggttactggtacgaacgacgtcttaccgacttccgacaacctagacgacgtacacgtacctacgggacgtcccgtaggtaaacgtacttaccgttgtaaccgtttaagtttttactaacccggttaggttaccaaggtacctaaggttcccggtaacgtaacccgtacggtttacccgggtacccccttcggttaacccgttttaaccggttcccggggggaaaccgggttaaacggggtaccccgggttaaagggtccggggtaaacggtaaaccgttaaacccgggaaaacggttacccgggttaggtaaccgggttccttaacggacccttacgtaacggttcccttacggttaccc

SEQ ID NO: 74124 - DNA, 713 bp, Homo sapiens
  misc_feature: GYAE6OF02F5O9V.49.46.E02.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (238)..(238): a, c, t, g, unknown or other
  misc_feature (238)..(238): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggcaccctgtctttgtctccgagggacagtgccacctntcctgcaggccagtcagngtnttagtancttcttagctggtaccaactagaacctggtccaggcctccgacggtacctcctactatcctaatcggaatcgacatcccgaacgtacggccacgtcggacgacctacccgaggtccctaacggttcaacggtcggacgtaacgggttcgggttacgttcggtagtaacccgaggttaacccgttcgaaccgtttccttaaccaaccgtacttaccgacggtactacgtaccgttagacgttactaggaacggttacttaggtacggttaccttaagttttaacctcgttacgtacctaaggacgtaaccgtcggttacggacctaagggtcccggttcctttaaccgggttctacccgttttacggggacggtaacgggtacccttaagggggaccggtaacgtaacggtaaaccgtaaaccggtacggtacgttaccggtacgtacctaccgaagtttcctaccggttaccttc

SEQ ID NO: 74125 - DNA, 625 bp, Homo sapiens
  misc_feature: GYAE6OF02H5TI0.49.46.E02.1.454.CMB.1.raw
  modified_base (289)..(289): a, c, t, g, unknown or other
  misc_feature (289)..(289): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtcttgtctccaggggacagtgcccacctctcctgcagggccagtcagagtgttagtagtcttcttagcctggtaccaacagaaacctggccaggctcccaggctcctnatctatgatgcatccaacagggccagtcggacactccccgagccacggttacaggtcggctaggtcgggtctggtgacacggtacttcctaactcctaccgacctactccaacgcacggtcctaaggcgtcccgttaaggtaagtacttaccgtgtaaccgtttagtttaactttacgtagttccgacgtacgtacggcttacggacctaaccgtcgggtcccttacgttccttaccggttacgggacggtaacgggtaccgtagggtggaacgtactaacccggtaaaggtaccgttgtacggtctacgaccgtacctacttccgtgtttaaccc

SEQ ID NO: 74126 - DNA, 544 bp, Homo sapiens
  misc_feature: GYAE6OF02JS020.49.46.E02.1.454.CMB.1.raw
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (314)..(314): a, c, t, g, unknown or other
  misc_feature (314)..(314): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (428)..(428): a, c, t, g, unknown or other
  misc_feature (428)..(428): n is a, c, g, or t
  modified_base (513)..(513): a, c, t, g, unknown or other
  misc_feature (513)..(513): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagactaccaccggagaaattgtgttgactacagtctaccggccaccctgtctttgtctccagggacagtgccacctcgtcctgcagggccagtcacgagtgttagacgcttcttagcctggtaccaanagaacctggccaggctccaggcctcctnactctatgatgcactccaacnggccatgcatcccagccaggttcagtcgagacgtggtcngtanacgacgtacttcacgtctacacctatcagcagtcctagcgctagaacgtacttctagctagtttactacgngtcagacgagtcgtaagcctaacgcgcctacgtcctacgttcggaacggagtaaccagggtcgacgtacgtaccaaaggtaccgnggttcgactcggtacaccgtagtcgtatccg

SEQ ID NO: 74127 - DNA, 548 bp, Homo sapiens
  misc_feature: GYAE6OF02GF874.49.46.E02.1.454.CMB.1.raw
  modified_base (382)..(382): a, c, t, g, unknown or other
  misc_feature (382)..(382): n is a, c, g, or t
  modified_base (503)..(503): a, c, t, g, unknown or other
  misc_feature (503)..(503): n is a, c, g, or t
  modified_base (545)..(545): a, c, t, g, unknown or other
  misc_feature (545)..(545): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagcttcttagcctggtaccaacagaaacctggccaggcctcccgaggcctcctcatctatgatgcatccaacgacggccacgtggcactccccagcccgtaggttcaggtcggcgtaggtgggttctgtgactagtacttcnctctcacactcagcacacgtagacgtcgtagaagtcttcgtgcttaacgtttatacttcgtacacgctacgacgttacgactacgtcgccttctcgtacgttcggacggtacgacgtaggngaggtacaacgaacgtacgtgtacgcgtcgacacgtctcgtnttc

SEQ ID NO: 74128 - DNA, 756 bp, Homo sapiens
  misc_feature: GYAE6OF02GJ2HD.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgcccaccctctcctgcagggccagtcagagtgttagagcttctagcctggtaccaacagaaacctggccaggcctcccgaggtcctcctacatctatgatgcactaccgaacgcgggccacgtggactactccccgagtcccgtaggttccaggtggcgtagggttggggtctggtagaactacggtacctttaccgaacctttccgtacccaacccgtattaccgaacggtacccgtaacggtacccgttaagggaacccggttacccgtaaggtaaaccggttacgtttcccgttacggtaccgtttaaaggttttttaacttaccgtttacggttccgtaacgtacgtaaccgggtaccggttaacggtacccgttaaccggttccggtaccccttaccgttaaccgttaccgggttttccggggaaccggggtaaccggggtaacccgtaagggggtacggaacggtaacgttaacccggtaaaaccggtacgttcgggttacgtccgttacggtaccctaccgtacggttaccgttcggtttaaccc

SEQ ID NO: 74129 - DNA, 687 bp, Homo sapiens
  misc_feature: GYAE6OF02GXQJ4.49.46.E02.1.454.CMB.1.raw
  modified_base (680)..(680): a, c, t, g, unknown or other
  misc_feature (680)..(680): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccctaccctctcctgcagggccagtccagagttgttagtagtcttcgttagccgttaggtaccaacgacgaaacctggaccgaggcctacccgaggccctcctctagtctagtgtatcgacactacccgaaacgacgggaccacggtcggacacgtacccacgtacccgtagggtttaccacggtacggaccgttagggttcgggtcgttggtagtacgacgttaccttcaccgttcctacaccctagtccgacggtaccacgtaccgtaaggaccgtcccgtagtaaacggtactttcgtacgtcgtttaacgttttacgttacgttcgttagacgtaccgtacggtaccgttagaccctagttccgtacccttcgttaccgtacggtttccggaacgggtacggtacggagggttgaacgtaccgaacgtaaccggtagtcgtcggtacgtacgacttaccgtcgttacgtnttacccg

SEQ ID NO: 74130 - DNA, 721 bp, Homo sapiens
  misc_feature: GYAE6OF02JWHDS.49.46.E02.1.454.CMB.1.raw
  modified_base (216)..(216): a, c, t, g, unknown or other
  misc_feature (216)..(216): n is a, c, g, or t
  modified_base (381)..(381): a, c, t, g, unknown or other
  misc_feature (381)..(381): n is a, c, g, or t
tcagagtcgagagacacgaccggtgctcgatttagactcatctacagggaaagggggagggaacgtgctcagttaggacccagagggaaccatggaagccccagctcagctctcttctcctgctactctggctccagataccaccggagaaattcgtggttgacacagtcctccggccacctgtcttgtctccgaggggtacagtcgccacccgtntccgtgcacgggccagtcagagttgtagtacgcttcttacgccttaggtaaccaacgagtaaaccctgggacccagggtcctcccgaggtcctcctcagttcctagtcggtactgacctcttaacccgaacgtcggggaccaacgtcggtacaaccgttacccgngtacccgtaaggtttccaacggttgggaacccgtgggttaccgggttctcggttaacggaccggtacgtaactttcccgaacttcccggtaacacccgtatccgaacgcgttacgccgttagaccgtcgtacgtagtacttcgtggtactagttttactagttcgagtacgctaacggcgtaacgtacgacgtcgtaccttacgaccgttacggttaccgggaacgggtacgggttaacccgaggggtttacgggacttaacggtaacccgttaaaggtacccggttaggttaccgggtactacgggtccctaaaaccgccgtttcggttacgttacccg

SEQ ID NO: 74131 - DNA, 726 bp, Homo sapiens
  misc_feature: GYAE6OF02FOV4A.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtcttgtctccgaggggacagtgccaccctctcctgcagggccagtcagtagtgttacgtagcttactaggccttggtaacccaaacagaaaccctggaccaggtccctaccgaggtcctacctcatccgtatgatcgctacgtaccaacggtacggtaccacgttcggacctacgtaccccgaacgtcccggtacggttaccgagggttaccggtacgtagggttcggggtcgtaggtacggtaacctaacggttcttccgtaaccgttctaccgtaccagtttaccgacgtacaccgtaccgtaggacgtacccgtaagggtaaacttacgttaacccgttgtaaccgtttaacggtttttactaccggttcgttacgaacgcgttaaccggacgttaccaacgtacccgttcgtaaccgtccgttacgtacggtttaccgggaacgggacgggtacggtacggtaggacgtaacgaaccgtaccgggtaacgttaggtcggtaccgtacgtaacccgtacgtacgttaccgttacgttaccg

SEQ ID NO: 74132 - DNA, 729 bp, Homo sapiens
  misc_feature: GYAE6OF02HZC7I.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccctaccctctcctgcgagggccagtcaaggagttgttagtagtcttacgtacgccgttaggtaccaaacaagtaaaccgtcggaccgtaacggccctaccgacggtcctaccgtacactctatcgaattcgactaactaccgaacgacgggtaccacgtcggacctactcccgagtccgtaacggtcgaggtcgacgtagggtcggtcgtgtacgacgtacgtacttacgtacttcctaccaccgtctaccgtaacgccgtaacgccgtaaggacctccgtaagtacgtcttacgtcgtacgttaagtttacttagtcgtacgagtctaggtcgtaacgtacgtaaccgtccgacttccgttaccgtaccggttacgggaccgggtaaccgggtaaccggtacggggttaacgtacgggtaaaccgttaaccggtaaaaccgggttaccgttcgggtacggttacccgggttacctaacccggttaacccggttaacgtttcccgggtacttttaaccccgg

SEQ ID NO: 74133 - DNA, 809 bp, Homo sapiens
  misc_feature: GYAE6OF02JIGL7.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacaggtcgcccaccctctcctgcgacgggccaggtcagtagtcgttagtagcttcttagcctggtaccaacagaaaccctggccaggctcccgaggctccgtcattcctagtcgatcgtacacttacccgaaacgtaggggacccctaacgtcgggacctaacgttaccccagacccgtaggggttccaacgggttgggaccagggttcggggttccgtggtacgaacgtaggtacctttacaaccttccgtcctaaccctacgtttacgaacgaccgtaacgaccccggttaaggaccggtacccgttaggaaaacggttctttaacccggttacgtaacgtttaacgttttttaacctttacgtttaaccggttacgtaaccgtacgaaccggttacggttaaaccgacgtaaacccgtttaccggtccccgtttaacgtaccggtttaacccggtttccggggaaaccgggtaaaccgggggtaaccccgttaagggggccgggtaaacggtaaacttaacccgggtaaaacgggtaccgttacgggttaccgggtcccttacgggtaaccctaacccggtagtttaccccggttgtttaacccccg

SEQ ID NO: 74134 - DNA, 792 bp, Homo sapiens
  misc_feature: GYAE6OF02H8LYI.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggcagtgcccaccctctcctgcagggcccagtcagtagtgttagtagcttcttagcctaggtacccaacagaaaccgtggaccaggcctcccaggcctcctcatctatgaatcgacactaccgaacgacgggcccaacgtcggacctaaccgtcccgaagtacccgtaaggtttccgaaggttcggaccgaggttcggggtactggttacgacgtacgtaaccgttccacttcctacccgaacctacgtttaccgaacgtaccgaaccgtacccgtaaggaaccgtacccgtaaggtaaacgttaaccgtttacccggtggttaccgtttaacggtttttaaacttttaaccgtacgttaaccgtaacgtcccgtaaacggttaccggttaaccggtaaccgtaccgtacgggttacccttacccgttacccgtttaacccgggtttaccgggaccgggtaaccggggtaacccggttaacggggtacgggtaacggaacgttaacccggaaaaccgggttaaccgttacgggttaaccggttcccgtaaccggtaccctaaccccggttacgttacccggttaccgtttaccccg

SEQ ID NO: 74135 - DNA, 789 bp, Homo sapiens
  misc_feature: GYAE6OF02JTZBZ.49.46.E02.1.454.CMB.1.raw
  modified_base (103)..(103): a, c, t, g, unknown or other
  misc_feature (103)..(103): n is a, c, g, or t
  modified_base (152)..(152): a, c, t, g, unknown or other
  misc_feature (152)..(152): n is a, c, g, or t
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (343)..(343): a, c, t, g, unknown or other
  misc_feature (343)..(343): n is a, c, g, or t
tcagagtcgagagacacgaccggtgctcgatttagactcatctacagggaaagggggaggaactgctcagttaggacccagagggaaccatggaagccccagntcagcttctccttcctcctgctactctggctcccagataccaccggganaaattgtgttgaacacagtctcccggccaccctgttctttgtctccgagggacagtcgccaccctntcctgcagggtccagtcagngttagtacgtatcttccttagcccgtaggtaccaaaccgagtaaaccgtgggtccaacgggtcctccccgtaacggcctaccgttccacttaccgtatggtaacncggtacaccttaccgaacgacgggtcccgtaacgtcgggcctactccgacccgaaccggttcggttaaccgaccgggttacggtaccgtaccggggtttacgggtaccgtaggttaccgggaactaaccgggttaccttaccccgtaacgtacccttacaacccggtaactccgaacccggtaccggtacgtacccgttaccggaaccggtacccgtaagtaacggttacgttaccggttactagttaaccgtttaacgttacgttacgtacccgtaagccggtaccgttaacgtaccggttaacccgaccggtttccgacctttacgttcccttaacggttccggaaccgggtacggtaacgacggttaggaacggtaagtaccgtaacggtacgttacggacgtaccggttacgaccttacgacgtttacctaggttaaccccg

SEQ ID NO: 74136 - DNA, 689 bp, Homo sapiens
  misc_feature: GYAE6OF02G8ZGV.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgcccaccctctcctgcagggccagtcagtagtgttagtagcttctagcctaggtaccaacagaacctggccaaggcctcccgaggctcctcactctatgatgcactccaacgacgggccacgtcggcacgtcccgagccctaggttcaggtcggactaggtcgggtctaggtacgacacgtaccttacaccttctaccaccctacgtccaagaccacggtacccgtaacgacgtaccgtacggtaaagtactttaccgttcggtacctttaacgttttaacgtttacgtttacggtaccgtaagtaccgtaacggtaccggtaacgtacccgtaaccgttccggtacccttccgttacgttacccggtttccgggaaccggggtaacggggtaaccggtaagggttacgggtaacgtaacgttaaaccggaaacggttacgttcggtacgacgttacgacctaccgtacgttccgttagttaccc

SEQ ID NO: 74137 - DNA, 668 bp, Homo sapiens
  misc_feature: GYAE6OF02I4WU4.49.46.E02.1.454.CMB.1.raw
  modified_base (363)..(363): a, c, t, g, unknown or other
  misc_feature (363)..(363): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtcgccaccctctcctgcgacgggccaggtcagagtgttagtagtcttcttagtcctggtaaccaacgacgaaacctcggaccaggcctccgaggcctcctcatctagtgtatcgcataccaacgcggaccagtcggcctactcccgagaccgtaggttacnggttacgcgtaggtcgggtctggtacgacgtagtaccgttactacgtccgtaccaaccgtacgtactacgtacgacgtaccgtacgacggtcctaaggtaactacgttactcggtacttaagttttactacgttgactaggtacgtacggtacgtacgtaacgtaccgtcgttacccgttcgtaccgttacggttccgggacgggtaacgggtaaccgtagggtcggtaaacgtaacttaaccggaaaacggtcggtacggtcggtaaccgtacggaacccgtaacgtacgttcggtaccttacg

SEQ ID NO: 74138 - DNA, 854 bp, Homo sapiens
  misc_feature: GYAE6OF02GTJWE.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtgcccacctctcctgcagggccagtcagagtgttagtagcttcttagccgtggtaccaacagtaaaccgtggccaggcctcccgaggcctcctcgatctaagtgactcgctactaccgaacgacgggtaccctacgtcgggctaccgtcccgaagcccgtaggttcacggtcggaccgtacgggttcggggttacttggtacgaaacgtacggttaacctttccgtaaccgttcccttaaccgaaccctacgtttaccgaacgggtccctaacgggtacccgtttaaacggaaccgggttccccgttaaagggtaaaaaggtttcctttaccggtacgggttaaacgtttaacggttttttaaacgtttaccggttggttaaacccgtagtacccggttaacggtccgggtttaacgaacccggttaaacccggttccgggttaccccgtttcccttttaaacccgggtttaaccgggttttacccccgggggaaagggggtaaaacccggggtaacccggttaacgggggttaacggggtaaccggttaaaccgttaaaccccggtaaaacggttaacggttcccgggtaggttaccccgttacgggaaccccttaaacccggtacgtttcccggttacgttttaaccccg

SEQ ID NO: 74139 - DNA, 757 bp, Homo sapiens
  misc_feature: GYAE6OF02G9QB9.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggcctcccagataccaccggagaaattgtgttgacacagtctccggccaccctgtctttgtctccgagggacagtgcccaccctctcctgcgagggccagtcagagtgttagtagtcttcgttagcctaggtaaccaacacgaaaccctggccaggcctccaggcctcctcatctatgatgcataccaacgacggccaacgtcggacctactacccgcgacctacggttccgagggtcggaccgtagggttacggggttcgtcggtacggtaaccgacggtaacctttcctaacctttaccgtaccaaccccttaacttccgaaccgtccgaaccggtaccgtaacggaaccgtaccgttaacgtaaacgttactttacggtacggtacgtttaaacgttttaacgtttaccggttacgtacgtactaccgtacggtacggtaaccgttacgaaaccgttccgggtacccttaccgttaccgttacccgggtttacgggaccggggtaaaccgggtaaccgggtacggggtacgggtaacggtaaccgttaaccggaaaaccggttacgttacggttacggaccgttaccggaccctaaccgttacttccggttacgtttaacccgg

SEQ ID NO: 74140 - DNA, 751 bp, Homo sapiens
  misc_feature: GYAE6OF02HHON6.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctcaggggacagtgccaccctctcctgcagggccagtcagagtcgttagtagtcttcttagcctggtaaccaacaacgaaacctggacctagggcctccgaggcctcctcatctatgatgacactaccaacgacggggccctacgtcggacactaccccgacggtccctagggtttccaaggttcggggacctaggggttcggggtccttggtacggtaacctacggttaaccttccgaacttaccctaccgaaccctacgtccaacggccgtaacgtccgttaacggacgtaccccgttaaggaaacgttcgtttaccttacggtaccgtttaagtttttaaacctttacgttccggtactaacggtccgaaagggtccttaaacggtcgttaaccgtccgggtacctttcccgttacgttaaccggtttccggggaacgggtaacggggtaccgtaaggggtacggtaaggtaacccttaaggtaaacccgttaaggttccggtaaggggttccctaagggtaccctaacccgttacgtttacccgttcggtttaacccg

SEQ ID NO: 74141 - DNA, 687 bp, Homo sapiens
  misc_feature: GYAE6OF02GTQWW.49.46.E02.1.454.CMB.1.raw
  modified_base (153)..(153): a, c, t, g, unknown or other
  misc_feature (153)..(153): n is a, c, g, or t
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (355)..(355): a, c, t, g, unknown or other
  misc_feature (355)..(355): n is a, c, g, or t
tcagagtcgagagacacgaccggtgctcgatttagactcatctacagggaaagggggaggaactgctcagttaggacccagagggaaccatggaagccccagctcagcttctcttcctcctgctactcgtggcctccagactaccaccggaanaattgtgttgacacagtctccggccacctgtctttgctccgaggtacngtgcctacctctcngcacggccagtcagngtgtagagtcttntacgcctaggaaccaagacgaacctggaccgtagcctaccgacgcctacctcacttactacgtagtacgtcgtaccacttaccgaaacgtacggcccagtcggacctaaccncccgacgaccgtacggttacacggtacggccttaggtcggggtacttacgggtagtaacccgaaggtaccttaccgtaacttcccgttacccgaacgtaacgtcgtaacgtaccgaacggtacccttaacgaccggtaccgtaagtaacgtacttacgtaccgtacgtttagtttaacgtttacgtacgttacgacgtacgacgttcggttacgacgtaccgtacgtcccgttactacgtaccgtttacgggaccgggtacggtaaccggtagtacggacgtaagaaccgtaacgtagtagtcgacgttcgaccgtactactacgttctacg

SEQ ID NO: 74142 - DNA, 939 bp, Homo sapiens
  misc_feature: GYAE6OF02JOKSM.49.46.E02.1.454.CMB.1.raw
tcagagtcgagagacacgaccggtgctcgatttagactcatctacagggaaagggggagggaactgctcagttaggacccagagggaaccatggaagccccagctcagcttctcttctcctgctactctggcctccagactaccgaccggagaaattgtgttgactacagtctccggccaccctgtctttgtccttccgaggggacagtcgcctaccccgttctccctgcgtacgggccagttacgagtacggtgttaggtacgtcttacgttacgccgttacggtacctaaaccgacgtaaaccttcgggacccgtacgggtccctaccccggtaacggtcccgttacccgttaccgacttacgttaacgtaccggtaacgttacggacctaacgttaacccgaaccggtacggggaaccctaccgttaccgggacctacccgtaccccggtacggaccccggttaacggggttactaaccgggtcggtacggttaacggggttcgggttagtcggggtaagtaccgtacggttacctttacggtaacctacccttaccgaaccgtagttaccgacggtaccgaacgtaccgtaacgtaccgtaccgtaacgtaaaggtttaaccttcggtttacgtaacgttttaccggttttacgttttaaccgttacggttaaccgttaacgggtacccttaaacgggaccggtttaaaacggtcccgttaaaccgggttccgtaacccgttttccccgttaagtttaacccggggttttaccggggtaacccgggtaaggggtttaacccgggaacggggtttaaccggaacggttaaacccggtaaagtttaaaccccgggggtacggttaccgggtagggttacccggttaaccgggtacccgttaaccgttaaccggtttcccggttacggtttaacccgg

SEQ ID NO: 74143 - DNA, 763 bp, Homo sapiens
  misc_feature: GYAE6OF02GETRN.49.46.E02.1.454.CMB.1.raw
  modified_base (206)..(206): a, c, t, g, unknown or other
  misc_feature (206)..(206): n is a, c, g, or t
tcagagtcgagagacacgaccggtgctcgatttagactcatctacagggaaagggggaggaactgctcagttaggacccagagggaaccatggaacgccccagctcagcttctcttcctcctgctactctggctcccagataccaccggagaattgtgttcgacacagtcctccggcctaccctgtctttgtcctccgaggggacngtcgcccaccctctcctggcagggccagtcagtagtgttagagtctttctacgcctggtaaccaacgagaaacctggaccagggcctcccgaggccttacctcattactatgattgctactccgaacgtagggccctactgggacctaactcccgacggtacccgaggttacgacggtgccgtaggggtcgggttactggagaccggtagttacctactaaccgttccctaccgaaccctaagtacccacgggtacgaacccggtcccgtaaacggtccggtacccgtaagttaaccggtaactttccgtacgggtaacttttacggttttaaaccttcggtttacgtaccgtacgtaccgggaacgtttacccgtacggtacgtttaaccggtcccggttacccgttacccttaccgggttacggtttacccgggagggggtaacccgggtaaccgggtagggtttaccggaaacgtaccgttaaacccggtaaacggttacgggtacgttaccggacgttacggtacctacccgtaagtttcccgagtttacccg

SEQ ID NO: 74144 - DNA, 819 bp, Homo sapiens
  misc_feature: GYAE6OF02HE7LY.49.46.E02.1.454.CMB.1.raw
  modified_base (203)..(203): a, c, t, g, unknown or other
  misc_feature (203)..(203): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaattgtgttgacacagtccgtccggccaccctgttctttgtcctccgagggacngtcgcccaccctctcctgcgacgggccagtcagtcgttagttagtacgtctttcgttacgccttacggtaaccaacgaacgtaaacccgtcggaccgacggtccctaccccgaggtcccttccctacgtaccttaccgtatacgttagtcgtaccgtaacctaccgaaccggacgggaccctacggtccggaccctaaccgttaccccggacggttaccgtacgggtttccgaacgggttccgggaccggttagggggttcccgggtttacgtttacgggggtaacgtacccggttaacggtttaaccctttaccggtaacccctttccctaacccgtaaccctagttacccgaacgaccgtaaccgtcccgtaaaggtaccgttacccggaagttaagttcctttacggcgttaaccgtttaaggtttaacttcccgtaggttccgacggtaccgtaggtaccgtacgtaccgtaccgttccggtacctttaccgtacttaccggggtttccggacgggtaaccgggtacggtagggtccgaagttaacgtaaaccggaaacgtccggttaggccgttacgtccgtaacctcggttaacgtccgtttcctaaccg

SEQ ID NO: 74145 - DNA, 764 bp, Homo sapiens
  misc_feature: GYAE6OF02FKHEN.49.46.E02.1.454.CMB.1.raw
  modified_base (302)..(302): a, c, t, g, unknown or other
  misc_feature (302)..(302): n is a, c, g, or t
tcagagtcgagagacacgaccggtgctcgatttagactcatctacagggaaagggggaggaactgctcagttaggacccagagggaacctatggaagccccagctcagcttctcttcctcctgctactctggctcccagtataccaccggagaaattgtcgttgactacagtctaccggccaccctgtctttgctcagggacagtgccacctgtcctgcagggcctaggtccagagttgttacgagtcttcttagccttaggtaccaaagcgaaacctggaccaggcctccgagtcctcctnactcgtatcgagttcgcgtactccgaacgtaggtcccacgttacggcctaacttccccgaagtcccgtaaggggtttacccagggttcggaccgtaacggggttcggggttacttcggtacgggtaacctacggttaccgtttacccgaccggtttaccctaaccctaaccgtaacgtcccgaacggtacccgtaacggtacccgttaacgaaccgggtacccgttaggaaacgttacgtttccggtaggtaccgtttaacgttttaaacgttaccgtacggttaccaacggtcgtaacgggtacgttaaacgaccgttaaaccgtcggtacccgttcgttaacgtacccggtttacgggaccgggttacggaaccggtaagggtacgggtaacgtaaacgtaccgaaaaccgttacgcgttacggaccgttacgaccctaagtaccgtcgtacgttacccg

SEQ ID NO: 74146 - DNA, 582 bp, Homo sapiens
  misc_feature: GYAE6OF02FHUGX.49.46.E02.1.454.CMB.1.raw
  modified_base (289)..(289): a, c, t, g, unknown or other
  misc_feature (289)..(289): n is a, c, g, or t
  modified_base (418)..(418): a, c, t, g, unknown or other
  misc_feature (418)..(418): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctccaggctcctnatctatgatgctatccaacgagggccacgtggacactccccagcctagggttcaggtggctaggtgggtctggtcgactacgacttcaccttctaccaccatcagcagcctagacgctagagtacttcngctagtttatacgtgtcagctagcgtagacctacgtcgccttctacgtaccgtttcgggcgggtacgggtaccgtagggtcgggaacgtacggtaaccgaaaccggttaacggtacggttacggtaccgtcggtacccaaccgtacgttccgtacggtttaccc

SEQ ID NO: 74147 - DNA, 696 bp, Homo sapiens
  misc_feature: GYAE6OF02GMXUC.49.46.E02.1.454.CMB.1.raw
  modified_base (350)..(350): a, c, t, g, unknown or other
  misc_feature (350)..(350): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagtaaattgtgttggacacagtctccggccaccctgtctttgctccaggggacagtcgcccaccctctcctgccgagggccaggtccaggagttgttagagtcttcgttagccgtggtaccaacgacgaaacctggccaggcctacccgaggctcctcactctatgactgcactccaacgcggccacgtggacactcccgngacctacggttcaggtcggctaggtcgggtctggtacgacacggtaccttacgacctcgtacaaccctacgtaccgagctaaaccggtcctaaggaaccgtccgtaagtaaaggtactttaccgggagtactttaacgtttttaacgttaccgtttcgtaacgacgtacgtaagtacggttaacgtaacggttaccgttacgggtccctttaccgttaccgtaccgggttttacccggggaaccggttacccggggtaagtaaccgggtgggtaaactaacggtaaccgtaaaccggtacggtacgtacgggctacggtaccgacttaacggttcgtacttacccg

SEQ ID NO: 74148 - DNA, 701 bp, Homo sapiens
  misc_feature: GYAE6OF02FUFJF.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacaggtcgcccacccgtctccgtgcacgggccagtcagagttgttagtgtcgttcttacggcctaggtaaccaactacgaaaccgtggacccaggcctaccgaggtcctcctcgactcgtactgatcgactatacccgaagacgggccaagtcggctactccgacgcgtacggttcaggtggcgtaggttcggtctaggtagactaggtaccttcgacttcgtacccacgtactcgagccaacgtaccgtacgacgtaccgttaggtaaacgtcttaccgtagtaactttagttttaaatccgttacgtactaggaccgaggtaccgtaacggtaccctacggttaccggttcctaccggttacgttacccgggtttacggggaaccgggttaaccggggaacccgttaggggtacggtaaccggtaacttaaccgggtaaaaccgacggtttcggtaaccggtcttaaccggtacgacctacggttaccgttcgttacccg

SEQ ID NO: 74149 - DNA, 795 bp, Homo sapiens
  misc_feature: GYAE6OF02F8RUA.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgttctttgtctccgaggggacagtcgccaccctctcctgcagggccagtcagtagtgttagtagtctttcttagccgttacggtaaccaaacgacgtaaaccgtggacccgaggccctacccgaggtcctcccgtactacgttctacttgactcgacctaacgtacccgaaacggtacgggaccctaacgttcggacctaccgttccccgacgtacccgtaggtttcaacgggttcggacgtagggttcgggtacttggtacgtaaccgtacggttaaccttaccgtaccttaacctacccgtaacccgtaacgtacgtaacgaccccgtaaggtaccccgtaacgtaacgggtacccttaaaggaaaaccgttcgtttaccgtacgtacgtttaacgtttttacgtaacgttcgtaaccgaggtacctagggtaccgttaacggtacaaccggttccggttaccttacccgttcggttaaccggttacgggaaccggggtaccggaaaccgggttagggtacggaaaccggttaacgtaaaccggtaaaacggttccgttaagggttccgtacgtaccggtaaccaacgtttccgttacggtaccgtttacccg

SEQ ID NO: 74150 - DNA, 835 bp, Homo sapiens
  misc_feature: GYAE6OF02GEYMO.49.46.E02.1.454.CMB.1.raw
  modified_base (273)..(273): a, c, t, g, unknown or other
  misc_feature (273)..(273): n is a, c, g, or t
tcagagtcgagagacacgaccggtgctcgatttagactcatctacagggaaagggggaggaactgctcagttacggacccagagggaaccatggaagccccagctcagcttctcttcctcctgctactctggctccagataccacggagaattgtgtgacacagtctccggccacctgtctttgtctccgaggggacagtcgcccacccgtctacctgccgacgggccagtcagtagttgttagtagtctttcgtagccgtaggtacccaaanacgaaacctggaccgaggcctacccgagggtcctcctactactctaatcgtatcgacaacgtccgaaacgtccgggacccacgtcggactacccaccgtaccggtacccgtaaggttccgtaacgggtcggtaccgtagggggttcgggttacgttggaggtaaccctaaggttaccttacctaaccttcccgtaacctacccgtaactccgtaacgacccgtaaccggtccgttaacgggaacctacggttaacggtaacgttaacctttcggaccgtttaacgtttaacggtttttttaacgtactttaccggtaccggtaacgtaccggtaacgggtacggttaaacccgtaaccgttaaccgggtttacccggcccgtttttaacccgaaccgggttttaccggtttcccgggggaacccggggtaaccggggtaacccgggttaagggggttccgttaaacggaaccgttaaacccggtaaaacgggtacgtttaccggggagtaacccgtttcggaaaccccgttacgtttaccggtttaccttacggttttaccc

SEQ ID NO: 74151 - DNA, 753 bp, Homo sapiens
  misc_feature: GYAE6OF02GNE7A.49.46.E02.1.454.CMB.1.raw
  modified_base (724)..(724): a, c, t, g, unknown or other
  misc_feature (724)..(724): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagactaccaccggagtaaattgtgttgactacagtcctccggccacctgtctttgtctccgagggtacagtcgccctacctctctgcgacgggccagtcaggtacgttgttagtactctttcgttacgccgttacggtaaccaaacgaacgtaaacccgtggtacccaacgggtccctaccgtacgggtccttacccgtactacttaccgtagtaccggtattagacctaaacgtacccgaaaccggtacgggaccctaacggttccggacctaccgttaaccccgaacggtacccggtacggtttaccgacgggttaaggccgtaagggggttcggtcttagggaacgtaaccgacggtacttaccacccttacgtaccctacccgtatcccgaaagtcggaacgttcccgaagtaccgtccgtaaggtaacttcgttacctgtactttaacggtttataccttgacaagtcacggtacgtacacgttacgtccgaccttcttcgtaaccggttcgggaaccgggtacggtaaccgttgggaacgttacgaacgttaacgaaaccggttacggtagtcggttaacncgggaaccgttactcggttatcccgtttc

SEQ ID NO: 74152 - DNA, 620 bp, Homo sapiens
  misc_feature: GYAE6OF02FLFAM.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccaggggacagtgccaccctctcctgcagggccagtcagagtgtagtagcttctagcctggtaccaacagaaacctggaccaggcctcccgaggctcctcatctatgatgcatccaacagggccacgtggcatcccagccaggttcagtggcaggtgggtctggtgacagtacttcactctcaactatcagcacgtctaaggacgccttagaacgtattcgtagacttaagttttaacttacgtgttacctagcgtagacgttaagacccgtaacgtcggtacccttacgtaccgttaccggttttacgggccgggtaacgggggacccctaaagggggtcggaacggttaacgttaaccgaaaaacggtaccgttagggttacggaccgtacggtaccctaaccgtacgtttaccgtaccgtttacccg

SEQ ID NO: 74153 - DNA, 741 bp, Homo sapiens
  misc_feature: GYAE6OF02FRI3N.49.46.E02.1.454.CMB.1.raw
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
tcagagtcgagagacacgaccggtgctcgatttagactcatctacagggaaagggggaggaactgctcagttaggacccagagggaaccatggaagccccagcctcagcttctcttcctcctgctactctggctcccagataccaccggagaaattgtgttgacacatctccggccaccctgtctttgtctcgaggggacagtgccaccctntcctgcacgggcagtcngagtgttagtagacctttnttaacgccgtaggtaacccaaacgtaacgtaaacccttggaccaggtacccttcccgaaggtcccttcccctctaacttccgttaattcggacttacggacctaacgtaccccaaaccggtcgggtacccctaagtccgggacctaacttacccccgaagggtacccctaagggttttccgaagggttccggaactagggttacgggttcctaggtacgaacgtacgtaccttaccacgttaccttacgacactcgacgacacgtccgagacgtccctaggtatacttacgtacgacttaacggtttaacttacgtagtacagaacgtacggttacgtaggaacctacgtacgggtaccctttcgtacccgtttaaccggttcgggaaccggtacggtaacccgtaacgggtaggtaacaacggttaaccggtaaacggtaacctcgggtaccgccgtacggacctaaccggtaccttccgtacggtttaacc

SEQ ID NO: 74154 - DNA, 748 bp, Homo sapiens
  misc_feature: GYAE6OF02HUPGG.49.46.E02.1.454.CMB.1.raw
  modified_base (221)..(221): a, c, t, g, unknown or other
  misc_feature (221)..(221): n is a, c, g, or t
tcagagtcgagagacacgaccggtgctcgatttagactcatctacagggaaagggggaggaactgctcagttaggacccagagggaaccatggaacgcccagctcagcttctcttcctcctgctactctcggcctccagataccgaccggaagtaaattgtgttgacacagtcctccggccaccctgttctttcgtctccgacggggacctaggtcgcccncccttctccgtcgcgacgggccagtcaggtagtgttaggtagtcttacttgccgttacggtaaccaacgtagaaacctcggccacggctacccgaggcctcctcgtatcctaagtgtatcgactactaccgaacgaccggtccacgtcggacacctacccgacgccgtaaggttcgacgggttcgacgtcgggtggtccttggacggacctacggtaccttaccgtacttccgtaccgtaccacgtcgaccggtacgaaccggtacccagggtaccgtccgaaggttaacgttaccgtttaaccgtggtaaccttttaacgggtttaactttcgttaccgtacgtaggacctagggttacgaacggttaacccgacgttcccgtccttaccggttaccgtaccgggttccggaaccgggggtttacggaaccggttagggacggtagtaacccgtaacggttaaacggtaccgtacgggttccggtacgtcccggacctaacgtacgttttccggacctttaaccgg

SEQ ID NO: 74155 - DNA, 211 bp, Homo sapiens
  misc_feature: GYAE6OF02ITZZG.49.46.E02.1.454.CMB.1.raw
  modified_base (206)..(211): a, c, t, g, unknown or other
  misc_feature (206)..(211): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctccagatacccaccggagaaattcgtgttgacacagtctccggccaccctgtctttcgtctccgagggactgnnnnnn

SEQ ID NO: 74156 - DNA, 783 bp, Homo sapiens
  misc_feature: GYAE6OF02F0WZH.49.46.E02.1.454.CMB.1.raw
  modified_base (766)..(766): a, c, t, g, unknown or other
  misc_feature (766)..(766): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaattgtcgttgacacagtctaccggccaccctgtctttgtcctccgaggggacagtgacccaccctctcctgcacgggccagtcagacgtagttagacgcttctagcctaggtacccaagacgaaacctggcccaaggtcctaccccaaggcctcctacgacttacgtaacctaggacttggcctaacttaccgaacgacggggccccaacgttcgggaccaacgttcccccgaacggacccggttaggggttcctaagggtccgggtaccgaaggttcccggggtttaccgggtgtaacccgaaggttaccctttaccggacccttaccgtaccctaacccggtaacctttccgaaccggtacctaacggttccccggttaagaacccgggtaccccttaagggtaaaagttcccgtttagtaccggaccggttttaacgttttaacgttacgttcggtttaaccgacggtacctagggtcccgtaacgacccgtaaaccgttccggacccttttacgaccgtttaacgttacccggggacggggttacgggaaccggtagggttacggacggtaaattaccggtaaacggactcgggtaggtcctacggaaccncgtactacgtgttaccc

SEQ ID NO: 74157 - DNA, 706 bp, Homo sapiens
  misc_feature: GYAE6OF02HCQUN.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaattgtgttgacacagtctccggccaccctgtctttgtctccgaggggtacagtcgccaccctctcctgcgacgggccagtcagagtagttagtagcttcgttagcctggtaaccaacgagaaacctcggccaggcctcccgaggcctcctcatctatgatcgacactaccaacggtacggcctacgtggaccactcccgagtccgtagtccgagtcggactagggtcgggttctggtagactagtaccttcaaccttcctacccgacctatccgacgacctacggtaccttaacggacgtcccgttaagaaacttacgtttacgacggttaactttagttttaacgtttacgtacggttacgacgtacgtaacgtcggtaacgacctacggtccgtccttaccgtacgttacccggttcggggaacccggggttaacgggaacccggttaaggggacggtaaacggtaaccgttaaacccggaaaccgggttaacgttacggggttacggtaccgttcggaacccctaaccggttcttacccgttcgtttacccg

SEQ ID NO: 74158 - DNA, 631 bp, Homo sapiens
  misc_feature: GYAE6OF02ID2MI.49.46.E02.1.454.CMB.1.raw
  modified_base (164)..(164): a, c, t, g, unknown or other
  misc_feature (164)..(164): n is a, c, g, or t
  modified_base (230)..(230): a, c, t, g, unknown or other
  misc_feature (230)..(230): n is a, c, g, or t
tcagagtcgagagacacgaccggtgctcgatttagactcatctacagggaaagggggaggaactgctcagttaggacccagaggaaccatggaagccccagctcagcttctcttcctcctgctactctggctcccagataccaccggagaaattgtgttgacanagtctccggccaccctgtctttgtctccagggacagtgccaccctctctgcaggccagtcagagtnttagagcttacttagcctaggtacccaacgagaacctcggacccaaggcctccccgaggcctacctcaatctatgatcgactaactccaacgacggcctaacgtcggcactccccgagccgtaggtttacgacggtggacctagggttcggtctcggtacgactagacctttcgaaccttcctacacctactcagccagtacccgtagacgactagtaaagctttcacgtactttaagtttacgttactgtacagtacacgtacgtagacctaacgtggtacccttcgtactaccggttcggacggttaaccgggaccttaaggggtcgaacgtacgtaaccgtaaacggtacgttacgtacggaccttcggaacctacctagttccccgttagttacccg

SEQ ID NO: 74159 - DNA, 853 bp, Homo sapiens
  misc_feature: GYAE6OF02IZNWP.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagatacccgaccggagtaaacttgtgttgacacagtctcccggccaccctgttcctttggtcctccgaggggacaggtcgccaccctctcctagccagggccagtcagtcgtgttagtagtccttatacgctacggtaaccaacgacgaacctggaccgacggtcctacccgacggtcctacctactagtactacgtacgtagtaccgactactacccgaaacggacggggtaccctacggtaccggtacctaacccgtaccccgtacgggtacccgtagggttaccgtaacggttccggtacgtaacgggttcggggttaccgttggtacgaaccgtaacggtaccttaccgtaaccttccgtaacccgtaacctacgtcctaacggtcccgaacggtacccgttaaggccgtacccgttaaggtaaacgtttaccgtttacgtacgttaaccgttttaaggttttaaccgttaccgttacggtaaccgaccggttaaccgtacgggttacccgggttaacaaccgtttaaccgtcccgggttaacccttaccgtttccccggtttaaccgggtttccgggaaaccgggggttaaccgttaacccgggggttaacggtagggtaaccgtaaccggttaaacccggaaacggtcggtaaccgggttaccggtacgtaccgtaccctaaccggtaccgtttaccgcccggttttaacc

SEQ ID NO: 74160 - DNA, 790 bp, Homo sapiens
  misc_feature: GYAE6OF02GIVX2.49.46.E02.1.454.CMB.1.raw
  modified_base (362)..(362): a, c, t, g, unknown or other
  misc_feature (362)..(362): n is a, c, g, or t
  modified_base (572)..(572): a, c, t, g, unknown or other
  misc_feature (572)..(572): n is a, c, g, or t
  modified_base (703)..(703): a, c, t, g, unknown or other
  misc_feature (703)..(703): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagactaccaccggagaaattgtgttgacacacgtctccggcctaccctgttctttgtcctccgaggggactagtcgccctacccgtcttcccgtggacgacgggcctaggtccagaggttcgttaggtacgtcgtttacttcggaccgttacggtaaccctaaacgacgtaaaacccgtgggaccctagggcctccgacggttcctccgtacattctatacgtancgctacgtaacccaacggacgggcctaacggtcggacctaactccccgagtacccgtaaggttcgacgggcggtacgtacggggttcgggtacgttacgggtacgtaaccgtacggttaccttacggtaccctttaccgtacccaaccttacgtaccgactaccggaacgtacccgtaaggtccgaaccgttaaggatttacccggtttnacgttagtttaaacgtttcgtttacgttacgtacgaagtacgaccggtacgtaacgtacccgtacggttcgtcctttaaccgttcctttaaccgggtcccgggaacgggtaaccgggtacgttaacggggngttacccggtaaagtaaccgtaacggggtcgtttacggaccggttacgacccgttaccgaacctagtttacccgtccggtttacccg

SEQ ID NO: 74161 - DNA, 603 bp, Homo sapiens
  misc_feature: GYAE6OF02FZM0X.49.46.E02.1.454.CMB.1.raw
  modified_base (295)..(295): a, c, t, g, unknown or other
  misc_feature (295)..(295): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagatacccaccggagaaattgtgttgacacagtctccggccaccctgtctttgtctccgaggggacagtcgcccaccctctcctgcagggccagtcagtagtgttagtacgcttcttagcctggtaaccaacagaacctgccaggctcccgagctcctnatctatgatgctatcccaacgcgggtccacgtggctaactcccgagcccagggtttcaggtggcgtaggtcggggtctggtgactagtactcactccgtcaaccatcaacgcacgcctagacgtcctagaacgtacttccgtagtcgttaagtttacttacgttcgtacgtaagccggtaagcggttacgacgtaacgtcggtacccttccgtcttaaccggtttcggaccgggtacgggacgtacggtggaacgtaacgaacgtaaacggtacgttcggtaggctcgtacctactcgttgtcgttac

SEQ ID NO: 74162 - DNA, 722 bp, Homo sapiens
  misc_feature: GYAE6OF02HIC9U.49.46.E02.1.454.CMB.1.raw
  modified_base (565)..(565): a, c, t, g, unknown or other
  misc_feature (565)..(565): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggcctcccagataccaccggagaaattgtgttgacacagtctccggccacccttgtctttgtctccgaggggacagtcgcctaccctctccgtgcgagggccagtcgagaggttgttagtgtccttacttacgccttaggtaaccaacgaacggaaaccttgggaccacgggccttaccccgaaggccttcccctactaatcctagtacgatcgaccactacccgaaacgcgggaccctagtccggactaccgtacccgtacgaccgttacggggttcacgggtcggtacgtacgggtggttctagggttacgaacttacggtaccttacaccgttcctacccaacgtactaccgaaggtccctaacggtctaacggacaccgttagaacgttacttcgtacgtactttacgtttaacttcggattaccgacgtnagttacccggatacccgtagtccgttaccttccgtaacgttccggggtaccggaggggttaaaccggccggtaaggggttacctaacgggaaacgttaaccgaaacggtcggttgggacgttccgaacgcccggttaaccttgccccggtttatccg

SEQ ID NO: 74163 - DNA, 584 bp, Homo sapiens
  misc_feature: GYAE6OF02F8DPC.49.46.E02.1.454.CMB.1.raw
  modified_base (436)..(436): a, c, t, g, unknown or other
  misc_feature (436)..(436): n is a, c, g, or t
  modified_base (570)..(570): a, c, t, g, unknown or other
  misc_feature (570)..(570): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgcccaccctctcctgcagggccagtcagagtgttagtagcttcttagcctggtaccaacagaacctggccaggcctcccgaggctcctcatctatgatgcataccaacgacgggccacgtcggaccactaccccgagtaccccgtaggtttcaaggttcggcgtagggttgggtctgtacgacagtaccttcgactctccacactcagtcacgctagacgcgtagagtatcncgtcttaagtttatacgtgtacacgcacgacgtacacgtacgtccgtaccttcttaccgttcgttacgggaccggaggtacctagggtcggaagactaacgaaaccgtacgttggtaccgacgtcgaccgtacnggtttcctagttcc

SEQ ID NO: 74164 - DNA, 939 bp, Homo sapiens
  misc_feature: GYAE6OF02GOO6P.49.46.E02.1.454.CMB.1.raw
tcagagtcgagagacacgaccggtgctcgatttagactcatctacagggaaagggggaggaactgctcagttaggacccagaggggaaccagtggaacgccccagctcagcttctcttcctcctgctactctggcctcccagactaccaccggagaattcgtgttgacacagtctccggccaccctgtctttgctccgaggggcagtcgccctacccgtctcctgcgacgggccagtcaggacgttgttaagtagtctttcgtacgtccgtacggtaacccaaacgtaacgaaaccgtcggaccgaacggccctacccgacgtcctccttacactcttagtgacttcgacctacctacccgaacggtaccgggacccacggtcggaccctaccgtaccccggaacgtaccccggttaaggttaccgacgggtacggtaccggtacggggttaccgggggttcttaacggtacggtaacccgttaaggttaccctttaccgtaaccctttccctaacctaacccgttagtacccgtaggtacccgaaccgtaccgtaaaccggacccggtaccggttaaagtaaaccgtttacttcccggttaacgttacccggttttaaagttttaacccgtttacgttccgggtaaccgtacgggtaaccgttaaccgggttaccccggttaaaggaaccccgtttaaaccccgggtttccgggtccccccgtttaacgtttaaccccgggtttaacccgggggttttaacccgggggaaacccgggggaaccccggggtttaaaaccgggttaacgggggaccgggtttaaaacggtaccccgtaaaaacccggggttaaaacggttccgggttaacggttacccggggtacttaccgggtaaacccgttaacccgaggttttaaccccggtttacgtttaaccccg

SEQ ID NO: 74165 - DNA, 804 bp, Homo sapiens
  misc_feature: GYAE6OF02HV7BU.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctccagactaccacggagaaattgtgttgacacagtcctccggccacccttgttcttcgtcctcgagggacaggtcgccctacctctcctgcgacggccagtcaggtaggttgttagtacgtcttacgttaacgccgtaggtaacccaaacgaagtaaacccgtcggaccgacggtccttacccggacggtcccttacccgtactaacttacttacgtacggtacttacgacctaacttaaccccgtaaacggaccggtccctaacgtcggccctaaccgtaccccgacgtaccggttacggttacccggtaagggtccggtacctaaggggttcgggtactaggtcggaactacggtaccttcgaaccttcctaaccgcctaatacccgaggacctcggtaaccgtacggtaaccgtccgtaagtacgtttacgttcgacgttaccgtttaagtttaccggtttaccgtgtttacgaacgttcgaacggttccgtaacggtacccgtaacggttccgtaccggttccctttaggttaacccgggtttcgggaaaccgggtacggaaccggttaacgggcggtttaaacggacccgttaaacggtaacggttaccggtacggaccgttaccggtacctaccggtaccctttacggttccgtttctaacccgg

SEQ ID NO: 74166 - DNA, 739 bp, Homo sapiens
  misc_feature: GYAE6OF02FMRVJ.49.46.E02.1.454.CMB.1.raw
  modified_base (575)..(575): a, c, t, g, unknown or other
  misc_feature (575)..(575): n is a, c, g, or t
  modified_base (660)..(660): a, c, t, g, unknown or other
  misc_feature (660)..(660): n is a, c, g, or t
tcagagtcgagagacacgaccggtgctcgatttagactcatctacagggaaagggggaggaactgctcagttaggacccagagggaaccacggaagccccagctcagcttctcttcctcctgctactctggctcccagataccaccggagaaattgtgttgacacagtcctccggccaccctgttctttgtctcgagggacagtgccaccctctcctgcgagggccagtcaagagttgttagtagtcttacttagtcctggtaaccaacaacgaaacctggccagggcctaccccgaggccttccgtacacttacctagtcgatcggacctacaccgtaacgaccgggcctaccggtggcctacaccccgacgtaccgtacggttacacggtggacgtacgggttcggggttcgttaggtaacgacccgagttaacttccctaaccgtacccttacccgtacctaacgttccgaaacgtccgtaaccgtacccggttaacgacggtaccccgtaaggtaacgtactttaccgtcgttacgttaacggttttacttaagtttcgacgtacgtaccncggttacgacggtacccgaaccgttccgggtcctttaccgtaccttaccggtttccggggacggtaaagggacccgttaaggggngttaacgaacgttaacggaaaccgttacggtacgttcggacgttaccgaaccgttctaggttcctacgttacctaaccg

SEQ ID NO: 74167 - DNA, 806 bp, Homo sapiens
  misc_feature: GYAE6OF02HBPN6.49.46.E02.1.454.CMB.1.raw
  modified_base (182)..(182): a, c, t, g, unknown or other
  misc_feature (182)..(182): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaattgtgttgacacagtctccggccacccgttntttcgtctccgaggggacagtcgcccaccctctcctgcagggccagtcagagttgttagtacgtctttcttacggccttacggtaaccaacgaacgtaaaccgtcgggacccacgggtccctacccgaggtcctcccttactattccttatggtactcggacctacgtacccaaaccggcgggacccaacgtcggaccaaccttaccccgacgtacccgttacggttaccgaggttcggtacgtacgggttacggggttcttagggtccggaaacctacggttactttaccgtaccttacccgtacaaccctgtaccgtacgaccgtaccgtaccgtacggacgtccgttaaggaaacgttacgtttacccgtagttaccgtttaagttttaccggttactcggttaacgacgtacgtacggtacgttaacgtaccgtaaccgttcggtaccccttacggttacccgttacccggggtttacgggaaccggggtaaccggtaacgggtacggggttacggaacggtaacgttaaaccggtaaacggttaacggttagggtaaccggtacggtaccgtaacccggtaacgtttaccgtacggttttacccgtaccgtttaacccg

SEQ ID NO: 74168 - DNA, 823 bp, Homo sapiens
  misc_feature: GYAE6OF02JNZLH.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctccagactaccaccggagaaattgtgttgacacagtctccggccacctgttctttcgtctccgaggggacagtcgccaccctctccgtgcgacgggtccagtacaggagttgttagtagtcctttacttacgccttagggtaacccaacgtaacgaaaaccgttcgggacccgaagggtcccctcccgtaacgggtccttaccctaccgtacttacctaagttcgtaacgttcggaccacttaacccgaaaccgggacgggtaccccgtaacgttcgggaccctacgttacccccgaacggttcccgtaacgggtttaccgagggtaccgggtaccgtaggggtcgggttacgttcggttaacgacggtaccgtacttacgtaccttcgtacctaccgtacgtacgacgacgtaccgacccggttaggaccgtaccgtaggaacgttacttaccggtactacggtttaaacgtttacggttaccctttaggtaccgtacggtaaccgtacggttaaccggtaccgtaacccggttaacgtcccggtacctttaccgttaccgttaccgggttacgggaaccggggtaaccggtaacggttacggggtacgtaacgtaacggttaaccgaaaaccggttgttaaccggttcggaccgtacgacccgtacctacggtttactccgttaaccg

SEQ ID NO: 74169 - DNA, 744 bp, Homo sapiens
  misc_feature: GYAE6OF02H3DK7.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtcctccgccaccctgtctttgtctccgagggacagtcgccaccctctcctgcaggccagtcagagtgttagtacgcttctagccgtgtaaccaacagaaaccgtggccaggtcctcccgaggctaccgtctaagttctagtgtactgacacttacaaccggacggtccaacgtcgaccgtacctaccccgagtacccgtacggtttaccgaacgggtcgggaacgtacggggtttcggggttacttagggttacggaaccgtaaacggtacctttaccaaccctttaccgttaccaaaccctagtacccgagacgtacgtaccgtaagacgtacccgtaggaacttacgttcgtacgacgtttaaacgttttaacttacggttagtccgaagtacgtaccggtaacgtacggaacccgaaccggttccggtaaccttccgttaccttacccgggtttacgggaaccgggtaacggggtaacggttaaaccgggtggtaaacggaagttaaacccggaaaacgttacgtacgggttacggcgtaccgggtacccaccgtttatcccgtttgttaaccg

SEQ ID NO: 74170 - DNA, 740 bp, Homo sapiens
  misc_feature: GYAE6OF02IYD8Y.49.46.E02.1.454.CMB.1.raw
  modified_base (733)..(733): a, c, t, g, unknown or other
  misc_feature (733)..(733): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtctccgaggggacagtcgcccacctctcctgcagggccagtcaggagtgttagtagcttcgttagcctggtaccaacacgaacctggaccaggcctcccgaggccttcctcattctactaggtactagcctacgtacccgaaacgtacggggaccctaacgtcgggacctacgttaccccgcggtacccgtaaggggtttccaacgggttcgggaccttacggggttgggggtccttagggtaccgaacgtacggtacctttaccgacttacccgtacctaaccgtacgtcctaacggaccgaacgtacccaaacgggtaccgtaccttacggttaaaacgtcgtttaccgtacggtaccgtttaaaggtttaaccttacgttcggtacctaaggtccacggttacggaacgtccgtaacggttcggtaaccttacccgttcgttaccggttaccggaccggggtaacggtacccggtagggtacggtaacgtaacggtaccgtaaacggtacgtggtacggacctaggaccctagtactacgttnttacccg

SEQ ID NO: 74171 - DNA, 797 bp, Homo sapiens
  misc_feature: GYAE6OF02JI5BO.49.46.E02.1.454.CMB.1.raw
  modified_base (261)..(261): a, c, t, g, unknown or other
  misc_feature (261)..(261): n is a, c, g, or t
  modified_base (316)..(316): a, c, t, g, unknown or other
  misc_feature (316)..(316): n is a, c, g, or t
tcagagtcgagagacacgaccggtgctcgatttagactcatctacagggaaagggggaggaactgctcagttaggacccagagggaaccatcggaagccccagctcagcttctctcctcctgctactctggctcccagataccaccggagaaattgtgttgacacagtctccggccaccctgtctttgtctccagggacagtgccaccctctcctgcagggccagtccagcgtgttagtagcttcttagcctggtaccaanacgaaacctggccaggctcccaggctccgtcatctatgatgacctatcccaaacngggaccctagtcgggcctacgtcccctaaggccctacggtttaccgtacggtccggaccgtaagggttcccgggggttcttcggttaacggacctaaacgggtaccttttaccgtaacccgtttacccgttacctaaacccggtacgtttaaccgaaccgggtaccgtaccggtaccccgttaacgggtaaaccggtcccggttaacggtaaacggttacctttaccggttacggttaccgttaaacgggtttttaccgtttaaacccggttcggtttaaccggaacggttaccgtaaacgggttacggtaaccggttaccgtaaacccggtttccgggtacccttaccgttacccgttaaccgttttcccggggaccgggtaaacgggtaccccgtaagggtccggtaacggtacctaaccgtaaccggtaaccgtcgttaacggtcgtacgtaaccctacggaccttcgtcgttaaccg

SEQ ID NO: 74172 - DNA, 864 bp, Homo sapiens
  misc_feature: GYAE6OF02JOJ1Y.49.46.E02.1.454.CMB.1.raw
  modified_base (211)..(211): a, c, t, g, unknown or other
  misc_feature (211)..(211): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctccagataccaccggagaaattgtgttgacacagtcctaccggcctaccctgttctttcgtcgtaccgaggggaaccnggtcgaccctacccttcctccgtgccgaagggcccctaggtaccagggtaacgttaggttaacggtacgtaccgtttacgtttaaccggtcccgttaagggttaacccaaacggtaaccggtaaaaccgttcgggaccaaaccgggtccctaacccgtacggtacccttaccccgtactaacgtacgttacgtacggttaactcggactaacctaaccgaaaccggtacggtaccctaacggtacccgggacctaaaccgttcccccggaaaggtaccccggttaacggtttacccgaacggttccggtaacggtacggggttcggggtttacctacgggttaacggtaacgttcggtaaaccgtttccgaaccgtttaccacccgtaaacgtacgttaacccgaacgtaccgtaacgtaacccgtacgggtaccgtaaccgtaacgtaaacgtccgttaacgtacgtacgttaacggttacgttaacttacggtacgacgtactacgtacggtaaccgacctacggaccgttcctacggttacctaacggttccgggaacgtacgggtaactaggtacggaaccgtaacgtaaccggtaaacgtaacgtaggttacgacgttacggaccttacgtaccgtgttaccttaccg

SEQ ID NO: 74173 - DNA, 651 bp, Homo sapiens
  misc_feature: GYAE6OF02HJLSX.49.46.E02.1.454.CMB.1.raw
  modified_base (206)..(206): a, c, t, g, unknown or other
  misc_feature (206)..(206): n is a, c, g, or t
  modified_base (298)..(298): a, c, t, g, unknown or other
  misc_feature (298)..(298): n is a, c, g, or t
  modified_base (333)..(333): a, c, t, g, unknown or other
  misc_feature (333)..(333): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagactaccaccggagaaattgtgttgacacagtctccagtccaccctgtctatgtctccgaaggggaaancgcccaccctctacctgcgaggccagtcagatgtgcagcctatagcctggaccagacaagaaacctggaccaggcctacccagtcctccctnacttcttagatcgcctacgtcccgaggacgggccncgtcgaccactcccgagacccgtaggttcgaggtcgggcgtagggttggggttacgggactacggtcttcgacgtcctacgaccataccacgaccacgtaccgtagacgtaccgtagtaaagttgtttacggacgttaagtttaacttcgttacgttaccgtaacacgtacctaaccgaacgttaggtacctttacgtacccggtttaccggcccgtacgggtaaccctaggtaacgtacggtaactacgtaacgaaccgtagttcggacggtctaaccgacctactacgttgttaccgtactttcctacttaccccg

SEQ ID NO: 74174 - DNA, 823 bp, Homo sapiens
  misc_feature: GYAE6OF02FO3RZ.49.46.E02.1.454.CMB.1.raw
  modified_base (158)..(158): a, c, t, g, unknown or other
  misc_feature (158)..(158): n is a, c, g, or t
  modified_base (315)..(315): a, c, t, g, unknown or other
  misc_feature (315)..(315): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgngttgacacagtctccggccaccctgtcctttgtctccgagggacagtcgcccaccctctcctgcgagggccagtcagagtgttagtagacttcttagcctaggtaccaaacagtaaacccgtggacccaggccttacccgaagggtccttaccctanaacttctaagtcgaactacgactacgttaccaaaccgacgggtccccaagttcgggacctaacgtcccccgaaggtacccgtaacgggtttaccgaacggttcggggcccgttaagggttaccggggggttaccttacgggttaccggaaacccgttaaacggggtaaccccttttacgtaaacccgtttaccgttaccccaaaccccgttaacgttaccaaccgggtaacccgtaacggaccccgtttaaaggaccgttacccggttaacggtaaaacgtacgttaccgttacgtaccgtttaaggttttaacttttaccgtaggtttaccgaacggtactaacgggaccgttaacgaccgttaaaccggttccgttaccgtaccttacccgttacgtttaccgggaccggaaccgggtaaccgtagggtacgaacggtaacttaaccgaaacgttaacgtcggttacggacgttcgaccgtacttaccgtacgttcggttaacccg

SEQ ID NO: 74175 - DNA, 776 bp, Homo sapiens
  misc_feature: GYAE6OF02I8E5Y.49.46.E02.1.454.CMB.1.raw
  modified_base (565)..(565): a, c, t, g, unknown or other
  misc_feature (565)..(565): n is a, c, g, or t
tcagagtcgagagacacgaccggtgctcgatttagactcatctacagggaaagggggaggaactgctcagttaggaccagagggaaccatggaagccccagctcagcttctcttcctcctgctactctggctccagataccaccggagaaattgtgttcgacacgagtctccggccaccctgtctttgtctccaggggacacgtgcccaccctctcctagcgacgggtccaggtcaaggacgttgttacgtacgtctttacgtttagccccgttgggttaaccccaaacgaacgtaaaaccccgttggcccctaagggtcccctaccccaacgggtccttcccccttacgaactttccttaacgtagtaagttcgacccaacttaccccgaaacgaccggggcccacgttacgggacctacctcccccgaaggtcccctagggtttacaacggttcggggaccgtagggttccgggggttcttaggtacgaacccgtaaggttacccttacgacccttccctaccaaccctatcaagccgtaacgacttacggacgtcccggtanaattaccttagacgttacttaagttttacttaacgttgtccgagcgtagaacggtactaacgcgtaaccgtccttaccgtcgttacccgtttacggggacggtaacgggtacggtacgggtcggaacgggttaaccaacgggtaaacgtaaacggttcggtttaaccggaccttttaccgacctacccggtacttaccgttacggtttccc

SEQ ID NO: 74176 - DNA, 589 bp, Homo sapiens
  misc_feature: GYAE6OF02HQY0A.49.46.E02.1.454.CMB.1.raw
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (375)..(375): a, c, t, g, unknown or other
  misc_feature (375)..(375): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctcccggccaccctgtctttgctccaggggacagtcgccaccctctcctgccagggccagtcagagttgttagagcttctagcctggtacccaaanagaaacctggccaggcctccaggctccncatcatcgatgcataccgaacagggccaacgtcggcactcccgagcctaggttcagtgcnggtggtntagtgacgagtaccttnaacctctaccgacctatcagtacacgtacctaggactccgtagaaacgtatcgtagacttagtttattacgtgtacagctacgcgtaagcctaagtcggtcctcgtacttaccgtttacggacgggtacggtacgtaggtacgggtaacggtaactaaccgaaaacgtaacgtaggtacggtactcggtaaccacccgtattacgtgttacccg

SEQ ID NO: 74177 - DNA, 754 bp, Homo sapiens
  misc_feature: GYAE6OF02IEHW3.49.46.E02.1.454.CMB.1.raw
tcagagtcgagagacacgaccggtgctcgatttagactcatctacagggaaagggggagaactgctcagttaggacccagagggaaccatggaagccccagctcagcttctcttcctcctgctactctggctccagatacccaccggaagaaattgtgttgacacagtctccggcctaccctgttcctttgtctccgaaggggtacagtcgccctacccctctccgtgccgacgggccagtccaggtagttgttaagtatctttaccttagccttaggtaacccaaactacgaaacctggaccacggcctacccgaggcctcctctatctatgatcgctactaccgaaacgcggtaccacgtcggacctaccgtcccgagtcccgttaggtacgtaagggtcgtaccgtagggtacggttcgtaggtacaaccgtacggttaccttactaaccttccgtaccctaaaccgtaactcgtaacgaccgtaaccgttacccgtaggtaacccgaccgttaaaggtaacgttaccgttacgtacgggtaactttaagttttaacgtcgtagttaccgacggtactaaggtaccgttaccgtacgtaccgtccggttacccgtaccttaacggtttccgttaccggggaccgggttaaccgggaacgggtacgtaacgggtaacgtaacccgtaaaccgtaaacggtcggttacggtacggtacaccggtaacctccgttaaccgttcttacggttccc

SEQ ID NO: 74178 - DNA, 765 bp, Homo sapiens
  misc_feature: GYAE6OF02HAS3U.49.46.E02.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
tcagagtcgagagacacgaccggtgctcgatttagactcatctacagggaaagggggaggaactgctcagttaggacccagagggaaccagtggaacgccccagctcagcttctcttcctcctgctactctggctccagataccgaccggagaaattgtgttgaacacagtcctccggccacctgtcttgtcnccgagggacagtcgccctacctctcgngcgacggcctagtcgaaggcgttagttagacgtctttacttacgccgttaggaacccaaacgacgtaaaccgtggaccgtacggccctcccagggtccctcctactacttacgtataggtacgtagtcaacgttaccaaccggacggcccacgtacggctaccgtcccacgtccgtaggttacgaggtcggtaacgtggtcggggtcttacggacacgagttaccttactactaccctacgaacccgtactaccaagcccgacggttaaccctcggaaaccgtacgtaaacggtaaacgttacgtttaccggaccggttaacttaaacggttttaccgttaaccgttaggtacccaagttaacggacggttaaccgtacgggtaaccctacggttaccgccgtttaccttaccggttcggttccgggaacggggtaaccgtaaccggtagggtaccggtaaggtaaaccgttaaccggaaaggttaaacgtgggtacgtacgttacccggaaccttaaccgtacggttaccgttaacggtttccc

SEQ ID NO: 74179 - DNA, 930 bp, Homo sapiens
  misc_feature: GYAE6OF02F3U17.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggcctacctgtctttgctccgaggggacagtcgccaccctctccgtgcgagggccagtcagagttgttagtacgtctttcgttacgcctacggtaaccaacgtaacgaaaacccgtcggaccgaagggtccccgtaccccgacggggttcccttacccttaacgtaaccgtttccgttaagttcggtaagttcccggacctaaccgttacccgaaaccggaccgggggtacccaaccggtacgggtcccaaccgttacccgacgtaccggttaacgggtttccgaacggttcgggacggtacgggttcggggttaccgtacggtacggtaccgtaggtttaacccttcccgaccggtttacccttaccgtaaacccgtaccgttaaccgaccgtaaccgttaacccggtacctttaaccggggaaccgttaccggtttaaacgggtaaacgtttacgtttccgggttaaaccgttccgttttaaaccgggtttttaacgtttacccggttttacggttaaaccgtacgggtttacccgaaacgggggttttaacccgggtacccgttaaacccgggttaaccggttacccgtttcccccgttaacgtttacccggttacccgggttttaccgggggacccggggtttaaacgggaaaccgggtagggggttaccggtaaggttaaaccggaacgtaaacgggtaacgttacgggtacgtacggtccaaccggtacttaccggttacgtcgtttacccgg

SEQ ID NO: 74180 - DNA, 734 bp, Homo sapiens
  misc_feature: GYAE6OF02FYPP0.49.46.E02.1.454.CMB.1.raw
  modified_base (457)..(457): a, c, t, g, unknown or other
  misc_feature (457)..(457): n is a, c, g, or t
  modified_base (559)..(559): a, c, t, g, unknown or other
  misc_feature (559)..(559): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggcctaccctgtctttgtctccgagggacagtcgccaccctcgtcctgacagggccagtcagagtgttagatcttcttagcctaggtaccaacgagtaacctggccaggcctccgaacggctacctcgatctatgtatgactactaccgaacgacgggccacggttggcctacgtaccccgtagacccgtaagggttcctaagggttgggaccgtaaggggttcgggttcttaggtaccgggtaactacggttaacccttaacaccctttccgacccaacccttnaacccgtagacccctaacgggtaccctaagggtaaccggtccccgtttagggaaaacgtttcttaccgtacgtacgttaagttttcgttaacttccggttanacgtaacgtagtacggtacgacgaccgttggcccttcgttacgttccggttacggacgggtaaccggtaccgtaagggtcgtaaacggtaacctacgggaaaacccgttacgtaagggttaccggtacgttacccggaaccccgtaaccgttaccgtacgttcgttttaaccccg

SEQ ID NO: 74181 - DNA, 629 bp, Homo sapiens
  misc_feature: GYAE6OF02I0ZYJ.49.46.E02.1.454.CMB.1.raw
  modified_base (617)..(617): a, c, t, g, unknown or other
  misc_feature (617)..(617): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaattgtgttgacacagtcgtccggccacctgtctttgtctccgaggggacagtcgccaccctctcctgccagggccaggtcaggagttgttagtagtctttctagcctggtaaccaacacgaaacctggccaggccctaccccgaggtccttccctacattcctagtgactcgctactaccaaacggtacgggccaacgtcggactactcccagccgtaggtaccgagtcggctagggtcggtctcggtacgacgacgtacttccacttccgaccactacgtcacgtccacggtacctagcgtaccgtaggaacgtattcgtgtactttagtttactaccgttagtacgacgtacgacgtacgtagaccgtaacgtcgtaccttacgtccgttacggttccggaggaccgggaactagggtacgaacgtacgtaacgaaccgtagtccgtaggctacgtacctaccngttcgtgttacc

SEQ ID NO: 74182 - DNA, 707 bp, Homo sapiens
  misc_feature: GYAE6OF02HLDSF.49.46.E02.1.454.CMB.1.raw
  modified_base (683)..(683): a, c, t, g, unknown or other
  misc_feature (683)..(683): n is a, c, g, or t
tcagagtcgagagacacgaccggtgctcgatttagactcatctacagggaaaggggggaggaactgctcagttaggacccagagggaaccatggaagccccagctcagcttctccttcctcctgctactctggcctcccagactaccgaccggaagaaattgtagttgacacagtctccggaccaccctgttctttgtctccggaggggcaggtcgcccaccctctcctgcgagggccagtcaggtattagttagtacgtcttacgttacgccgttaggaaccaacacgaaccgttggacctacgggtccctacccggaggtaccttccctacacgttactagtacgattcgacctaacgtacccgaaacggtccgggtacccacggtacggaccaccgtcccgaagtcccgttagggtcgaggtcggactacgggttggcttgtacgagtacgtactcgaccttcgaccacctagtccaggacacgtactacgaacgccgtaaggtaacgttacttcggttacgtaacgtttagtttacttaacggtaggtactaacgtcggaacgttaccggaaccgtcttaaccgtccggtaccttacgtccgttaccgggtttaccgggacgggtaaccggtagtacgggtaaggaccggtaacgaaccgtaacggtacgtgaccggtnaacgcctacgtctcccttggttac

SEQ ID NO: 74183 - DNA, 719 bp, Homo sapiens
  misc_feature: GYAE6OF02G5RGE.49.46.E02.1.454.CMB.1.raw
  modified_base (206)..(206): a, c, t, g, unknown or other
  misc_feature (206)..(206): n is a, c, g, or t
  modified_base (225)..(225): a, c, t, g, unknown or other
  misc_feature (225)..(225): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagactaccaccggaagaaattgtgttgacacagtctcccggccaccctgtctttgtctccgaggggacngtcgccaccctctcctgcngggccagtcagagtgttagtatcttctgcctaggtaaccaacgagaaccgtggccaggcctcccaggcctcctcctatctatgatcgcctactacccaacgacgggcctacgtcggacaccgtcccgacgtcccgtaggttacgaggtcggtcgtacgggttggggtctggtacgaacgtacgtacccttacgaccttcctaccgaaccctaacgtccgtaccgtacgaccggtaccgtaacggtacggtaccgtacggtaaacgttattccgtacgtacgttacgttttagtttacgttacgttacgtcggtacacgggtacgtaacgtaccgtaccgtcggtcccgttaccgttaccgttaccgggttaccgggaccgggtaacgggtaacccgggtagggtacggtaacggtaaccgtaaaccgtaaaccggtaacgtacggtacggtacgtaccggtaccgtaccgtacggtttccgttaccgttacccg

SEQ ID NO: 74184 - DNA, 686 bp, Homo sapiens
  misc_feature: GYAE6OF02J0S8E.49.46.E02.1.454.CMB.1.raw
  modified_base (506)..(506): a, c, t, g, unknown or other
  misc_feature (506)..(506): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccaccggagaattgtgttgacacagtctccggccacctgtcttgtctcgagggacagtcgccaccctctcctgcacgggccagtccagagttgttagtacgtcttcgttacgtccgtcggtaaccaacgaacgtaaacccgtcgggccgaacggtcctcccgaggtcctcccttacacttctagtcgatgacactaccaacgacggaccctacgtcggcctactaccccacggtacccgtaagggttcgacggtaggaccgtacggggttggggtccttggtaacggaccgtaacgttacccttacgtacccgttactacccgtacactaccgacgtcgaacgtcctagtacgccgtagtaacttnttcgcgtacttagtttactctcgtacagtacgacgtcggtacgtactcgtaccgtcctacgttccgttaaccgtcggggtaacgggacgaaccggtagggtacggtaacgtaacctaacggtaacgtaccggttggaacggttccgtaccggtaacctacgtccgttacgttacgttacc

SEQ ID NO: 74185 - DNA, 778 bp, Homo sapiens
  misc_feature: GYAE6OF02GC0BM.49.46.E02.1.454.CMB.1.raw
  modified_base (201)..(201): a, c, t, g, unknown or other
  misc_feature (201)..(201): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacngtgccaccctctcctgcagggccagtcagagtgttagtacgctttcttagcctggtaaccaagacgaaacctggaccaggcctccgaggcctcctcatctatgatgcataccaacgacgggccacgtggacactccccgacgaccgtacggttcgaggtcggacgtagggtcggggttcttgggtacgaacgaacggttacttaccgaacctttccgtaccctaaccactaccgaacgctaaccgtaccgtaaggaaccgtcccgttaagaaacggttacctttaccgtacggtaccgttttaagtttttaacgtttaaccgtttacggtacctaacgggtacctaacgggttacggttaaccgaacccgttaaaccggttccggttaccccgtttacccgttaccgtttaacccgggttttacccggggaccgggggtaaccgggtaaacccggtaagggggttacggtaaacgggttaacctaaacccgggtaaaacggttaaccggtttacggtaccgggttaccttacgggtaaccctaacccggtaaccgtttccggtccgttttaaccccg

SEQ ID NO: 74186 - DNA, 691 bp, Homo sapiens
  misc_feature: GYAE6OF02JFECF.49.46.E02.1.454.CMB.1.raw
  modified_base (106)..(106): a, c, t, g, unknown or other
  misc_feature (106)..(106): n is a, c, g, or t
  modified_base (265)..(265): a, c, t, g, unknown or other
  misc_feature (265)..(265): n is a, c, g, or t
  modified_base (412)..(412): a, c, t, g, unknown or other
  misc_feature (412)..(412): n is a, c, g, or t
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
tcagagtcgagagacacgaccggtgctcgatttagactcatctacagggaaggggagactgctcagttaggaccagaggaaccatggaagccccagctcagcttcncttcctctgctactctggactccagataccgaccggagaattgtgttgactacacgtctccggccacccttgtctttgacgtccgagggactaggttcgccctacctcgtctgcaggtccagtcagagtgtatagcttcgtagcctacggtaacaacgngtaacctggaccaggacctaccgaggtcctaccgtactacttacgtatcgagtcgacctacgtaccgaacgtcggacctagtaccgataccgttacccaagtccgtaacgggtttacacgggtcggaaaccgtagggtccggttacncgggtacttacaaggtttacccttagacccgttcgtaccaaccgttntacccgntaccgacgtaccgtacgtacggtacctagaacgtcttacgacgtacttaaggttaacttacgttacgttaacgcgtaacgaccggttcgtacgtaccgtacgttccggtactcgttacccgtaggttacccggtacggacgtaacgacggtataccgggaacttaccggaaacttcggtacgtacggcccgttagtaccccaacggtgttaaccgtccgttaacg

SEQ ID NO: 74187 - DNA, 792 bp, Homo sapiens
  misc_feature: GYAE6OF02F1OVA.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagaaattgtgttgacacagtctccggccacccgttgtctttgtcctccgagggggacaggtcgccctaccctctcctcgcgaacgggcccaggtccaggtaggttaggttagttaggctttacttacgtccgttagggttaaacaaacgaacgaaaacccgttggcccaagggcctcccgaacgggtcctcctacatcctatcgatggccacgtaccgaaccggaccggacctacggtccggactaaccgtcccgaccgtacggtacggtgaaggtcggtacggtaggtcggttcgtagtagacgtacgtacgtacctctacctaccgactacgacgtacgtacgtactacggtaacggtcacggtaacggtaagttaccgttacggagttaccgtttaacggttttaactacggttacgcggtaacgttccggtacgtaacgggtaccttacccggtacggtccgttacccttccggtttaacccgttaccggggttcggggaaaccgggggttaaccgggtacgggtacgggaacgggttaaccggtaaaccggtaacccgttaaacggttaacccgggtgggttccccgttagtaaccggtacccttacggtaacctttcccggtaccttttaacccggg

SEQ ID NO: 74188 - DNA, 736 bp, Homo sapiens
  misc_feature: GYAE6OF02HAS8I.49.46.E02.1.454.CMB.1.raw
tcagagtcgagagacacgaccggtgctcgatttagactcatctacaggggaaagggggaggaactgctcagttaggacccaggagggaaccatggaagccccagctcagcttctcttcctcctgctactctggctcccagataccaccggagaaattgtgttgacacagtctccggccaccctgtctttgtctccgaggggacagtcgccctaccctctcctgcagggccagtcagagttgttagtagtcttcttagccttaggtaaccaacagtaaaccgtggaccaggcctacccgaggcctcctacatctatgatgctactaccaacgtacgggaccctaacgtcgggacctaacgtaccccgaacggtacccgtaaggtttacccgaagggttcgggaccgtaggggttcggggttaccgttggtacggtaacgaacggtacttaccgacttctaccaacctatacacgacacgacgtagacgccgtaagaagtcttacgtcggtacttaagttttaacttacgtacgttacgacgtaccgacggttaccgttaacggaacgtttaccggtacggttaccccttaccgttaacgttacccgggtttacgggaaccggggaacggggtaacccgtaggggtaggtaaccgtaaacggtaaacccgtaaaaggtaaccgttagggtaccggtaccaaccggttacccgaaccgttacgtacgttacgttaaccc

SEQ ID NO: 74189 - DNA, 797 bp, Homo sapiens
  misc_feature: GYAE6OF02F40OT.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtgccaccctctcctgcagggccagtcagagtgttagtagctttctagccgtggtaaccacagaaacctggcccaggtccctacccgacggtcctccgtactacgttctaagttgaactcggaccgacttacccgaaaccgacggggccctaacgttcgggacctaaccgttaccccgaggtcccgtaacgggtttaccgagggtccggacggtaggttcggggttacctgggtacgtaacggtacgttaccttcgaacctttcctaccgtaccacgttccgacggtacgaccggtacctaacggacgtacccgtaaggtaacgtacgtttccgtaagtacgtttaacggttttaacgttaccttacggtaccgttaacgaccggtaacggtaccgttaacggtaacccgtaacgggttcccggtaaccctttccgtaaccggtttaaccgggttcccgggaacggggttaaccgggtaaccgggtaggggtacggaaacggtaccgtaaaccggttaaaacggtaccgttaacgggtccgggttaccgaccggttaaccgtaacccgttaacggtttccgttaccgtttacccg

SEQ ID NO: 74190 - DNA, 800 bp, Homo sapiens
  misc_feature: GYAE6OF02GC33C.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctccagataccaccggagaaattgtgttgacacagtctccggccaccctgtctttgtcctccgaggggacagtcgccacctctcctgcgagggccagtcagagttgttagagtctttcttagcctaggtaaccaacaacgtaaaccgtcggaccgaggtcctacccgaggtccttcctacattcctatagtatgtccaactaccaacgacggtccacgtcggcactcccgagaccgtaggttacgagtcggcgtaggttgggtacttggtaacgacgtaacgttacctttaccgacctttactaccgaaccctaacgttacgaacgtccgaaaccggtacccgttaacggaccgtaccggttaagtaaacggtttctttaaccgtaggtaaccgttttaaaggttttaacctttaacgttcgggtttaaccaagggtttacccgaaaggttaccgggttaaacgtaaccctaaaccgggtttccggtaaccctttcgtaaccgttttaacccgggttagggggaaccgggtaaaccggggtacccgtaaaggggtaccgtaaacggtaacgttaaacccggaaaaccggtttaacgggtacgggttaacccggtccgtaaccggtaaccccgttaaccgtaacccggtttttacctccgggtttaaccc

SEQ ID NO: 74191 - DNA, 819 bp, Homo sapiens
  misc_feature: GYAE6OF02H10FC.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggcctccagactaccaccggagtaaattgtgttgacacagtctcccggccacctccgtctttgcctacgagggacagtcgcccacccgttctcctgcacgggccagtcaggtagtgttagtatccttcgttagcctggtaacccaagaacgtaacctcggccacggtacctcccgaaggttcctacccgtactaactccttaatggacttcggccactacccgaaacgcgggaccctacggtccggacctaccgtccccgaacgtcccgtaggtttccgaagggttcccgagtaccgggttgggtaccctgggtaccgtaacgtcggtaaccgtttccgtaaccgtttccctaaccctacccggttaacctttaccggaaccggtaccgtaacccggtaccggtttaaccgggaacggtacccgttaaagggtaaaccgtttctttacggtcggttaaccgttttaaacgtttttacgtttaccgttacggtaccgttaacgccgtacggttaacgtaccgtacccgttaacggttccgtaacccttcccgggtttaccttaccgggtttacgggaaccgggttaaccgggaaccgtagggttttacgggaactaaccggaaacgttaaccggtaacgttacgtacggtaccgtccggtaaccacggtttaccgttcgtccgtttaccg

SEQ ID NO: 74192 - DNA, 844 bp, Homo sapiens
  misc_feature: GYAE6OF02GE3OU.49.46.E02.1.454.CMB.1.raw
tcagagtcgagagacacgaccggtgctcgatttagactcatctacaggggaaagggggaggaactgctcagttaggacccagagggaaccatggaagccccagctcagcttctcttcctcctgctactctggctcccagactaccaccggagtaaattcgtgttgacacagtctccggccaccctgtctttgctccgaggggacagtgcccaccgtctacctgcagggtccaaggtccaggagtgttaagtagactttacgttacgccttacgggtaaccaaacgaacggtaaaacccttgggaccctaacgggaccttaccccgaaggtacctcccgtaactaaccttaccttaagtacggtaacttggaacctaacgtaccccgaaaacggtacggggtacccctaacggttcgggaccctaacttcccccggaagtcccgttaacggggtttcaacggggtttcgggacgtacgggttacgggggttacctttaggacggaacggaaggtaaccctttacccgaaaccgtttccgtaaaccgaaaccgtacttaccgaagacctaacggtaccgtaacgacgtacccgtaaggaaacgttaacgttacgttacgtacgtttaagttttaacgttacgttacgtaccgtaacgtaccgtacggtaaccggttaacggtaacctaaccgttaccgtaccttaccgttaccgttaaccggttttaccgggaaccgggttaacggggaaccgttaagggtacgggaaacgtaacgttaaacgtaaaacggtaaccggttaggtaccggtactaacggaccgaacctacgtacttaccggttaacc

SEQ ID NO: 74193 - DNA, 633 bp, Homo sapiens
  misc_feature: GYAE6OF02HXSEX.49.46.E02.1.454.CMB.1.raw
  modified_base (374)..(374): a, c, t, g, unknown or other
  misc_feature (374)..(374): n is a, c, g, or t
  modified_base (439)..(439): a, c, t, g, unknown or other
  misc_feature (439)..(439): n is a, c, g, or t
  modified_base (480)..(480): a, c, t, g, unknown or other
  misc_feature (480)..(480): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtcctccggccaccctgtctttgtctccaggggacacgtgcccaccctctcctgcagggcccagtcagagtgttagtagctcttagcctaggtaccaaacagaaacctggccaggacctccgaggacctccgtcatctatgatgctataccaacgaggcccaacgtggcctactacccgagtcccgaaggtttccaagttcgggaccngggttggggtctggtagactaggactttcacgttactcacctaatcaacgacacgaccgtagacnccgtagtaaacgtacttcgtagactaggttttattaccgtntcctagcgagcgttagctaaacgtcgtcctaacgtctaccgtttcgggaaccgtaggggtaacccgtaagggtaccgggtagtaaccgtaacgtaaaccggaacttcgggtacggtcgttaaccggcctaaccgtacttcgtacgtttacccg

SEQ ID NO: 74194 - DNA, 836 bp, Homo sapiens
  misc_feature: GYAE6OF02F89WE.49.46.E02.1.454.CMB.1.raw
  modified_base (201)..(201): a, c, t, g, unknown or other
  misc_feature (201)..(201): n is a, c, g, or t
  modified_base (721)..(721): a, c, t, g, unknown or other
  misc_feature (721)..(721): n is a, c, g, or t
tcagagtcgagagacacgaccggtgctcgatttagactcatctacagggaaagggggagaactgctcagttaggacccagagggaaccatggaagccccagctcagcttctcttcctcctgctactctggcctccagataccaccggagaaattgtgttgacacagtctccggccaccctgtctttcgtcctcgagggacngtcgaccaccctctcctgcgacgggacctagtccaggtaggttagttagtacgtctttacgttacgccgttacgggaacctaaaccgacggaaacccgtggacccggacggtaccctaccccgacggtaccttaccttaccactttaccgtacgtaggtaactgtaccaccgttacccggaacggtccggggaccctacggtacggtacctaccgttaccccgacggtacccgtacggttaccggtagggttacccggggcgtaggggttccgggggttacctagggttacgaaccgttcggttaactttacccgtaactttccccgtaacccgtaacctaacgtaccgtacggtaccgtcggtacccgtacggtacgtcccgttaagtaacggttaccttagggtccgtttaacgttaaggttttacttaccgttacgacgtaacgaccgtagggtaaccgtacggtaccttaccgggtccgttacgttccttaaacccggtttcggttaacccggggngggttaaacccggggtacggtaaggttacgggtaacggaaacgttaaacccggaaggttacccgtttcgggaacgtcgttaccgaacgtcctccgtttacggttactttacccgg

SEQ ID NO: 74195 - DNA, 725 bp, Homo sapiens
  misc_feature: GYAE6OF02GQ812.49.46.E02.1.454.CMB.1.raw
  modified_base (301)..(301): a, c, t, g, unknown or other
  misc_feature (301)..(301): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccacctgtctttgctccgagggacagtcgcccaccctctcctgcagggccagtcgagagtgttagtagctttgttagccttaggtaccaaacgacgtaaaacccgtggaccgacggtcctaccccgngggtaccttcctacctaacgttctaacttgtactcggactactacccgaacgacggggtcccaacgtcggcctacctcccgacgtcccgtacggttcgacggtaggtccgtagggttcgggttacgtggtacggactcgtacgttcacttccctaccgtaccactccgaagccgaacgtacccgtaggaacgtacccgttaagtaacgttacgttcgtacgttacgttactttttaacgtttaccgttagtacgacgttcgaggttacggtaacgaaccgtacggtccgtaccgttacttccggttaccggttccgggacgggtaccgggtaaccggagggttacgacggtaacgtaaaccggtaacggtaacggttcggtacggtccgttaggacccgtaccgtttcgtccgttaccgtttcc

SEQ ID NO: 74196 - DNA, 798 bp, Homo sapiens
  misc_feature: GYAE6OF02FPRK3.49.46.E02.1.454.CMB.1.raw
  modified_base (308)..(308): a, c, t, g, unknown or other
  misc_feature (308)..(308): n is a, c, g, or t
tcagagtcgagagacacgaccggtgctcgatttagactcatctacagggaaagggggaggaactgctcagttaggacccagagggaaccagtggaagccccagctcagcttctctcctcctgtctactctggctccagataccgacgagaaattgtgttgacagtatctcccggaccacccgtgttcctttgtctccgaggggactagtcgaccctccctcctccgtagcgtacgggctacggtcaggtacgttagttaggactcttacttacgcccgttacggtaacccgaactaaacgtaaacccncggtaccacggccccgtaccgaggtcccttcctacctacttacccgttagtcgtaagtcgtaaccgaccttaaccggaaccgtacccggggacctacgtcggactaaccgcccgtaacgcccgtaggttccgaggtcgtacgtaggttcgggtactggtacgacgtgaaccttcgacctactaccgacctacgtacgtagacgtaccgtaaccggtacgtacgtaccgttaaaggacgtacgtttaccgtacggtacgttttaacctttccgttaacgtccgttaggactaccggttaaccgtacggtaccgtaaccgttacgtacccggtttcgtaacccgttttccgggtaccgttttacgggaccggggtaaaccggtttaccgggacggttacgggaacggttaacccgtaaacggtacccggttaaacgtttggggcgttacgaacccggttacgtaacccggttcttacggttctttaacccgg

SEQ ID NO: 74197 - DNA, 764 bp, Homo sapiens
  misc_feature: GYAE6OF02IZS94.49.46.E02.1.454.CMB.1.raw
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (549)..(549): a, c, t, g, unknown or other
  misc_feature (549)..(549): n is a, c, g, or t
  modified_base (575)..(575): a, c, t, g, unknown or other
  misc_feature (575)..(575): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagatacccaccggagaaattgtgttgacacagtcctccggccaccctgtctttgtcctccgaggggacagtcgcccacctctcctgcgngggccagtcagagttgtagagtcttgtacnccgtaggtaacccaagacgtaaacctcgggaccacgggtcctcccggaacggtcctacccttactattccgttaatagtatacgcctaccttaaccgaaaccggtaaccgggaccctaaccggtcgggaccctaacccgttacccgacgtacccggtaaggttcccaagggttcggacgtaggggttcggtacgtcgtagaacgtaacggtccttacctaaccgtccctaaccgacgtaacctcgagaccgtaccgacgtaacgaccggtacctaaggtacgtacttaccggtnttaaccgtttaaagtttagtttacgngttaaccgacggtactaaccgggtctaaacgtccggtaaacgttccggtcccttaacgttacccgtacggtttacccggggaacggttaaacggggtacccggtaagggttacggaaacggtaaccgtaaggaaacccggttgggtcgacgttcgacgaccgttaacgtcgttaccgttacgttacccg

SEQ ID NO: 74198 - DNA, 772 bp, Homo sapiens
  misc_feature: GYAE6OF02FN3PE.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctgctccagataccaccggagaaattgtggttgacacagtctccggccaccctgtcttgtctccaggggacagtcgccaccctccctgcagggccagtcagagtgttagtagtcttcttacgccttagggtaccctaacgaacgtaaaccgtcggaccgaggcctccaggcctcctcgatctatcgatcgcataccgaacgacgggcctacgtcggcacgtcccgacgtaccgtacggttacgacggtaggaccgtaggttacgggttacttcggtacggaacgtaacgggttaccttttacgaacctttcccgtaccctaaaccgtactaacccggtacgtaccgtaacccggtaacccgtaaacgggtacggtaccccggtttaaaggaaacgttaccgttttaccggttaaccgggttacgtttttaacgttttaaacgttttaaccgttacgtttaccgacgtaaccggtacggtacggttaccgtacgtaaccgttccggtaccttcgttccgttacgtttccggggacgggtacgggtaaccgtagggtacggacgtaacgtaacgtaaaccggtacgttacgggtacggtaccgttacggaccgttaccggtaatttcccgttacgttaccgttaccg

SEQ ID NO: 74199 - DNA, 670 bp, Homo sapiens
  misc_feature: GYAE6OF02H5LD4.49.46.E02.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
  modified_base (535)..(535): a, c, t, g, unknown or other
  misc_feature (535)..(535): n is a, c, g, or t
tcagagtcgagagacacgaccggtgctcgatttagactcatctacagggaaagggggaggaactgctcagttaggacccagagggaaccatggaacgccccagctcagcttctcttctcctgctactctggtcctacccgagactacccaccggaagaaatttggtgttagacacgagtcgtccggaccaccttgtcttgtcctcgaggggacngtgcccacctntacctggccgacgggccaagtcgaggtagtgttaggagtctttactacggccgttaggtaacccaagaacgaaccgtcggacctacggacctcccgagtcctcctnacgttnttagngatacncactcccgaaagccggtccacgtggacccacgtccgacggtactacgggtacctggtacggcggtggttcgggtttaccaggtacgaattacggtaaccttctaacgtccaacgtacgactttcgacgacgtacgtacgtagaccgttcaacggtaacgtacttcacgttagttacttaacgtttancggtactagccgtaagcgtaacgtacgcgtgtacccgttcttaacgtccggttcggaaccggggacgcgtagggtacgagaacttacgaacgtacgttcgggagttcgagtaccgtactacgttcgtacgttccg

SEQ ID NO: 74200 - DNA, 1040 bp, Homo sapiens
  misc_feature: GYAE6OF02I9A7R.49.46.E02.1.454.CMB.1.raw
  modified_base (1029)..(1029): a, c, t, g, unknown or other
  misc_feature (1029)..(1029): n is a, c, g, or t
tcagagtcgagagacacgaccggtgctcgatttagactcatctacagggaaagggggaggaactgctcagttaggacccagagggaaccatggaagccccagctcagcttctcttctcctgctactctggctcccagataccaccggagaaattcgtgttgacacagtcctccggccaccctgtctttggtctccgaggggacaggtcgccacccctctcctgcgagggcccagtcagacgttagttacggtacgctttccgttaggaccgttagggtaacccaaacgtaaccggtaaaacccttggaacccgtacggtacccttacccgaaacgggcccttacccctactaacttccttaaagttcgacttacgactaaccttacccgaaaccggacggggacccctaccgttaacgggacccttaaccgttcccccgaaccgggtaccccggttaacggggttttaccgaaacggggttttaggggacccggttaaacgggggtttccgggggtttcgttaccggtttaccgggaacgttaaaccgttcccggttttacgtaaccccttacccggtttacccaaacccgttaacgttccggaaccgtaccccgttaaacccgggtaccccgggttaaacgggtaccgggtttaaccccggttaaaggggtaaaacctttaccggggttttccttacggggtaaacccccttttttaaggtttttttaaaacgtttaaccccgttttaggggtaacccttaaaacgggggttccccgttaaacggggtacccgttttaaaacgggtaaacccccgtaaaccggggttttacccgggttcccttaacccgggtttacccgttttaaccggggtttaccccgggggttaacgggggaaccggtttaaccggggtaaccggggttaggggttaaaaccgtaaccgtaaaacccggggtaaaccgttaacccggttggggtttaacccgaccggtttacgaaccccgtttaacgccgttttaacccggtttnttaaaccccgg

SEQ ID NO: 74201 - DNA, 763 bp, Homo sapiens
  misc_feature: GYAE6OF02FQABH.49.46.E02.1.454.CMB.1.raw
  modified_base (249)..(249): a, c, t, g, unknown or other
  misc_feature (249)..(249): n is a, c, g, or t
  modified_base (356)..(356): a, c, t, g, unknown or other
  misc_feature (356)..(356): n is a, c, g, or t
  modified_base (480)..(480): a, c, t, g, unknown or other
  misc_feature (480)..(480): n is a, c, g, or t
  modified_base (718)..(718): a, c, t, g, unknown or other
  misc_feature (718)..(718): n is a, c, g, or t
tcagagtcgagagacacgaccggtgctcgatttagactcatctacagggaaagggggaggaactgctcagttaggacccagagggaaccatggaagccccagctcagcttctcttcctcctgcttactctggcctcccagactaccaccggagtaattgtgttgacacagtcgtccggcctacccgtgtctttgtcctccgaggggacaggtcgccctaccctctcctggcgtacgggcctaggtcagngttaggtttacgacgttctttacgtacgccgttaacgggtaacccaaaggtaaacgaacccgttcggacccggtaacggttcccgaccccgtaagggtccttccccnctacgttaccttaagttgacgttcgacctaccgtaccgaaacggtcgggtacccacggttcgacctacccgtaacccggtacgtaccgtagttccggagggtcggtaacgtggggttccgggtntagggtacgtaacgtacggttaccacgttaacctctaccgtacctaatacccgcaccgttcgtaacggtacgtagccggttagacttacggtctacggtgtttaactttcgtaacttccgacacggtacacggtcgtacggtacgtaccgtccgtaccgtttccgtaccgttacgtaccgggtacgggaaccgggtagtaccggtagacggtaacgtaaccggaactaacggttccgnggtaacccggtccgtacttaccggtcgtttccgtacggttacccg

SEQ ID NO: 74202 - DNA, 616 bp, Homo sapiens
  misc_feature: GYAE6OF02GDHCN.49.46.E02.1.454.CMB.1.raw
  modified_base (246)..(246): a, c, t, g, unknown or other
  misc_feature (246)..(246): n is a, c, g, or t
  modified_base (609)..(609): a, c, t, g, unknown or other
  misc_feature (609)..(609): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgctccaggggacagtgcccaccctctcctgcacgggccagtcagagtgttagtagcttnttagcctaggtaccaacagaaacctggaccaggcctcccgaggctcctcatctatgatgcactaccaacgacgggccacgtcggacactcccagcctaggttcaggttcggacgtaggttcggggtctggtcgacgacgtacttcaactctaccgaactactcacgtcaacgtccgtagacgcctagaacgtacttcgtgtacttaagttttactattcgtcagctacgtacgtgacctaacgtcggtaccttcgtacgttaccggtttccgggaagggaccggtaaccgtaggggtacggaacgtaacgtaaccgaaacgggtaactcgggttacgcgtacgacctaaccgtacgttcgttnttacccg

SEQ ID NO: 74203 - DNA, 754 bp, Homo sapiens
  misc_feature: GYAE6OF02JOWX8.49.46.E02.1.454.CMB.1.raw
tcagagtcgagagacacgaccggtgctcgatttagactcatctacagggaaagggggaggaactgctcagttaggacccagagggaaccatggaacgcccagttcagcttctcttcctctgctactctgctccagactaccaccggagaaattgtgttcgacacagtcctccggccaccctgtctttgtcctcgaggggtacaggtcgccctaccctctccgtgcgacggcccagtcagtgttgttagtacgtcttactagtcctacggtaaccaacgtaacgtaaaccgtcggaccgacggtacctaccccgaggtcccctacccgttactacgttaccttaatacggtcgtaccgtacctaaccgtaacccgaaaaccggtaccggtcccgtaacgttccgggacctaacccgtccccgaacggtacccgttacgggttccgtaacgggtcgtcgttacgggtcgggttcgtacgttagaaccttacgtaccgtttccaacgttcctaccctaaccgctaccgtaacggcgtaccgtaacgtacggtacgtccgtaagtaacgttcttcgtagttacgttagtttacgttcgttatacgtacgacgttacggtacacgttacaccgttcgtcctacgtcgttaccggtggtaccggtacgacgtaggtacgagtaaccgtaacgaaccggttacgtacgtaccggtccgtaaccgttcggaacctttcggtacgtttccgacctttaacccg

SEQ ID NO: 74204 - DNA, 703 bp, Homo sapiens
  misc_feature: GYAE6OF02FH3QP.49.46.E02.1.454.CMB.1.raw
  modified_base (215)..(215): a, c, t, g, unknown or other
  misc_feature (215)..(215): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggcctcccagataccaccggagaaattgtgttgacacagtctccggccaccctgtctttgtctccgaggggacagtgcccaccctntcctgcagggccagtcagagtgttagtagtcttctacgcctacggtaaccaacaagtaaaccctgggacccaggcctccgaggtcctccgtcatcctatagattgccaactacccaacgtacgggtacccacgtggaccacgtccccgaagccctaaggggttcaggtcggactagggttcgggtctggtaccgacgtagtaccttccactacctaccacctatcacgctacggctacgagtcctaagaacgtgttaacctggtaacctttaacgttttaacgtaccgttgacttaacgcgaaccgttggttaccaacgttaacccggttccggcccttacctttaaccctccgggtttaccggggtaacgggtacccgggtaaaccggtaggggtcggtaaaacggtaccttaaacccggaaaacggttaccgtaggggtccgtaccgtacggtaccccgaaccgtacggttcctttcggttaaccg

SEQ ID NO: 74205 - DNA, 787 bp, Homo sapiens
  misc_feature: GYAE6OF02GBK4M.49.46.E02.1.454.CMB.1.raw
  modified_base (219)..(219): a, c, t, g, unknown or other
  misc_feature (219)..(219): n is a, c, g, or t
  modified_base (313)..(313): a, c, t, g, unknown or other
  misc_feature (313)..(313): n is a, c, g, or t
tcagagtcgagagacacgaccggtgctcgatttagactcatctacagggaaagggggaggaactgctcagttaggacccagagggaaccatgggaagccccagctcagcttctcttcctcctgctactctgctccagataccaccggagaaattgtagttgacacagtcctccggcctaccctgttctttgctcgaggggactagtcgccacctctccngacgacgggccagtcagtagtgttagtagtctttacgtagtccttacggtaccaacgtagtaaccgtggaccaaggctacccgagtcctcctanatctatagctagcactaccgaacgtacggccagcgacctacctacccgagacccgttaggtcaggtcggtacgtaggtcgggtcgtagtacggaactacgttaccgttacctaccttacccgtacctaaccgtactactaaccggacccgtaacgtacccgttaaggacccttaacccggtaggttaaaacgtttcccgttagttacccgttaaccggttttaaagttttacccgttaaacgggtaccgttaaccgaaacccgttaacgaccccgttaaacccggttaagtaacccggttaaccgttttacccgtttccccgggttaaacccggttccggaaaccggttacccgttaaggggtaaccgtaaggttaccctaacggttaaaccgtaaaccggtggtaaccggtccggtaacctaccgacccgttaacttacgtttaccgttacccgtttactttaccgtcccccg

SEQ ID NO: 74206 - DNA, 202 bp, Homo sapiens
  misc_feature: GYAE6OF02IQG6I.49.46.E02.1.454.CMB.1.raw
  modified_base (166)..(166): a, c, t, g, unknown or other
  misc_feature (166)..(166): n is a, c, g, or t
  modified_base (169)..(202): a, c, t, g, unknown or other
  misc_feature (169)..(202): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccggagaaattgtcgttgacncannnnnnnnnnnnnnnnnnnnnnnnnnnnnnnnnn

SEQ ID NO: 74207 - DNA, 832 bp, Homo sapiens
  misc_feature: GYAE6OF02H6AH6.49.46.E02.1.454.CMB.1.raw
  modified_base (238)..(238): a, c, t, g, unknown or other
  misc_feature (238)..(238): n is a, c, g, or t
  modified_base (268)..(268): a, c, t, g, unknown or other
  misc_feature (268)..(268): n is a, c, g, or t
tcagagtcgagagacacgaccggtgctcgatttagactcatctacagggaaagggggaggaactgctcagttaggacccagagggaaccatggaagcccagctcagctctcttctcctgctactctggcctccagtactaccaccggaataattgtcgttgacacagtcctcggcctacctgtctttgtcctacgagggactagtcgccctaccctctctgcgacgggtaccagttanaggtacgttgtagtacgtctttcgttaacnccgtaggtaaaccctaacgaagaaaccgtcggacctacggaccttccgaacggttccttcctactaacgtattaacgtgtacgtgtacctactaaaccgaaccggaacggccccgtaacgttaccggaaccgtaaccctcccggaaccggtaccgtaacggtttcggaaaccggttcggaacggtcgggttaccgggttagttagacgtaaaccggacgtacctttacctaccgttaccctaacaccgttacgacgtaccgtaacgaaccgtacgtaacgaccggaccgttacgggtaacttacggttaccctagtaaccggtttaatttaacccggttttacgttacgacccgggttaagtaccggtttaacggtacgaaaccgttacccggttaacgtaaccgttcccgttaaccgttacccggtaccgtttacggggttaaacgggaaccgggtaacgaaccggggttagtaacccggaagtaaacccgtaacggtaaacccgttcggtaacgggttccgaacggtaaaccgtacccttaggttacccttagtttaccccg

SEQ ID NO: 74208 - DNA, 705 bp, Homo sapiens
  misc_feature: GYAE6OF02GTH5S.49.46.E02.1.454.CMB.1.raw
  modified_base (216)..(216): a, c, t, g, unknown or other
  misc_feature (216)..(216): n is a, c, g, or t
tcagagtcgagagacacgaccggtgctcgatttagactcatctacagggaaagggggaggaactgctcagttaggacccagagggaaccatggaagccccagctcagcttctcttcctcctgctactctggctccagataccgaccggagaaattgtgttgacacagtctccggccaccctgtctttgctccgaggggtacagtcgccacctctcngcaggccagtcagagtgttagtacgtacttactagccgtaggtaaccaacacgaaacctggaccaaggcccttaccgaacggtcctacctactagtactaagttcggaatacgacctaatacccgaaacgtacgggacccagtcgacctactaccccagaccgtaggttaccaggtacggtacgtagggtacggggtctacgggttaacgaacgtaccgttaactacctaccgttacctaaccgaaaccctagtaccgtaaacgaccaacggtcctaaaggacgtaccgtagaaacgtcttacgtacggtactttaaggttaacttaccttagtacgaaacgtcgtaacggtcgtaacgaccgtaaccgtcgaaccttacccgtacgttaccggttagggaccggtaaacgggtacggtacgaggtaacgtaactaaaccgaacggttaacgtacgcggtacacggactacccgaagttcgtattcccg

SEQ ID NO: 74209 - DNA, 786 bp, Homo sapiens
  misc_feature: GYAE6OF02HSQA3.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagactaccgaccgggaagtaaattgtgttgacacagtcctcccggcctacctgttctttgtctccgaggggacagtcgccctaccctcctcctcgcgacgggccagtacaggtaggttggttagtacggtcctttacgttacgtcccgttacggtaaccaaaccgaacgtaaacccgtcgggacccgacggtcccctacccgacggtccctcctacgtacttccttagtacgtagtacgtcgaaccttaaccccgaaacggtaccgggaccctacggtaccggactccgtaccccgaggtacccggttacggtcgtacggtcggacggtaggtcgggtactggtcgaaacgtcgtaccttcgaacccttcccgaaccacctacgtacgtacgaccgaccgtacgtacggtacgtaccgtaggtaacgttacttacgtacgttacgtttaacgttttacgttacgttacgtacgacgtcgtacggtacgtaacggtaccgtaaccgtccgttaccttaccgtccgtttaccgggtcgggaaacgggacggggtaaccgtacgggtaggtaacgtaaccggtaaccgtaaaccggtcgttacgggtaccgtacggtaccgtaaccgtaccgtacgttaccgttaccttaccg

SEQ ID NO: 74210 - DNA, 720 bp, Homo sapiens
  misc_feature: GYAE6OF02JPNG2.49.46.E02.1.454.CMB.1.raw
  modified_base (203)..(203): a, c, t, g, unknown or other
  misc_feature (203)..(203): n is a, c, g, or t
  modified_base (402)..(402): a, c, t, g, unknown or other
  misc_feature (402)..(402): n is a, c, g, or t
  modified_base (483)..(483): a, c, t, g, unknown or other
  misc_feature (483)..(483): n is a, c, g, or t
  modified_base (612)..(612): a, c, t, g, unknown or other
  misc_feature (612)..(612): n is a, c, g, or t
  modified_base (698)..(698): a, c, t, g, unknown or other
  misc_feature (698)..(698): n is a, c, g, or t
  modified_base (702)..(702): a, c, t, g, unknown or other
  misc_feature (702)..(702): n is a, c, g, or t
tcagagtcgagagacacgaccggtgctcgatttagactcatctacagggaaagggggaggaactgctcagttaggaccagagggaaccatggagccccagctcagcttctcttcctcctgctactctggcctccagactaccaccggaagtaattgtgttagacacagtcctccggccaccctgtcttgtctaccgagggacngtagccctaccctctcctgcgtacgggccagtacacgtagttgttacggtacgtccgttacgttaccggtaccgttggtaacccaaaacgtaacgaaaacccggtcggtaccctacgggtaccctaccaccggggtccttaccccttactacgttctagtcggtagtcgacctacgtacccgtaaacgccgggtacccncggtaccggttacacccgttacccgaccggtaccgtacggttaccggcgtaccggtacggtaacggttcgggaacttcggnggtaaaccgtggtaacccttaccgtaacccgtcctaccgtaacccagaccgtacgaaccctgtaccggtaactcggaacccgttagaacgttcttacgacgtacgttaagtttaccgattcggtaaccngtacgacgtacgactacgtgtccctactcgttaccgtacggtacgcgtaacgtagtacggagtacgtacgtaccgatacgtcgtcncgtnaccgtagtcttacgtgtc

SEQ ID NO: 74211 - DNA, 971 bp, Homo sapiens
  misc_feature: GYAE6OF02HA2YZ.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggcctccagtactaccgaccggaagtaaattggtgttacgaccacgtacgtcctcccggacctacccttcggttccgtttggtcctcccgggtaagggggtacctaggttccgacccctaccccgtttccgtaccccgttggacccggacgggggtcccctaagggttccgaacgggtacgggtttagtttaacgggtacggttccttttcggttaaccgtcccggttagggtaaaccccaacggtaacggtaaacccgtcgggcccgtaacggtccccgtacccggaggtcccttaccccgtactacgttaccgtaacgttaggaccgttacaccgttaacccgtaacccggaacgggtccgggtacccctaacggttaccgggacccttaacccggtccccgtaaacgggttccggttaaacggtccggttagggaccggttacggttacgggttccgggttaccggtaacggtaagttaaaccccgttaccggttaacctttccctaacgttaccccgtaccgtaacccgtaacgtcggaacccgtaccgtaacccggtacgtacgggtaaccgtaacggttaggtaaacccttcgttaccgttaagggttactttaacggtttacgttacgtacgtcgtaaccgggtacgtacggtaccgtaacgggtaccgtttacccggtacgtttaccctacggttaaccgggttaccgggtaccggtaacgggtacgggtaacccgggtagggtaaccgtaaccggtaacggtaaccggttaacggtcggtaccgtaccgggtacccttcggaacctcccggttagttccccgtttacggtccc

SEQ ID NO: 74212 - DNA, 674 bp, Homo sapiens
  misc_feature: GYAE6OF02FNAXT.49.46.E02.1.454.CMB.1.raw
  modified_base (214)..(214): a, c, t, g, unknown or other
  misc_feature (214)..(214): n is a, c, g, or t
  modified_base (265)..(265): a, c, t, g, unknown or other
  misc_feature (265)..(265): n is a, c, g, or t
  modified_base (307)..(307): a, c, t, g, unknown or other
  misc_feature (307)..(307): n is a, c, g, or t
  modified_base (454)..(454): a, c, t, g, unknown or other
  misc_feature (454)..(454): n is a, c, g, or t
  modified_base (647)..(647): a, c, t, g, unknown or other
  misc_feature (647)..(647): n is a, c, g, or t
  modified_base (661)..(661): a, c, t, g, unknown or other
  misc_feature (661)..(661): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccaccgagaaattgtgttgacacagtctccggccaccctgtctttgtctccaggggacagtgcccaccctcncctgcagggccagtcagagttgttagtagcttattagcctaggtacccaanagaaacctggaccacggctcccgaggtcctacctctatctangtatagccaactaccgaacgtacgggcccagtcggacgaacctcccgacgaccgtaggtttaccgagtcggccgtacggtaggggttcctaggtccggaaagtaccgtacttacctaaccgtccttaaccacccgtaattcccgaanaccgacgtccttaacggacgtaacccgacggtaagttaactcgtaacggtacttaacggtttttacctaacggttacgacctaacgaccgtaacgtacggttacgacgtaaaccgtcgaccttccttacgttacggttcggacgggtaaggaccgttagggtacgaacgactaaccgaaacgtgtacgaggtntacgacctaacgtntacctggttaacc

SEQ ID NO: 74213 - DNA, 732 bp, Homo sapiens
  misc_feature: GYAE6OF02GRMW9.49.46.E02.1.454.CMB.1.raw
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (561)..(561): a, c, t, g, unknown or other
  misc_feature (561)..(561): n is a, c, g, or t
tcagagtcgagagacacgaccggtgctcgatttagactcatctacaggggaaagggggaggaactgctcagttaggacccagagggaaccagtggaacgcccagctcagcttctcttcctctgcttacgtcgtcggcctacccagactaccgaccggaagtaattgtgttgacacaggtcctccgcctacccgtntcttgcctaccgagggacngtcgccctacctgtccnggacgacgggacctagaccgagtacgttggtagtcggtcctttagttacgccgttacggaaccaacgtaacggtaacctgggacccacggtaccttacccggaacggtcctcccgttactacgttattacggacgtatcgactacctaccgaacggacggctacgcgactaccgaccgtcgacgttaggttaccgagtaccggcgtacgggttcggtttaccgagggttacgaaccggtacgttaccgtactacccgtaccgttataacccgatttacggaccgtacgtacggtacgtaacgtaccggtcgtacggttaaactcgtttanacgttacgtttacgttaagtttacgtacgtcgtaacgtacgtacggtagtaccggacttacggcctccttacgcgttaccgtacgggcggtacgaccgtagacggtaagtaaccggaaccttaacggaacgttcggaccgacggttcgaaccgtgcgttactcggttaacg

SEQ ID NO: 74214 - DNA, 646 bp, Homo sapiens
  misc_feature: GYAE6OF02F8YPF.49.46.E02.1.454.CMB.1.raw
tcagagtcgagagacacgaccggtgctcgatttagactcatctacagggaaagggggaggaactgctcagttaggacccagagggaaccatggaagccccagctcagcttctcttcctcctgctactctggctcccagataccaccggagaaattgtgttgacacagtctccggccaccctgtctttgtctccgaggggacagtcgccaccctctcctgcagggccagtcagagtagttagtagtcttcttagcctaggtaaccaacaacgaaacctggcctaggcctacccgaggcctcctcatctatgatgcactccaacgcggacccacgtggctactcccagtcccgtaggttccaggtcggcgtaggtcgggttcgtggttcgaacgtacgtacttaccaacctctaccacctatcacgcacgaccgtaagaccgtccgtaagaacgtcttcgtacgtacgtttaagtttaacttcgttcgtacaggtaccacggtcgtaacgaccgtaaccggtcgttaccctccttaccgttaccggtttccgggacgggaacgggtaaccgtaggggtaggaacgtcgtaaaccgaacggtacgtggtacggaccgtacggaccctacgttactcccgttagttaccc

SEQ ID NO: 74215 - DNA, 1043 bp, Homo sapiens
  misc_feature: GYAE6OF02GJ7BF.49.46.E02.1.454.CMB.1.raw
tcagagtcgagagacacgaccggtgctcgatttagactcatctacagggaaagggggagaactgctcagttaggacccagagggaaccatggaagccccagctcagcttctcgttcctcctgctactctggcctcccagactacccgaccggaagtaaattgtagttgacacgtacgttccgtacccggcctaccccttgttcctttcgtccttcccgaaggggtaccacggtcgcccgtacccctctcccgtgccgacggggccctaggtacctaaggtacggttagtttaacggtacggtaccttttacgttaacggtcccgttacgggttaaaccctaaaacgtaacggtaaaaccccttcgggaaccccgtaacgggtccccttaacccccggaacggggttccccttacccccttaaccgtactttacccgtttaaaacgttccggtaaacgttccggtaaccgttaaccccgttaaccccgaaaaccgggttacccgggggacccctttaaccgggtaccggtaacccggttacccgtacccccgtaacgggtaccccggttttaacggggtttccgaaacggggttccgggtaacccgttaggggggtttcggggttttacctacgggttacggttaaacccgtaacggtttacccttaccggttacccttacctacccgtaaacctcgtaccgtaaccgtccgtaaccgtacccgtaaggtaacccgtccgttaaagtaaccttcggttaccgtacgttaacctttaaggttttaccgttacgttaccgtacgtaacgtacctacgggttaccgttaacggaccgttaaccggttccgtaacccgttaccgtttaacccgggttaccggtttaccggggaacccgggttaaccggacgggtttaaacgggaccggtacgtttaaacccgaaacggttaaaccccggttaacggtttaccggggttaacgtaccccgttaacggttacccccggtaaacgtttacccggtttccgttttaaccccggtttaacccg

SEQ ID NO: 74216 - DNA, 728 bp, Homo sapiens
  misc_feature: GYAE6OF02HQ8U0.49.46.E02.1.454.CMB.1.raw
  modified_base (156)..(156): a, c, t, g, unknown or other
  misc_feature (156)..(156): n is a, c, g, or t
  modified_base (362)..(362): a, c, t, g, unknown or other
  misc_feature (362)..(362): n is a, c, g, or t
  modified_base (439)..(439): a, c, t, g, unknown or other
  misc_feature (439)..(439): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (598)..(598): a, c, t, g, unknown or other
  misc_feature (598)..(598): n is a, c, g, or t
tcagagtcgagagacacgaccggtgctcgatttagactcatctacagggaaaggggaggaactgctcagttaggacccagacgggaaccatcggaacgccccagctcagtcttctcttcctctgctactcgtggcctccagactaccgaccggaanaaattgtcgttagacaacgtgtccgtcccggaccctacccgttgttaccgtttgtcccgttaccgaacgggggacctaggtccgacccctaccttcctccgtggtaccgaggccctagtcacggtacgttagttagtcgttccttacgtttacgcccgttacggtaccaaaccgtaaccgtaaccggtacggtccggaacggtccncccggtacggtcccgtcctacgtacctgtatacgacttcggctacaccgtaacggacggtcctacggtcgacctccncccggtaacgcgttacgggttnaccgggttnagtcgggtcgtcgtaggtacgcgtagtacctacgacctccggtcaaactcgtccacgtccaacgtaccgtagtaccgaccgttagtacgtacgttccgtagtacgttagttaccttagtcgtactacncggacttacggaccgttcgacttccggtcgttaccttccggtacgtcggtacgacggtagtcggtacggaactacgtaaccgtaacgtcgacggtcgtaccggcacgtcccgttactcggttaccgtacc

SEQ ID NO: 74217 - DNA, 738 bp, Homo sapiens
  misc_feature: GYAE6OF02G646W.49.46.E02.1.454.CMB.1.raw
  modified_base (199)..(199): a, c, t, g, unknown or other
  misc_feature (199)..(199): n is a, c, g, or t
tcagagtcgagagacacgaccggtgctcgatttagactcatctacaggggaaagggggaggaactgctcagttaggacccagagggaaccatggaagccccagctcagcttctcttcctcctgctactctggctcccagataccacggataattgtgtgacacagtctccggccacctgtctttgctccggaagggacncgtcgccctacctctcctgccgagggccaggtctaggagtgttagtacgtcttcgtacgacctacggaacctaacgaaccgaaaccgttcggaccgaaggtccctacccgaggtccttcctacgtatcctagtacgatcgacacttaccgaaacggccgggtccacggtcgactacctacccggacggtccgtagggttcgagggttacggacgtagggtcgtctggtaccgataccgtctacctaccgtctaaccacggtactcgacgacctacggtaccgtaagtccgtacgtaacgttaacgtacgtttaccgtaggtaccttttaagtttaacgttcttacggtaacgtctaaccggtaacgtaccgggtaataacccgttccggtccttaccggttacgttaccgggttaccgggttaaccggacgggttaaacggacccgttaaggggcgtaaacgtaacggtaaacccggtaagggtacctttcggtagacccgttacacccgtttaacgttccttacggttcccttaaccg

SEQ ID NO: 74218 - DNA, 174 bp, Homo sapiens
  misc_feature: GYAE6OF01C8OES.37.22.B11.1.454.CMB.1.raw
  modified_base (171)..(174): a, c, t, g, unknown or other
  misc_feature (171)..(174): n is a, c, g, or t
tcagtagtgtagatcacgaccggtgctcgatttagacgacagctcagggcccagtcggtcttcccctggcgccctgctccaggagcacctccgagagcacagcggccctgggctgcctggtcaaggactacttccatctacactactgagcgggctggcaaggcgcatagnnnn

SEQ ID NO: 74219 - DNA, 178 bp, Homo sapiens
  misc_feature: GYAE6OF01BSCM5.37.22.B11.1.454.CMB.1.raw
  modified_base (171)..(178): a, c, t, g, unknown or other
  misc_feature (171)..(178): n is a, c, g, or t
tcagtagtgtagatcacgaccggtgctcgatttagacgacagctcagggcccatcggtcttcccctggcgccctgctccaggagcacctccgagagcacagcggccctgggctgcctggtcaaggactacttccatcctacactactgagcgggctggcaaggcgcatagnnnnnnnn

SEQ ID NO: 74220 - DNA, 199 bp, Homo sapiens
  misc_feature: GYAE6OF01ALKGG.37.22.B11.1.454.CMB.1.raw
  modified_base (172)..(199): a, c, t, g, unknown or other
  misc_feature (172)..(199): n is a, c, g, or t
tcagtagtgtagatcacgaccggtgctcgatttagacgacagctcagggcccatcgggtcttcccctggcgccctgctccaggagcacctccgagacgcacagcggccctgggctgcctggtcaaggactacttccatctacactactgagcgggctggcaaggcgcatagnnnnnnnnnnnnnnnnnnnnnnnnnnnn

SEQ ID NO: 74221 - DNA, 170 bp, Homo sapiens
  misc_feature: GYAE6OF01DSHVT.37.22.B11.1.454.CMB.1.raw
  modified_base (170)..(170): a, c, t, g, unknown or other
  misc_feature (170)..(170): n is a, c, g, or t
tcagtagtgtagatcacgaccggtgctcgatttagacgacagctcagggcccatcggtcttcccctggcgccctgctccaggagcacctccgagagcacagcggccctgggctgcctggtcaaggactacttccatctacactactgagcgggctggcaaggcgcatagn

SEQ ID NO: 74222 - DNA, 224 bp, Homo sapiens
  misc_feature: GYAE6OF01ADYAJ.37.22.B11.1.454.CMB.1.raw
  modified_base (172)..(172): a, c, t, g, unknown or other
  misc_feature (172)..(172): n is a, c, g, or t
  modified_base (178)..(224): a, c, t, g, unknown or other
  misc_feature (178)..(224): n is a, c, g, or t
tcagtagtgtagatcacgaccggtgctcgatttagacgacagctcagggcccagtcggtcttcccctggcgccctgctccaggagcacctccgagaggccacagccggcccttgggcctgccctggtcaaggctacttccagtctacgactactgagcgggctggcaaggcncatagnnnnnnnnnnnnnnnnnnnnnnnnnnnnnnnnnnnnnnnnnnnnnnn

SEQ ID NO: 74223 - DNA, 174 bp, Homo sapiens
  misc_feature: GYAE6OF01CUNDV.37.22.B11.1.454.CMB.1.raw
  modified_base (170)..(174): a, c, t, g, unknown or other
  misc_feature (170)..(174): n is a, c, g, or t
tcagtagtgtagatcacgaccggtgctcgatttagacgacagctcagggcccatcggtcttcccctggcgccctgctccaggagcacctccgagagcacagcggccctgggctgcctggtcaaggactacttccatctacactactgagcgggctggcaaggcgcatagnnnnn

SEQ ID NO: 74224 - DNA, 171 bp, Homo sapiens
  misc_feature: GYAE6OF01BV01J.37.22.B11.1.454.CMB.1.raw
  modified_base (170)..(171): a, c, t, g, unknown or other
  misc_feature (170)..(171): n is a, c, g, or t
tcagtagtgtagatcacgaccggtgctcgatttagacgacagctcagggcccatcggtcttcccctggcgccctgctccaggagcacctccgagagcacagcggccctgggctgcctggtcaaggactacttccatctacactactgagcgggctggcaaggcgcatagnn

SEQ ID NO: 74225 - DNA, 542 bp, Homo sapiens
  misc_feature: GYAE6OF01B8MDZ.37.22.B11.1.454.CMB.1.raw
  modified_base (541)..(542): a, c, t, g, unknown or other
  misc_feature (541)..(542): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctacgtccgtggcgttttgactacgtgggccagggagccctggtcaccggtctcctcacgcctccaccaagggcccatcggtcttccccctggccgcccctgcctccaggcgccacctcccgagacgccacgacgcggcccctggggcctcggcccttgggtccaagggaccctacttcccgatccgtaacacctacgtgacggcgggctggacaagggcacatagnn

SEQ ID NO: 74226 - DNA, 557 bp, Homo sapiens
  misc_feature: GYAE6OF01D3I4E.37.22.B11.1.454.CMB.1.raw
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtatattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctacgtcctggcgttttgactacgtgggccaggggagccctggtcaccgtctcctcacgcctccaccaagggcccagtccggtccttcccccgtggcccgcccctgcctccgaggacgcacccgtcccgagacgcacacggccggcccgtgggcctcggccctgggtaccaagggtacctaccgttcccattcctaacacctacgtgacggccgggcctgggccaagggcccganactagcng

SEQ ID NO: 74227 - DNA, 202 bp, Homo sapiens
  misc_feature: GYAE6OF01CV9U1.37.22.B11.1.454.CMB.1.raw
  modified_base (175)..(202): a, c, t, g, unknown or other
  misc_feature (175)..(202): n is a, c, g, or t
tcagtagtgtagatcacgaccggtgctcgatttagacgacagctcagggtcccgatcggtcttcccctggcgccctgctccaggagcacctccggacgagcacagcggcccgtgggctgactggtcaaggactacttccatctacactactgagcgggctggcaaggcgcatagnnnnnnnnnnnnnnnnnnnnnnnnnnnn

SEQ ID NO: 74228 - DNA, 497 bp, Homo sapiens
  misc_feature: GYAE6OF01CM9U2.37.22.B11.1.454.CMB.1.raw
  modified_base (410)..(410): a, c, t, g, unknown or other
  misc_feature (410)..(410): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccagggccacgtggtatccccagccacctttagtggcagtgggtctgggacagagttcactctcaccatcagcagcctgcagtctgaagtattttgctagtttattactgtacaanagtacaatgactggcctctctactttcggcggagggaccgaggtgagtatacgaaacgaactggtggctgcaccatctgtcttctac

SEQ ID NO: 74229 - DNA, 220 bp, Homo sapiens
  misc_feature: GYAE6OF01BOH1H.37.22.B11.1.454.CMB.1.raw
  modified_base (180)..(220): a, c, t, g, unknown or other
  misc_feature (180)..(220): n is a, c, g, or t
tcagtagtgtagatcacgaccggtgctcgatttagacgacagctcgtaggggcccatcggtcttcccctggcgccctgctccaggaagcacctccgagagcacagcggcccctgggctgcctggtcaaggactacttccattcgtacgctactgaggcgggctggcaacggcgcagtagnnnnnnnnnnnnnnnnnnnnnnnnnnnnnnnnnnnnnnnnn

SEQ ID NO: 74230 - DNA, 515 bp, Homo sapiens
  misc_feature: GYAE6OF01COFFZ.37.22.B11.1.454.CMB.1.raw
  modified_base (329)..(329): a, c, t, g, unknown or other
  misc_feature (329)..(329): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccacctctcctgtagggccagtcagagtgttagctacaacttagcctggtaccagcagaaacctggccaggttcccaggctcatcatctatggtgcactcccaccagggccacgtggtactcccagccacctttagnggcagtgggtctggacagagttcactctcaccatcagcagcctgcagtctgaagtattttgctagtttattactgtcaactagtaacaatgactggtcctctcgtacgtttcggacggaggaaccgtaggtggagagtaccgaaaacgtagtcggtggactggctaccattctgttccttcgtacc

SEQ ID NO: 74231 - DNA, 518 bp, Homo sapiens
  misc_feature: GYAE6OF01B9FYB.37.22.B11.1.454.CMB.1.raw
  modified_base (357)..(357): a, c, t, g, unknown or other
  misc_feature (357)..(357): n is a, c, g, or t
  modified_base (516)..(518): a, c, t, g, unknown or other
  misc_feature (516)..(518): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagacaattccaagaatacggtctatctggaaatgaacagcctgagagccgaggacacggccctctattactgtgcgagagatcagacggagtatagcagcagctctgactactggggccacggaaccctggtcaccgtcncctcagcctccaccaagggcccatcggtccttccccctcggcccaccctcctacccaacgacgccaccctcgtcggggccacacgccggccctgggcctcgcctggtcaaggactacttccatctacactactgagcgggctggcaacggcgacatagnnn

SEQ ID NO: 74232 - DNA, 436 bp, Homo sapiens
  misc_feature: GYAE6OF01EGRYD.37.22.B11.1.454.CMB.1.raw
  modified_base (428)..(436): a, c, t, g, unknown or other
  misc_feature (428)..(436): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatccggtcttccccctggccgccctgctccaggagcacctccgagagcacagcggccctgggctgcctggtcaaggctacttccatcctacactactgagcgggctggcaagggcgcatagnnnnnnnnn

SEQ ID NO: 74233 - DNA, 437 bp, Homo sapiens
  misc_feature: GYAE6OF01C86CZ.37.22.B11.1.454.CMB.1.raw
  modified_base (346)..(346): a, c, t, g, unknown or other
  misc_feature (346)..(346): n is a, c, g, or t
  modified_base (432)..(437): a, c, t, g, unknown or other
  misc_feature (432)..(437): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgccttcaccatctccagagactattccaagagcactctgtatctgcaaatgaacagcctgagtgccgaggacacggccctatattattgtgcgaaatgtggggggagtgggggctactcctgggcgttttgactactggggccagggagccctggtcaccgtctcctcagcctccaccaagggccccatccggtccttccccctggccgccctgcctccagganccacctccgagagcacagcggccctgggctgcctggtcaaggctacttccatctacactactgagcgggctggcaaggcgcatagnnnnnn

SEQ ID NO: 74234 - DNA, 433 bp, Homo sapiens
  misc_feature: GYAE6OF01C89BW.37.22.B11.1.454.CMB.1.raw
  modified_base (426)..(433): a, c, t, g, unknown or other
  misc_feature (426)..(433): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggccccatcggtcttccccctggccgccctgctccaggagcacctccgagagcacagcggccctggactgcctggtcaaggctacttccatctacactactgagcgggctggcaaggcgcatagnnnnnnnn

SEQ ID NO: 74235 - DNA, 492 bp, Homo sapiens
  misc_feature: GYAE6OF01CWD78.37.22.B11.1.454.CMB.1.raw
  modified_base (489)..(489): a, c, t, g, unknown or other
  misc_feature (489)..(489): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaaagagccaccctctcctgtagggccagtcagagtgttagctacaacttagcctggtaccagcagaaacctggccaggttcccaggctcatcatctatggtgcatccaccagggccactggtatccccagccacctttagtggcagtgggtctgggacagagttcactctcaccatcagcagcctgcagtctgaagattttgctagtttattactgtcaacagtacaatgactggcctctcactttcggcggtagggaccaaggtggagatacgaaacgatgtggctgcaccatctgtcttntac

SEQ ID NO: 74236 - DNA, 170 bp, Homo sapiens; identical to SEQ ID NO: 74221
  misc_feature: GYAE6OF01DFXGX.37.22.B11.1.454.CMB.1.raw
  modified_base (170)..(170): a, c, t, g, unknown or other
  misc_feature (170)..(170): n is a, c, g, or t

SEQ ID NO: 74237 - DNA, 508 bp, Homo sapiens
  misc_feature: GYAE6OF01EG8LE.37.22.B11.1.454.CMB.1.raw
  modified_base (191)..(191): a, c, t, g, unknown or other
  misc_feature (191)..(191): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagngccaccctctcctgtagggccagtcagagtgttagctacaacttagcctggtaccagcagaaacctggccaggttcccaggctcatcatctatggtgcatccaccgagggccacgtggtactcccagcctacctttagcggcaggtggggtctggggacaggtagttcactctcaccatcagcagcctgcagtctgaagtattttgcttagtttattactgtacaactagtacatgactggcctctctacgtttcggcgggacggaccgaagggtggagatacgaaacgtagtggtggctgacacatctgtctctac

SEQ ID NO: 74238 - DNA, 583 bp, Homo sapiens
  misc_feature: GYAE6OF01C6832.37.22.B11.1.454.CMB.1.raw
  modified_base (191)..(191): a, c, t, g, unknown or other
  misc_feature (191)..(191): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagngccaccctctcctggtagggccagtcagagtgttagctacaacttagcctggtaccagcaagaaacctggccaggcctcccaggcctcctcatctagtggtgcatcccaaccagggccactggtactcccgagccaggttcagtggctaggtgggtctggggacaggtagttcacttctcacctatcagcagccctgcagtctgaagtatttcgacttagtttactttctgttacagtctaagttaattaagtttacgtcggtacccttccgtacgggtcggtaccggtttcggaccgtaaaggggacccaaagggttaggaaaactccgaaaaacggtacgttgggtacgggtacttcggaccctaaccgtagttccttggttccttaccg

SEQ ID NO: 74239 - DNA, 488 bp, Homo sapiens
  misc_feature: GYAE6OF01CE2KA.37.22.B11.1.454.CMB.1.raw
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (485)..(485): a, c, t, g, unknown or other
  misc_feature (485)..(485): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccagggccactggtactcccagccacctttagnggcagtgggtctgggacngagttcactctcaccatcagcagcctgcagtctgaagtatttgctagtttattactgtacaacagtacaatgactggcctctctactttcggcggaggaccaggtggagatacgaaacgatggtgctgcacatctgtctntac

SEQ ID NO: 74240 - DNA, 514 bp, Homo sapiens
  misc_feature: GYAE6OF01EN581.37.22.B11.1.454.CMB.1.raw
  modified_base (191)..(191): a, c, t, g, unknown or other
  misc_feature (191)..(191): n is a, c, g, or t
  modified_base (395)..(395): a, c, t, g, unknown or other
  misc_feature (395)..(395): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccatcctctctgtgtctccaggagaaagngccaccctctcctgtagggccagtcagagtgttagctacaacttagcctggtaccagcagaaacctggccaggttcccaggctcatcatctatggtgcatccaccgagggccacgtggtactcccagccctacctttagtcggcgtaggtcgggtctgggacagtagttcactctcaccatcagcacgcctgcagtctgaagtntttgctagtttattactgtacaatatacatgactgcctctctacgttcggacggacggaccgaagggtggaagtagtacgaaagacgtggtcggactcgtaccactatcgtgtcttacg

SEQ ID NO: 74241 - DNA, 494 bp, Homo sapiens
  misc_feature: GYAE6OF01EP7TI.37.22.B11.1.454.CMB.1.raw
  modified_base (337)..(337): a, c, t, g, unknown or other
  misc_feature (337)..(337): n is a, c, g, or t
  modified_base (468)..(468): a, c, t, g, unknown or other
  misc_feature (468)..(468): n is a, c, g, or t
  modified_base (473)..(494): a, c, t, g, unknown or other
  misc_feature (473)..(494): n is a, c, g, or t
tcagtagtgtagatcacgaccggtgctcgattttagacgacagctcagggaagggactgggagtgggtctcggtctattagtggaagtggtgcgttatactaaactacgcagcctccgtgaagggccgcttcacccatctccagagactattccaagagcactctgtatctgcaaatgaacagcctgagtgccgaggacacggccctatattattgtgcgaaatggtggggggagtgggggctactcctggcgttttgactacgtggggccagggacgccctggtccaccggtctcctcagcctccaccaacgggcccagtccggtccttcccccgnggccgcccttggttcccagggacgcgacccgttccggagacgccaacacggccgggcccctggggctcggcccgtggtacaaagggtccctacttccagtccttacactactgagtcgggctggcaaggcnatagnnnnnnnnnnnnnnnnnnnnnn

SEQ ID NO: 74242 - DNA, 509 bp, Homo sapiens
  misc_feature: GYAE6OF01AJJ34.37.22.B11.1.454.CMB.1.raw
  modified_base (506)..(506): a, c, t, g, unknown or other
  misc_feature (506)..(506): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccgagggcccacgtggtactccccagcctacctttagtggcaggtgggtctgggacaggagttcactctcaccatcagcacgcctgcagtctagaagtattttgactagttttattactgtacaacagtacaatgactgcctctctacgttcgggacggtaggaccgagggtgagatacgaaacgtagtggtcgctgaccacatctcttctntac

SEQ ID NO: 74243 - DNA, 486 bp, Homo sapiens
  misc_feature: GYAE6OF01EDRJP.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacacttagcctggtaccagcagaaacctggccaggttcccaggctcatcatctatggtgcatccaccagggccactggtatcccagccacctttagtggcagtgggtctgggacagagttcactctcaccatcagcagcctgcagtctgaagattttgcagtttattactgtcaacagtacaatgactggcctctcactttcggcgagggaccaaggtcggagatcgaaacgactgtggctgcaccatctgtctctac

SEQ ID NO: 74244 - DNA, 540 bp, Homo sapiens
  misc_feature: GYAE6OF01DT2I2.37.22.B11.1.454.CMB.1.raw
  modified_base (535)..(535): a, c, t, g, unknown or other
  misc_feature (535)..(535): n is a, c, g, or t
  modified_base (539)..(540): a, c, t, g, unknown or other
  misc_feature (539)..(540): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaagtggtggggggagtgggggctacgtccgtggtcgttttgactacgtggggccgaggggacgcccgtggtcacccgtctcctcacgccctccaccgaacgggcccagtccggtccttccccccgtggcccgcccctgcctccgaggcgccaccctccgagacgccacacgcggcccgtgggctggcccgtggtcaacggtctacgttccatcctacactctgacggcggcgtggcaggcnatgnn

SEQ ID NO: 74245 - DNA, 563 bp, Homo sapiens
  misc_feature: GYAE6OF01DM005.37.22.B11.1.454.CMB.1.raw
  modified_base (232)..(232): a, c, t, g, unknown or other
  misc_feature (232)..(232): n is a, c, g, or t
  modified_base (530)..(530): a, c, t, g, unknown or other
  misc_feature (530)..(530): n is a, c, g, or t
  modified_base (561)..(562): a, c, t, g, unknown or other
  misc_feature (561)..(562): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccaggggaaggactggagtgggtctcgtctattagtggaagtggtgcttatacaaactacgcagcctccgtgaagggccgcttcaccatctccagagactattccaaagngcactctgtatctgcaaatgaacagcctgagtgccgaggacacggcctatatttattgtgacgaaagtgggtggggggagtgggggcttacgtccgtggtcgttttgacgtacgtggggccagggacgcccgtggtccaccgtctcctcacgcctcccaccgaacgggcccagttccggtccttcccccgtggcccgcccctgcctccgaggacgccacctccgagcgcacgacgccggcccgtgggcctcggtccctggtaccaacggtccttaccttccactcctaacacttacgnggacggcgggctgggacaagggccacagtgnng

SEQ ID NO: 74246 - DNA, 495 bp, Homo sapiens
  misc_feature: GYAE6OF01CGHW0.37.22.B11.1.454.CMB.1.raw
  modified_base (326)..(326): a, c, t, g, unknown or other
  misc_feature (326)..(326): n is a, c, g, or t
  modified_base (491)..(491): a, c, t, g, unknown or other
  misc_feature (491)..(491): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccagggccactggtatcccagccacctttagnggcaggtgggtctgggacagagttcactctcaccatcagcagcctgcagtctgaagtatttgctagtttatttctgtcagtcagtataattctggcctctagtggacgttcgccgtaaggaccaaggtaggaaatcgaaacgtatggtgctgcacatctgtcttntacg

SEQ ID NO: 74247 - DNA, 792 bp, Homo sapiens
  misc_feature: GYAE6OF01AMX6Y.37.22.B11.1.454.CMB.1.raw
  modified_base (114)..(114): a, c, t, g, unknown or other
  misc_feature (114)..(114): n is a, c, g, or t
  modified_base (149)..(149): a, c, t, g, unknown or other
  misc_feature (149)..(149): n is a, c, g, or t
  modified_base (791)..(791): a, c, t, g, unknown or other
  misc_feature (791)..(791): n is a, c, g, or t
tcagtagtgtagatcacgaccggtgctcgatttagacgacagctcagggtccctgagactctcctgtgcagcctctggattcaccttcagcagctatgccatgacctgggtccnccaggctccgagggaggcgtggagtgggtctcgtnttagttaggtggtaagtggtcgtactttagtaactaaactacgcacgtcccttccggtaggaacggggcccgtcttaccaacctattcctaccgaaggtacgtaacttacttaacccgaaaggactcctaacttcgttagttaactcgtagaacctaaaatcggaaaacctacggcccttaggtaacgttcggacccgggtaaggaccctacccgggtacccctttaagttaagtttacgttggtccgaacggtaaaacggttggggtggggggggtaacggtcgggggtacttaccggttccgttaggggttccgtttttaagaccgtttagggtccggggaccgtaaggggtcccgtcccgttaggtccccgtaacccggttccgtccttaccgaacggtccccttacccaaacccggtacgggtcccctagtcccgggttaccctttcccccggcgggtcccgtcccgtcgtccctaccggacggtaccgcccgtacccgtcccgacggtacgccgacgtaccggccggtccgtccggggccgttggtacccgtgggtacaacggtacttcccgtactactaccgtacctaacgtcgtagaccgggtcggtacacgggtacgacggtcaagtcgagtcng

SEQ ID NO: 74248 - DNA, 479 bp, Homo sapiens
  misc_feature: GYAE6OF01E4E1O.37.22.B11.1.454.CMB.1.raw
  modified_base (471)..(479): a, c, t, g, unknown or other
  misc_feature (471)..(479): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccagggagcccgtggtcaccgtctcctcagcctccaccaacgggccccagtccggtccttccccctggccaccctccctccaagacgccaccctcgtcggggggccaccgacggccgggccctgggggcctcggcccgtgggtaccaaagggtaccttacttccattcctacactactgaggcgggctgggcgaagggcgcaatagnnnnnnnnn

SEQ ID NO: 74249 - DNA, 426 bp, Homo sapiens
  misc_feature: GYAE6OF01D0WYO.37.22.B11.1.454.CMB.1.raw
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (424)..(426): a, c, t, g, unknown or other
  misc_feature (424)..(426): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttccccnggcgccctgctccaggngcacctccgagacgcacagcggccctgggctgcctggtcaaggctacttccatctacactactgagcgggctggcaaggcgcatagnnn

SEQ ID NO: 74250 - DNA, 434 bp, Homo sapiens
  misc_feature: GYAE6OF01CUB4B.37.22.B11.1.454.CMB.1.raw
  modified_base (340)..(340): a, c, t, g, unknown or other
  misc_feature (340)..(340): n is a, c, g, or t
  modified_base (428)..(434): a, c, t, g, unknown or other
  misc_feature (428)..(434): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactacgtggggccagggagccctggtcaccgtctcctcagcctccaccaagggcccatcggtcttccccctggcgccctgctccaggancacctccgagacgcacagcggccctgggctgcctggtcaaggactacttccatctacactactgacgcgggctggcaaggcgcatagnnnnnnn

SEQ ID NO: 74251 - DNA, 575 bp, Homo sapiens
  misc_feature: GYAE6OF01C8Y5S.37.22.B11.1.454.CMB.1.raw
  modified_base (114)..(114): a, c, t, g, unknown or other
  misc_feature (114)..(114): n is a, c, g, or t
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (570)..(571): a, c, t, g, unknown or other
  misc_feature (570)..(571): n is a, c, g, or t
  modified_base (573)..(575): a, c, t, g, unknown or other
  misc_feature (573)..(575): n is a, c, g, or t
tcagtagtgtagatcacgaccggtgctcgatttagacgacagctcaggggtccctgagactctcctgtgcagcctctggattcaccttcagcagctatgccatgacctgggccnccaggctccgaggggaaggggctgggagtgggtctcgaggttattacgtggtagtggtaataccgcatactacgcagactccgtggaccgggccggttcaccgtctccagagactaattccaaagatacgtctatctaggaaatgaacngcctgaagcgccgaggaccacgtccctntattactgtgcgaaganatcgaaggacggatanagcagcagctcagaactcggcgggacccaaccgggtaacctggtccacccgttcctcctacacgccctacccgaacggtaacggccctagtccgtccctccccgtcgacccacccctccctaccgacgaccgccgaccgtcggtcgggccacgacggcccgccgtcggcgtcgcgtcggtacgtacggtaccttacctccactcctacacaccgtgacggcggcgcggacgacggcgacgtacganncnnn

SEQ ID NO: 74252 - DNA, 647 bp, Homo sapiens
  misc_feature: GYAE6OF01EKT2Z.37.22.B11.1.454.CMB.1.raw
  modified_base (170)..(170): a, c, t, g, unknown or other
  misc_feature (170)..(170): n is a, c, g, or t
  modified_base (339)..(339): a, c, t, g, unknown or other
  misc_feature (339)..(339): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctntctgtgtctccaggagaaagcgcccaccctctcctggtacgggccagtcagagtgttagctaacacttagcctggtaccagcagaacctggccaggttcccaggctcatcatctatggtgcactcccaccgacgggccacgtggtactcccacgtccctacgtttaggnggtctaggttcgggtcgtgggactaggtacgtttccacttccgtacaaccgtatccgagccacggtccctgctacgttacgtagtaacgttagttttgactttaagttttactttaacgttcgttaactaactaacgttaacaagttcggtaaccttcgggtcccttcttaccgttaccggtttccgggacgggtaacgggtaacccggtaaggggtacggtaaggtaacgttaacggaaaaccggtaggttacggtcggtaccgtcgacccgtacctacttaccgttcgtttccgttccgttacccg

SEQ ID NO: 74253 - DNA, 597 bp, Homo sapiens
  misc_feature: GYAE6OF01B3OOR.37.22.B11.1.454.CMB.1.raw
  modified_base (327)..(327): a, c, t, g, unknown or other
  misc_feature (327)..(327): n is a, c, g, or t
  modified_base (363)..(363): a, c, t, g, unknown or other
  misc_feature (363)..(363): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtaggccagtcagagtgttagctacaacttagcctggtaccagcagaaacctggccaggctcccaggctcctcatctatggtgcatccaccagggccacgtggtactcccagccacctttagnggcagtgggtctgggacaggtagttcactctcaccntcagcagcctgctagtctagaagtattttgcttagttttatttctgttacagtactagttaacttaagtttaccgttcggtacccttaccgttaccggttggggtacccggtttccgggtaacccgtaaacggggaaccctaaaggggttacggaaaacgttaccgaaaaacggttaaccgttcgggtacgggacgttcgacctaacctacgttccttcgttcctttcctaccg

SEQ ID NO: 74254 - DNA, 613 bp, Homo sapiens
  misc_feature: GYAE6OF01CQ5R2.37.22.B11.1.454.CMB.1.raw
  modified_base (171)..(171): a, c, t, g, unknown or other
  misc_feature (171)..(171): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagcccaccctntctgtgtctccaggagaaaagcgcccaccctctccgtggtacgggccagtcaagagtgttagctaacaacttagcctggtaccagcaagaaacctggccaggttcccaggctcatcatctatggtgcatccaccagggccactggtactcccagcctaccgtttagcggctaggtgggtctgggactagagttcactctcaccatcagcagcctgctacgtcgtagtaacgtatttcgcttaagttttattaacgtgtacctaaacgtacgttaaactaagttacggaacgtcgggtacccttacgttaccgttaaccgttttccgggaacgggtacgggaacccgtaaagggtacggtagaaacgtaccgtaaaacggtaaccgttgggtcggacgtacggacctaacccgtacgttacgttcgttccttccgttaacccg

SEQ ID NO: 74255 - DNA, 196 bp, Homo sapiens
  misc_feature: GYAE6OF01CTOUK.37.22.B11.1.454.CMB.1.raw
  modified_base (173)..(196): a, c, t, g, unknown or other
  misc_feature (173)..(196): n is a, c, g, or t
tcagtagtgtagatcacgaccggtgctcgatttagacgacagctcaggggcccatcggtcttccccctggcgccctgctccaggagcacctccgagagcacagcggccctgggctgcctggtcaaggactattccatctacactaactgagcgggctggcaaaggcgcatagnnnnnnnnnnnnnnnnnnnnnnnn

SEQ ID NO: 74256 - DNA, 195 bp, Homo sapiens
  misc_feature: GYAE6OF01B1TA1.37.22.B11.1.454.CMB.1.raw
  modified_base (163)..(163): a, c, t, g, unknown or other
  misc_feature (163)..(163): n is a, c, g, or t
  modified_base (169)..(195): a, c, t, g, unknown or other
  misc_feature (169)..(195): n is a, c, g, or t
tcagtagtgtagatcacgaccggtgctcgatttagacgacagctcagggcccatcggtcttcccctggcgccctgctccaggagcacctccgagagcacagcggccctgggctgcctggcaaggctacttcatctacactactgagcgggctggacaaggcgnaatagnnnnnnnnnnnnnnnnnnnnnnnnnnn

SEQ ID NO: 74257 - DNA, 865 bp, Homo sapiens
  misc_feature: GYAE6OF01B82FK.37.22.B11.1.454.CMB.1.raw
  modified_base (857)..(857): a, c, t, g, unknown or other
  misc_feature (857)..(857): n is a, c, g, or t
  modified_base (862)..(862): a, c, t, g, unknown or other
  misc_feature (862)..(862): n is a, c, g, or t
tcagtagtgtagatcacgaccggtgctcgatttagacgacagctctagggggtccctggagacgtctcccctcgtggtccaggcctctggatttcgaccttcagcagctatgccatgaacctgggtccgccaggccgtccgtagggggaacgggtctgggagttgggggttccttcggttctaatttaaggtttagggaagttcggtggtctttaagtaacgaaacgtcggcacgtcccgttccggtaggaacggggtcccgggactttccgaccgtactccgtcccgtaaggggtacctacgtaagttaccccgaaagtaccgtccaaccttccgtaggttacttccgtaggtacctaaaacgtcggtaaaccaggtacccttaggtaacggttcggtacccggtaagggaccgtaacccggggtcccccgttaacgttaacgtttaacggtttcggttacggaaccgggtaaaaaggtggggttaggggggggtaaagtcggggggtaccttaaccggttccggttaggggtacggtttttacggaacgttaaccgggtcggggacccgtaaagggggtacctacccgttacggtacctaacccggtctacccgtaccaccggtacccgtaccgaaccggtaacgggtcccctaaggttccccggtacccttcccccgtcgggacccgtccccgtacgtacctaccgaacggaccgccgtaaccctccggaagtaccgaccgacggtaccggccgtccggtacgggctacggtccgtaggtaccgaacgtacctaccgttcctagtactacgtccgtaggtggacggtcggacgtcggaacgtacggaccgtagngcggnacg

SEQ ID NO: 74258 - DNA, 698 bp, Homo sapiens
  misc_feature: GYAE6OF01BBZNE.37.22.B11.1.454.CMB.1.raw
tcagtagtgtagatcacgaccggtgctcgatttagacgacagctcagggggtccctgagactctctgtgcagtctctggattcaccttcaggccagctatcgcccagtcgaccctgggtccgccaggcgtcccagggaagggctggagtggtctcgtctattagtggaagtggtcgcttatacaaactccgctagcctccgtgaagggtccgtcttacaccatctcccagacgactacttccaaggacggctaactctagtatctgtcaaatgtaactaagtcctagagtacgaccgaaggaccaccgaccctatatatgtagcgaagtggtggggagtggggcttacgtacgtagggtcggttttcgacttaacggtgggaccgtagggacgtccgtggtcaccggtcgtaccgtcgtacgtccctacccaccgaaccgggccctaacgtccggttacccttcccccgtggtcccgcccccgttcgacccgttaccggaaggtccgtacccgtaccccgttacccggaagtaccgccgtaaccgaacggtcccgggtaccgtcgggtaccgtccgtcccggtacgggttaccgaacggtaccttacccgttccgaacgtacccggtaacctaacgttaccgttagggaacggtcgggtaaccgtgggaccgtaacgggcctagaacgttccggatcg

SEQ ID NO: 74259 - DNA, 500 bp, Homo sapiens
  misc_feature: GYAE6OF01CB1PI.37.22.B11.1.454.CMB.1.raw
  modified_base (338)..(338): a, c, t, g, unknown or other
  misc_feature (338)..(338): n is a, c, g, or t
  modified_base (480)..(500): a, c, t, g, unknown or other
  misc_feature (480)..(500): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggcctatattattgtgcgaaatggtggggggagtgggggctactccgtggtcgttttgactacgtggggccagggagccctggtccaccgtcctcctcagccctaccaccgaacgggccccatccgggtccctttccccccgnggcccgtccctgcctccagggacgccacctccgagacgcacgacggccggcccgtgggctcggcctggtacaaacggcttacctccatcctaacacttacgtggagccggggtctacgggactaaacggcgactaagtagcnnnnnnnnnnnnnnnnnnnnn

SEQ ID NO: 74260 - DNA, 753 bp, Homo sapiens
  misc_feature: GYAE6OF01BTQRF.37.22.B11.1.454.CMB.1.raw
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtggcagttatatcagatgatggaagtgttgaggagtatgcagactccgtgaaggccgattcaccatctccagagacaattccaagaacacactctatctgacaaatgaacagcctagaagaactgaggacacggctgtgtatcactgtcgacgaacgtaagggggtttgagatgcgagcgtaggagggtgtagttggtttagtagtttaggtcggggtacgaaagggactaagttcgggtacctaccggttcttacccgttaccgaccggtaccccttacccgaaacccggtaaaccgggtcccctaacggttcccgggtttccccttccccccggttacgggacccctaaccccccgttccgtaaccccgaaacggacccgtccgtaccccggttacgggttaccgggggaccctaccggaccgggtccccgggtcccccgttcgggggcccttaccgggtccccgttacggggtaacccgtaaaacggggttcccctttaacccggtttacccccgtaacgtttaaccccgttaaaccgttaaccccgttaaccggtacggggtaaaccccggggtcccggggttacgttacccgggggtaacccgg

SEQ ID NO: 74261 - DNA, 843 bp, Homo sapiens
  misc_feature: GYAE6OF01B4HQI.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctcccagataccactggagaaatagtgatgacgcagtctccagcccaccctgtctgtgtctccgaaggggaaagacgcccaccctctcctgcgacgggccagtcagagtgttagcagcaacttagccgtggtaccagcaagaaccgtggccaggcctacccgaggcctcctcattctagtcggtcgccactcccgaccgacgggccacgttcggtactccccgagccgtaggttcgaggtcggaccgtagggtcgggtcgtagggactaagggtacgtttcaaccgttcctaccaaacccgtagttaccgaaccgaccgtaaccggtcccgttacggtaccgtaacggttacccggttaaggtaaaacggtttacgttttttaccggaacctttttaaccgttttttaacgtttaaccgtttcggttaaccgtaacgggtaacttaaacggtttaaaactttaaaccggttaaaccccggtttaccccggggaaccccccggggtttaaacgggtttaccccggggaaacccggtaaaccggggtaacccggtaaaacgggggttaaccggttaaaaacggttaaaccccggtaaaaaccgggttaacccggttacggggttaaccggtacccggttacggtaaccccgtaaacccgtttacgttacccgtttaaccggtttacccctttaaccgttacccgtttcccccggtttaaccccccg

SEQ ID NO: 74262 - DNA, 586 bp, Homo sapiens
  misc_feature: GYAE6OF01CC31M.37.22.B11.1.454.CMB.1.raw
  modified_base (304)..(304): a, c, t, g, unknown or other
  misc_feature (304)..(304): n is a, c, g, or t
  modified_base (330)..(330): a, c, t, g, unknown or other
  misc_feature (330)..(330): n is a, c, g, or t
  modified_base (419)..(419): a, c, t, g, unknown or other
  misc_feature (419)..(419): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagcccaccctctctgtgtctccaggagaaaagcgcccaccctctcctggtacgggccagtcagagttgttagctaacaacttacgcctggtaaccaggcaacgaaacctggaccaggttcccaggtctcgatcatctagtggtncactccaccgagggccacgtggtacncccgagccctaacgtttggcggctaggtcgggtcgtgggacaggtacttcactctcacatcagcacgcctgcgtagtcgtagtaagttntttacgacttagtttattacgtacgtacaacgtagtaactaagtcgtactcggtccctcgttaccgtacgtttcgggacgggtaacgggtacgtaagggtggaacgtacgtaacgaaacgtaacgtggtcgcgtacgacctaccgtacttccttgtccttactaccg

SEQ ID NO: 74263 - DNA, 591 bp, Homo sapiens
  misc_feature: GYAE6OF01DV7UG.37.22.B11.1.454.CMB.1.raw
  modified_base (200)..(200): a, c, t, g, unknown or other
  misc_feature (200)..(200): n is a, c, g, or t
  modified_base (550)..(550): a, c, t, g, unknown or other
  misc_feature (550)..(550): n is a, c, g, or t
  modified_base (564)..(564): a, c, t, g, unknown or other
  misc_feature (564)..(564): n is a, c, g, or t
  modified_base (589)..(589): a, c, t, g, unknown or other
  misc_feature (589)..(589): n is a, c, g, or t
  modified_base (591)..(591): a, c, t, g, unknown or other
  misc_feature (591)..(591): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaaggactggagtgggtctcgtctattagtggaagtggtgcttatacaaactacgcagcctcgtgaagggccncttcaccatctccagagactattccaaagagcactctgtatctgcaaaatcgaacagcctgagtcgccgaggaccacggcctatattatgtagacgaaatgggtagggggagtggggctacgtccgtggtcgtttgactacggtgggccagggacgcccgtgggtcccaccgtctccgtcacgtccctaccaaccgacgggccctagttcccggtaccttcccccgtggcccgtacccgtcgcctaccgaggacgtccaccgttcccgaagcgactacgacgccggcccgtagggcctccggtcgtacggtacaacggtaccttaccgtccacttccaacgacgttacgngggacgccggggtntggaccgaaggggccaagtgtacgntn

SEQ ID NO: 74264 - DNA, 508 bp, Homo sapiens
  misc_feature: GYAE6OF01ANX1G.37.22.B11.1.454.CMB.1.raw
  modified_base (489)..(508): a, c, t, g, unknown or other
  misc_feature (489)..(508): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctactcctggcgttttgactactggggccagggagccctggtcaccgtctcctcagcctccaccaagggccccagtccggtccttccccctggccgccctgcctccaggacgccaccctccgagacgcacgacgccgggccctggggcctcggcccgtgggtccaaacgggaccttaccttcccattccgtaaccaccgttaaccgtggaacggcccggggtcttcgggacaaacgggccgaccgaagtacggnnnnnnnnnnnnnnnnnnnn

SEQ ID NO: 74265 - DNA, 473 bp, Homo sapiens
  misc_feature: GYAE6OF01ELHIP.37.22.B11.1.454.CMB.1.raw
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (450)..(473): a, c, t, g, unknown or other
  misc_feature (450)..(473): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccagggacgccctggtccaccgtctcctcagccctccaccgaagggccccatccggtccttccccctggccgccctgctccgaggngccacctccgagngcacgagccggccctgggctgcctggtcaaggccttacttcccatcctacactacgtgaggcgggctggacaagggccgacagtagcnnnnnnnnnnnnnnnnnnnnnnnn

SEQ ID NO: 74266 - DNA, 430 bp, Homo sapiens
  misc_feature: GYAE6OF01ALIK9.37.22.B11.1.454.CMB.1.raw
  modified_base (423)..(430): a, c, t, g, unknown or other
  misc_feature (423)..(430): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggatgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnnnnn

SEQ ID NO: 74267 - DNA, 174 bp, Homo sapiens
  misc_feature: GYAE6OF01CYOWJ.37.22.B11.1.454.CMB.1.raw
  modified_base (84)..(84): a, c, t, g, unknown or other
  misc_feature (84)..(84): n is a, c, g, or t
  modified_base (163)..(163): a, c, t, g, unknown or other
  misc_feature (163)..(163): n is a, c, g, or t
  modified_base (169)..(174): a, c, t, g, unknown or other
  misc_feature (169)..(174): n is a, c, g, or t
tcagtagtgtagatcacgaccggtgctcgatttagacgacagctcagggcccatcggtcttcccctggcgccctgctccaggancacctccgagagcacagcggcctgggctgcctggtcaaggactacttccatctacactactgagcgggctggcaaggcncatagnnnnnn

SEQ ID NO: 74268 - DNA, 647 bp, Homo sapiens
  misc_feature: GYAE6OF01E27TR.37.22.B11.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (421)..(421): a, c, t, g, unknown or other
  misc_feature (421)..(421): n is a, c, g, or t
tcagtagtgtagatcacgaccggtgctcgatttagacgacagctcaggggtccctgagactctcctgtgcagcctctggattcaccttcagcagctatgccatgacctgggtcccgccaggctcccaggggaagggactggagtgggtctcgtctagttagtggaagtggtgcttatacaaactacgcagcctccgtgaggccncttcaccatctccagagactattccaagngcactctgtatctgcaaatgaacagccgtgagtgccgaggaccacggccctatattatgtgcgaaatggtggggggatcgggggctactccgtggcgttttgactacgtgggccagggacgccctggtccaccgtactcctcacgcctccgaccgaacgggcccctagtccgggtcccttccccccgnggtcccgccccgttcgcctccgaaggcgccaccgtccgacgagcgacgaggccgggtccccgtggggacccttcgggccccgttagggggtaccccgtaaagggtaccccgttaacccgtttcccgaacgttaccccgtaacccgtaaccgttaacccgttggaaacccgggtccggggaccgttacggggacccgtaaacgggcccgtacctaacgttaggctcg

SEQ ID NO: 74269 - DNA, 562 bp, Homo sapiens
  misc_feature: GYAE6OF01DC4G5.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccacctctcctgtagggccagtcagagtgttagctacaacttagcctggtaccagcaagaacctggccaggttcccaggctcatcattctagtggtgcactcccaccgagggccacgtggtactcccgagcctaccgtttagtgcgtaggtgggtcgtgggacagtgtcactctcacatcagcagcctgctagtctagtaattagtttgacttagtttatactagtactaacgtagttacagtcgacttcggtcccttacgttccgtaccggtttcggggaccggtacgggtaccgtaagggtggaacgtactaacggaaacgtagttggtacggcctagacctactattcgttacgttcttcgtacccg

SEQ ID NO: 74270 - DNA, 446 bp, Homo sapiens
  misc_feature: GYAE6OF01D4I6E.37.22.B11.1.454.CMB.1.raw
  modified_base (325)..(325): a, c, t, g, unknown or other
  misc_feature (325)..(325): n is a, c, g, or t
  modified_base (343)..(343): a, c, t, g, unknown or other
  misc_feature (343)..(343): n is a, c, g, or t
  modified_base (431)..(446): a, c, t, g, unknown or other
  misc_feature (431)..(446): n is a, c, g, or t
tcagtagtgtagatcacgaccggtgctcgatttagacgacagctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccaggggacgccctggtcaccgtctcctcagcctccaccaagggcccatcggtcttccccnggcgccctgctccaggancacctcgagacgcacagcggccctgggctgcctggtcaaggctactccaatctaacactactgagcgggctggacaaggcgacatagnnnnnnnnnnnnnnnn

SEQ ID NO: 74271 - DNA, 780 bp, Homo sapiens
  misc_feature: GYAE6OF01A67OX.37.22.B11.1.454.CMB.1.raw
  modified_base (169)..(169): a, c, t, g, unknown or other
  misc_feature (169)..(169): n is a, c, g, or t
  modified_base (191)..(191): a, c, t, g, unknown or other
  misc_feature (191)..(191): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatgtgatgacgcagtctccagccaccctntctgtgtctccaggagaaacgngccaccctctacctggtacgggccagtcaggtagtgttacgctagtccacttagccttaggtaccaacagacgacctggaccgacggccccgaggcctccgtctactctagtcgctcgtcctttccgcgacgggtccacgtcggcctacgtcccgacggtccgtaggtttccgacggttcggacgtacggggttcgggtaccgtacggaacggtaacgtaacggttaccttaccgtaaccgttaccgtacctaacccgtacgtaccgtaacggtccgtaacggttaccgtaaggtaccgtcccgttaaggtaacggtttacttttacggacctttaacttttactaacgttccgttagtaaccgtaaaccgtacggtaccttaccgtaacccgttaccgggttacgggttacccggttaacccgtttaccggggaaccggtaaaccgggtaaccggttaacggggttaccgtttaacccgttttacccggtaaaccggttaaccggttacggtcccggttacgttaccggtacccctaaaccggttacctttccggttttacccggttccgttacccgttttaccccgg

SEQ ID NO: 74272 - DNA, 466 bp, Homo sapiens
  misc_feature: GYAE6OF01BVQK3.37.22.B11.1.454.CMB.1.raw
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
  modified_base (451)..(466): a, c, t, g, unknown or other
  misc_feature (451)..(466): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctactcctggtcgttttgactacgtggggccaggggagccctgggtccaccgtctcctcagccctccaccaagggccccagtcggtccttcccccgtggccnccctgcctccaggacncacctcgagacgcacgacgccggcctgggcctgcctggtacaaggtactacttccatcctactactactgacgcgggctgggacaaggcgacagtagnnnnnnnnnnnnnnnn

SEQ ID NO: 74273 - DNA, 499 bp, Homo sapiens
  misc_feature: GYAE6OF01DW79C.37.22.B11.1.454.CMB.1.raw
  modified_base (349)..(349): a, c, t, g, unknown or other
  misc_feature (349)..(349): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccaggggccactggtatccccagccacctttagtggcagtggggtctgggacagngttcactctcaccatcagcagcctgcagtctgaagattttgactagtttatttactgtcaacngtanaatgactggctctcacttcggcggagggtccaaggtggagagtcgaaacgaatgtcggctcgacaccgactctgtcttcctac

SEQ ID NO: 74274 - DNA, 652 bp, Homo sapiens
  misc_feature: GYAE6OF01DDO2H.37.22.B11.1.454.CMB.1.raw
  modified_base (642)..(642): a, c, t, g, unknown or other
  misc_feature (642)..(642): n is a, c, g, or t
  modified_base (651)..(652): a, c, t, g, unknown or other
  misc_feature (651)..(652): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccaggggaaggactggagtgggtctcgtctattagtggaagtggtgcttatacaaactacgcagcctccgtgaagggccgcttcaccatcctccagagactattccaagagcactctgtatctgacaaatgaacagcctgagtgcgaggacacggcctatattatgtgacgaaagtgggtagggggagtggggctacgtcgtggtcgttttgacgtacgtgggccgagggacgccgtggtccaccggtctcctcacgtccctccgaaccgaacgggccctacgttcccggtcccttccccccgtgggccccgtcccgtcgcccgtaccgaacgggaccaccgtaaccccgtaccggaacgaccggccaaccggacgggccccgggtcccgttacggggccttacgggtccccgtagggtaaccgtaaaccgggtaccttaccgttacctacgttacctaacccgtaaccgttaccggtaggaacgggttccggggtacgcggggaaccgaacgggccganacgtaacgnn

SEQ ID NO: 74275 - DNA, 641 bp, Homo sapiens
  misc_feature: GYAE6OF01BRXIA.37.22.B11.1.454.CMB.1.raw
  modified_base (220)..(220): a, c, t, g, unknown or other
  misc_feature (220)..(220): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
tcagtagtgtagatcacgaccggtgctcgatttagacgacagctcaggggtccctgagactctcctgtgcagcctctggattcaccttcagcagctatgccatgaccgtgggtccgccaggctccgaaggggaagggactgggagtgggtctcgtctagttaggtggaagtggtgcttaataacaaactacgcagcctcgtggaaggccgcttcacatcncagagactataccaagagctactctgtatcgtagacaaatagaacacgtctaggaggtcgaccggaggaccgaccggtacccttaagttagtttagttggtacgaacggtaaaggtggggtaggggggaggtcgggggtctacgtccggtggttcgtttagacgtacggtcgggaccgagggtcgtccgcggtccaccggttcctaccgtcacgtcccctacccgaaccgaaccgggccctacgtcccggttccccttcccccgtggcccctcccgtcgccctaccgaaggccgacctccggttcggacgggcaacggcggcccggtccggtcgggccgtcggccgtacggtaccgaacgtacctactccactccgtaacctacgaggcggcggcggtcggtcgacgacggcacagncngn

SEQ ID NO: 74276 - DNA, 642 bp, Homo sapiens
  misc_feature: GYAE6OF01DQS3T.37.22.B11.1.454.CMB.1.raw
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
  modified_base (641)..(642): a, c, t, g, unknown or other
  misc_feature (641)..(642): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccgaggggaaggactggagtgggtctcgtctattagtggaagtggtgcttatacaaactacgcagcctccgtgaacgggccgcttcaccatctccaganactattccaaagngcactctgtatctgacaaatgaacagctgagtgaccgaggacaccggcctaattatttagttgtggacgaaagtgggtggggggtaggtgggggcttacgtccgtggtcgtttgacgtcggtcgggcgagggcgccgtggtccaccgtcctcctcacgccctcccgaaccgacgggtccctagttcccggttcccttccccccggtggccccgtccccgtcgcccgtcccggaggccgaccctacccgtccgacgcgaccacgaccggcccggtcccgtcgggcctccgggtcccgtagggacccgtaaacggtccttaacccgttcccaacttcccgtaaacctacggttccgtagggaccgggtccgggtaccgtacgggaccggtaaacgggccgatacggtgnn

SEQ ID NO: 74277 - DNA, 740 bp, Homo sapiens
  misc_feature: GYAE6OF01BG68D.37.22.B11.1.454.CMB.1.raw
  modified_base (326)..(326): a, c, t, g, unknown or other
  misc_feature (326)..(326): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctcaggagaaagcgcccaccctctcctggtacgggccagtcaggtagtgttaacgccttaactaacgtttacgccgtgggtaaccagaccaacggtaaacccgtgggccctacgggtttccccaggtcctcaactcattctagtggtcncactcccgaccgacgggcctacgtggtacctccccgagtcccctaccgttttaggtcggccgtagggttcgggtcgttacggggaactagggttacgttccaccgttcctaccaacctaacgtccgaacgtacccgacggtcccgtacgtaccgtacggttaccgttaggtaaacgtttagttttacgtaccgtttaaagttttaacgtttaccttacggttaacctaacgtaacgttaactaacgttacgtaccgttacggtcccttaccgttaccgttaccggtttccggggaccgggtacgggtaaccggtaagggtacgggtaacgtacggttaaacggaaaccggttaggttcggtcggtacgtccgtaccgtaccctacgttccgttcctttaccgttccttaccccg

SEQ ID NO: 74278 - DNA, 428 bp, Homo sapiens
  misc_feature: GYAE6OF01A8YG7.37.22.B11.1.454.CMB.1.raw
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
  modified_base (407)..(407): a, c, t, g, unknown or other
  misc_feature (407)..(407): n is a, c, g, or t
  modified_base (413)..(428): a, c, t, g, unknown or other
  misc_feature (413)..(428): n is a, c, g, or t
tcagtagtgtagatacacgaccggtgctcgatttagacgacagctcagggaagggactggaggtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactacgtggggccagggagccctggtcaccgtctcctcagcctccacagggcccatcgtctcccctgcgcctgctcagncactcganagcacagcgccctgggctgcctggtcaggctacttccatctacactactgagcgggctggcaaggcncatagnnnnnnnnnnnnnnnn

SEQ ID NO: 74279 - DNA, 653 bp, Homo sapiens
  misc_feature: GYAE6OF01BGYB3.37.22.B11.1.454.CMB.1.raw
  modified_base (172)..(172): a, c, t, g, unknown or other
  misc_feature (172)..(172): n is a, c, g, or t
  modified_base (358)..(358): a, c, t, g, unknown or other
  misc_feature (358)..(358): n is a, c, g, or t
  modified_base (377)..(377): a, c, t, g, unknown or other
  misc_feature (377)..(377): n is a, c, g, or t
  modified_base (612)..(612): a, c, t, g, unknown or other
  misc_feature (612)..(612): n is a, c, g, or t
tcagtagtgtagatcacgaccggtgctcgatttagacgacagctcaggaactgctcagttaggacccagacggaaccatggaagccccagcgcagcttctcttcctcctgctactctggcctcccagatatcactggagaaatagtgatgacgcagtctccagcccaccctntctgtcgtcctccgaggagaaacgcgcccaccctctccgtggtacgggcctagtcagagttgttacgactactacttacgccgtacggtaccagacaacgaaccgtcggaccgtaggttcccaggtcctcgaactcattccgtagtcggtcaccgtactaccgacccgagggccctacgtcgtacncccgacgtcctacgttagngacgtaggttcggactgggaacctggtacgttccaacgtcctaccaactgtaccgacgtctacggtccgtcaacggtacgtcgttaagtaagtttcgttttaccgatttaacggttttacttaacgttacgtaacaaacgttacgttaatcggtacgtaccgttccgtacccgttccctaagttccgggttcgggaacgggtaacgacggtagtacgagtacctaacgtaaccgngttggacggtcacgaccgacttacgtcttctcctacgttcc

SEQ ID NO: 74280 - DNA, 622 bp, Homo sapiens
  misc_feature: GYAE6OF01BE5OQ.37.22.B11.1.454.CMB.1.raw
  modified_base (205)..(205): a, c, t, g, unknown or other
  misc_feature (205)..(205): n is a, c, g, or t
  modified_base (614)..(614): a, c, t, g, unknown or other
  misc_feature (614)..(614): n is a, c, g, or t
  modified_base (620)..(620): a, c, t, g, unknown or other
  misc_feature (620)..(620): n is a, c, g, or t
tcagtagtgtagatcacgaccggtgctcgatttagacgacagctcaggggtccctgagactctcctgtgcagcctctggattcaccttcagcagctatgccatgacctgggtcccgccaggctccgaggggaagggactggagtgggtctcgtctattagtggaagtggtgcttatacaaactacgcagcctccgtgaagggccncttcaccatctccagagactattaccaagacgcactctgtatctgacaaatgaaacacgcctgagtcgccgaaggaccaccggcccttaattatttagttgtagacggtaaaggttgggtaggggggaggtcgggggacttacgtccgttggtcgttttgacgtacggtcgggccgaggggacgcccgtggtcctacccggtccttccgtcgacgtccctacccgaccgaacgggcccacgttcccggttcccttccccgtcggccgccccgtcgcctccgacggcgccaccgtccgagacgcgaccgacgccggcccgtcgggtcgtccgtaccgtcggtaccgaacggaccttacctcctactaccgtacctacgtacgtgacggcggtccgaggaccgacggcganacgtgncg

SEQ ID NO: 74281 - DNA, 168 bp, Homo sapiens
  misc_feature: GYAE6OF01CH6FO.37.22.B11.1.454.CMB.1.raw
  modified_base (165)..(165): a, c, t, g, unknown or other
  misc_feature (165)..(165): n is a, c, g, or t
tcagtagtgtagatcacgaccggtgctcgatttagacgacagctcagggcccatcggtcttccccctggcgccctgctccaggagcacctccgagagcacagccggccctgggctgactggtcaaggactacttccatctacactactgagcggctggcaaggcnatg

SEQ ID NO: 74282 - DNA, 589 bp, Homo sapiens
  misc_feature: GYAE6OF01EGNW4.37.22.B11.1.454.CMB.1.raw
  modified_base (225)..(225): a, c, t, g, unknown or other
  misc_feature (225)..(225): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (581)..(581): a, c, t, g, unknown or other
  misc_feature (581)..(581): n is a, c, g, or t
  modified_base (589)..(589): a, c, t, g, unknown or other
  misc_feature (589)..(589): n is a, c, g, or t
tcagtagtgtagatcacgaccggtgctcgatttagacgacagctcaggggtccctgagactctcctgtgcagcctctggattcaccttcagcagctatgccatgacctggtccgcaggctcagggaggactggagtgggtctcgtctattagtggaagtggtgcttatacaaactacgcagcctccgtgaagggccgctcaccatcctccagagactatccaagngcactctgtatctgacaaatgaacagcctgagtgccgnggacacggccttatattntgtgacgaaagtgggtggggaggtggggctactcgtggtggttttagactacggtcgggcgagggacgtcccgtggtccaccgtcctctccacgccctaccaccgaccggcctacgtcccggttacccttccccgtggtcccgtcccctacgtccctccgtaacggcgaccctacccgtacgagaccgcacgacggcccggccgacgggtctcccggtccgttacggacgaacgtacctaacccgttcaccttcaaccgcgttactcggaggtccgggtccgtacggacgaacggccganacgtagcn

SEQ ID NO: 74283 - DNA, 565 bp, Homo sapiens
  misc_feature: GYAE6OF01BZR88.37.22.B11.1.454.CMB.1.raw
  modified_base (534)..(565): a, c, t, g, unknown or other
  misc_feature (534)..(565): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattatgtgcgaaatggtggggggagtgggggctacgtcctggtcgttttgactacgtggggccagggacgccctggtccaccgtctcctcacgccctccaccgaacgggccccacgtccggttcccttccccccgtggcccgcccctcggcctccgaggcgccaccgtccgagacgccaacgacgcccgggcccgtggggcctcggccgttggtaccgaacgggtaccttacccgtcctaacttacctaaccaccgttaaccgtcggggaaccggtccgggggtaccttcggggaaccgtaaacggggcccgtagtaaacgtggcagcctnnnnnnnnnnnnnnnnnnnnnnnnnnnnnnnn

SEQ ID NO: 74284 - DNA, 669 bp, Homo sapiens
  misc_feature: GYAE6OF01EKXIK.37.22.B11.1.454.CMB.1.raw
  modified_base (666)..(666): a, c, t, g, unknown or other
  misc_feature (666)..(666): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactcgcagcctccgtgaagggccgcttcaccatctccagacgactattccaagagcactctgtatctgcaaatgaacagcctgagtgccgaggacaccggccctaatactttagttgtgacgaaagtgggtggggggagtggggctacgtcgtggtcgttttgactacgtcggggccaggggacgcccgtggtccaccggtcctcctccgacgtccctaccgaacccgaacgggcccctacgtccggttacccttcccccgtcggcccgtcccctcgcctccgacggaccgcctacccgtccggacggacgacccaaccgacggcccgggtcccgtcggggtcccgtccggtcccggttcgggttaacccggtaaacgggtaaccccttacccgttaccgtaaccttcccgtaaacctaacccgttacgtaccggacggggtccgggccgggtacgggtaccgaaaccggggccgaccggacgttaggntcg

SEQ ID NO: 74285 - DNA, 668 bp, Homo sapiens
  misc_feature: GYAE6OF01C1JIU.37.22.B11.1.454.CMB.1.raw
  modified_base (627)..(627): a, c, t, g, unknown or other
  misc_feature (627)..(627): n is a, c, g, or t
  modified_base (658)..(658): a, c, t, g, unknown or other
  misc_feature (658)..(658): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
tcagtagtgtagatcacgaccggtgctcgatttagacgacagctcaggggttcctgagactctcctgtgcagcctctggattcaccttcagcagctatgccatcgacctgggtccgccaggctccaggggagggactggagtgggtctcgtctattagtggaagtggtgcttatacaaactacgcagcctccgtgaacgggccgctcaccatctccagagactattccaagacgcactctgtactctgacaaatgaacagcctgagtgccgaggacgaccggtcctaattattattgtgacgtaaagtgggtaggggggtaggtcggggtctacgtccgtggtcgttttgacgttacgtgggaccgaggggtacgcccgtggtccgtacccgtcctccctcgacgtcccctacccgaacccgaacgggccctaacgttcccgggttcccctttcccccccggtgggcccccgtccccgttcggacccgttaccccggagggaccctcccgtaccccgtacggacgtactcccgaacgtaccgggcccggtcccgtcgggccttccgggccgttcgggtaacctaacgggtccttaaccttcccaacttacccgtaactaccgtacgngggtaccggcgggacctaggacgtcggtacntaacggngnc

SEQ ID NO: 74286 - DNA, 564 bp, Homo sapiens
  misc_feature: GYAE6OF01CM9HD.37.22.B11.1.454.CMB.1.raw
  modified_base (561)..(561): a, c, t, g, unknown or other
  misc_feature (561)..(561): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggcccctatattattgtgacgaaatggtgggggagtgggggctacgtcctggcgttttgactacgtgggccagggacgccctggtcaccgtctcctcacgcctccaccgaagggcccatccggtccttcccccgtggcccgcccctcgcctccgacggcgccgaccctccgagacgcacacggccggcccgtgggcctggcccgtggtaccgaacggtacctaccttccacgtccactaccgtacgtggacggccgggtctcgggaccgtaacgggccgacagtagnacg

SEQ ID NO: 74287 - DNA, 713 bp, Homo sapiens
  misc_feature: GYAE6OF01ADBGN.37.22.B11.1.454.CMB.1.raw
  modified_base (158)..(158): a, c, t, g, unknown or other
  misc_feature (158)..(158): n is a, c, g, or t
  modified_base (173)..(173): a, c, t, g, unknown or other
  misc_feature (173)..(173): n is a, c, g, or t
  modified_base (203)..(203): a, c, t, g, unknown or other
  misc_feature (203)..(203): n is a, c, g, or t
  modified_base (332)..(332): a, c, t, g, unknown or other
  misc_feature (332)..(332): n is a, c, g, or t
  modified_base (712)..(712): a, c, t, g, unknown or other
  misc_feature (712)..(712): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccaggggaaggactggagtgggtctcgtctattagnggaagtggtgcttanacaaactacgcagcctccgtgaacgggccncttcaccatctccagagacctataccaaagaaccacacttgtctctagacaatcgaacagcctagagagtcggaggacaccggtccttaatacttacgtgtagtacgaacggtcctctacgtcccttanacgcgacgcggtactcggtcctggttacgtttcggaccggtacgtcggggacccacggggtaacccgtggtaccgaccgttctaccctcgacgtccctacccgaaccgaaccgggtcccaccgttcccggttccccgtttcccccgtcggtccctaccccgttcccgtacccgaacggaccgcccgtaccgtccggtcggggacaccggacgggacccggtccccggtagggtcccgtccggtacccggttaccgggtccgtaaccggtaccgttaccgttaccgttaccgttacccgtaaccgtaaccgttacccgtacggtaccgggtacccgggtacggtaccgggaccggtacgggaacctccggtaacgtacggng

SEQ ID NO: 74288 - DNA, 707 bp, Homo sapiens
  misc_feature: GYAE6OF01A5HQI.37.22.B11.1.454.CMB.1.raw
  modified_base (177)..(177): a, c, t, g, unknown or other
  misc_feature (177)..(177): n is a, c, g, or t
  modified_base (241)..(241): a, c, t, g, unknown or other
  misc_feature (241)..(241): n is a, c, g, or t
  modified_base (312)..(312): a, c, t, g, unknown or other
  misc_feature (312)..(312): n is a, c, g, or t
tcagtagtgtagatcacgaccggtgctcgatttagacgacagctcaggaactgctcagttaggacccagacggaaccatggaagccccagcgcagcttctccttcctcctgctactcgtggcctcccagatatcacgtggaagaaatagtgatgacgcagtcctccagcccaccctntctgtcgtcctacgaggaagaacgcgcccacctctccgtggacggccagtcagtagttgttacnctaacacttagccgtaggaccagcaacgaacctggaccacggtccaggtccacactcattctagtggtacncctaacgtacccgacgaccgggcctacggtaccggtacctacccgtaacgtacccgttaacgttttaggacggtacgtacgggttcggggtacgtacggggaaccgtaagttaccggtttaccaacccgttaccgtaccaacctaagtacgacgtaccacgtcccgtagacgtaacgttagtaacgtaacgtttagtttcgacgtttaagtttacttacgtactacgaacgtagtaactaatcggacgttccgtacccttagtaccggtttacggttcgggaacgggtaacggaccgtaaggggtaaccaggtaaacgtaaccgaaaacggttcgtacggttacgacccgtagaccctaaccgtacgttaccgtactttcccgtaccgttacccg

SEQ ID NO: 74289 - DNA, 648 bp, Homo sapiens
  misc_feature: GYAE6OF01DN3RS.37.22.B11.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
  modified_base (648)..(648): a, c, t, g, unknown or other
  misc_feature (648)..(648): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccggtgaagggccncttcaccatctccagacgactattccaagngcacttctgtatctgactaaatgaacacgcctggacgtgaccggacggaccaccggtccccttaataatttattgtgtacgaaagttgggtggggggtagtgggggcttacgtcgtggtcgttttgactacgtggggaccaggggacgcccgtggtccgtaccggtcctcctcacgtccctaccgaacccgaacgggcccctagttcccggtccctttcccccgtagggtcccgccccttcggtccctacccgcgggaccgtcgtaccccgtcggacgtacgaccaccgacggtcccgggacccgttgggacccttcgggacccgttcgggacaacggtacttaccgtttaccactccgtaacctacgtacttggacggtccgggcgttgggaccgaaaggccggacacgtgcgn

SEQ ID NO: 74290 - DNA, 887 bp, Homo sapiens
  misc_feature: GYAE6OF01CRCXK.37.22.B11.1.454.CMB.1.raw
  modified_base (150)..(150): a, c, t, g, unknown or other
  misc_feature (150)..(150): n is a, c, g, or t
  modified_base (261)..(261): a, c, t, g, unknown or other
  misc_feature (261)..(261): n is a, c, g, or t
tcagtagtgtagatcacgaccggtgctcgatttagacgacagctcaggggtccctgagactctcctgtgcagcctctggatccaccttcagcagctatgccatgacctgggtccgccaggctccagggaaggactggagtgggtctcgtntattagtggaagtggtgcttatacaaactacgcacgcctccgtaggaacgggccgcttcaccatctccagagactatccaagagcactctgtactcgtagacaatagaacngtacctgaaggtcggaccggaacggaccacccggtcccttaattaacgtttagtttggtaggtaacggtaaaaggttggggtgggggggtaagggtcgggggtaccttacgtttccggttcgggtttcggttttttacggaaccgtttaccgggtcgggggtacccggtaacgggggtacccgtccccggttacggggttacccgttacccggtttccgtttccgtttacccgacccgggtaccccccgtttaaccccggaaaccccgggtaaaccggggtccccccgttaacggttttccccccgggtttacccccgttttcccccccccgggtacggggtccccccgttcccccggtttccggtaccccggttaacccggtaaccggggacccgtaccccgggtaaccccgttaccccgggaaacgaacccggtaccccgaaccggaccgggtccccgggtccccggtgggggtccccgttccgggtccggtttacgggttaaccgaaaccgggttacccttaccgttacccgtaacttacccgttaccgtaccgtttacggtagggtaccgggtacccgggtcgttacggggaaccgtacgggtacgtaccaaggtcgcgtag

SEQ ID NO: 74291 - DNA, 742 bp, Homo sapiens
  misc_feature: GYAE6OF01BF99F.37.22.B11.1.454.CMB.1.raw
  modified_base (175)..(175): a, c, t, g, unknown or other
  misc_feature (175)..(175): n is a, c, g, or t
  modified_base (209)..(209): a, c, t, g, unknown or other
  misc_feature (209)..(209): n is a, c, g, or t
  modified_base (240)..(240): a, c, t, g, unknown or other
  misc_feature (240)..(240): n is a, c, g, or t
  modified_base (740)..(740): a, c, t, g, unknown or other
  misc_feature (740)..(740): n is a, c, g, or t
tcagtagtgtagatcacgaccggtgctcgatttagacgacagctcagggggtccctgagactctcctgtgcagcctctggattcaccttcagcagctatgccatgacctgggtcccgccaggctcccgaggggaagggactgggagtgggtctcgtctattagtggaagtggtgnttatacaaactacgcagcctccggtgaagggccncttccaccatctccagagacttataccaagngcactctgtatctgacaaatgaacacgtcctgagtcggaccgaaggaccgacggacccttattactttagttgtcggacgtaaagttggggtacggggggaggtcgggggtctaccgtccggttggtccgttttggaccttacggtcggggaccgaggggaccgtcccgtcgggtaccctaccgtcctcccgttcgacgtcccctacccgaacccggaacgggtccccctaacggttccccgggttaccccgtttcccccccggtgggtccccgtcccccgtcggtcccgacccggtaacgggaccgacccgtacccgtacccggaacggtacccgcccgaacgcccggggcccggtcccggtcgggccccgttacgggccgttaccgggtacaaccgggttcccttaacccgttacccgactttccctaaacccgacgttaccggtcggaacgggcccgggtcggtaacgggaccgtaacgggccctaacgagtccggngc

SEQ ID NO: 74292 - DNA, 558 bp, Homo sapiens
  misc_feature: GYAE6OF01DT3FY.37.22.B11.1.454.CMB.1.raw
  modified_base (361)..(361): a, c, t, g, unknown or other
  misc_feature (361)..(361): n is a, c, g, or t
  modified_base (526)..(558): a, c, t, g, unknown or other
  misc_feature (526)..(558): n is a, c, g, or t
tcagtagtgtagatcacgaccggtgctcgatttagacgacagctcagggaagggactggagtgggtctcgtctattagtggagtggtgcttatacaaactacgcagcctccgtgaagggccgctttaccatctccagagactattccaagagcactctgtatctgcaaatgaacagcctgagtgccgaggacacggccctatattatgtgcgaaatggtggggggagtgggggctactcctggtcgtttttgactacgtggggccaaggggcgcccgtggtcacccggtcctcctcagccctccaccgaacgggcccagtccggtccttcccccgtggccgccctgacctccgaagggacnccacccgtccggagacgcaccgacggcccgggccccgtggggtctcggcccgttgggtaccaaacgggtaccttaaccttcccattaccctaaccgtaaccttaccgttcgggaacggtccgggggtacgttcgggaccgaaaacggggccgaccgtaacgtgcnnnnnnnnnnnnnnnnnnnnnnnnnnnnnnnnn

SEQ ID NO: 74293 - DNA, 172 bp, Homo sapiens
  misc_feature: GYAE6OF01A79KH.37.22.B11.1.454.CMB.1.raw
  modified_base (171)..(172): a, c, t, g, unknown or other
  misc_feature (171)..(172): n is a, c, g, or t
tcagtagtgtagatcacgaccggtgctcgatttagacgacagctcagggcccatcggtcttccccctggcgccctgctccaggagcacctccgagagcacagcggccctgggctgcctggtcaaggactacttccatctacactactgagcgggctggcaaggcgcatagnn

SEQ ID NO: 74294 - DNA, 701 bp, Homo sapiens
  misc_feature: GYAE6OF01EU5DB.37.22.B11.1.454.CMB.1.raw
  modified_base (94)..(94): a, c, t, g, unknown or other
  misc_feature (94)..(94): n is a, c, g, or t
  modified_base (127)..(127): a, c, t, g, unknown or other
  misc_feature (127)..(127): n is a, c, g, or t
  modified_base (165)..(165): a, c, t, g, unknown or other
  misc_feature (165)..(165): n is a, c, g, or t
  modified_base (277)..(277): a, c, t, g, unknown or other
  misc_feature (277)..(277): n is a, c, g, or t
  modified_base (511)..(511): a, c, t, g, unknown or other
  misc_feature (511)..(511): n is a, c, g, or t
tcagtagtgtagatcacgaccggtgctcgatttagacgacagctctagggggttcccggtgaggactctcctcgtgccaggcctactggattcnccgttcagcgaggcctatgcatcgcgtggtccncagctccagggaggctacggaggtcgggtactacggtntacgttagtcggaacgtggtcgccttatacaactacgtccacgtcctccgtgacggtcctcttcaccatctcagatctatcaagcgtacacgctatatcacgatactagacnctcgtgcgtacgacgacgacgacggtactactatactacgtacgtgaaagtcgttgggggggaacttcggggcttacgttaccgtttgggacgttttcgggacgtacctaggggtcccacggggtagaccccgtacgggtcctaccgtcgtacgttccgtaggtacccgtaccgaccttacgggcctacgtcccggttcttccccccgtacggtacccgtccccgtaccggtancccgtaccgacggacgtagcccgtacccgtaccggtacgtaccgtaccgtaaccgtaccgtacccggtacccgttacgggtaccgttacgtaccgttacgggtacgtaaccgtaccgttaccgtacccgtacgtaccgtacgtacgtacgtacggtacggacggtacgtacggacgacggtcggcgtacg

SEQ ID NO: 74295 - DNA, 904 bp, Homo sapiens
  misc_feature: GYAE6OF01E5JDJ.37.22.B11.1.454.CMB.1.raw
  modified_base (139)..(139): a, c, t, g, unknown or other
  misc_feature (139)..(139): n is a, c, g, or t
  modified_base (174)..(174): a, c, t, g, unknown or other
  misc_feature (174)..(174): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggaanaatagtgatgacgcagtcctccacgcccacccttntcgtgtgtcctaccgaaggaacgaaaagcgccctacccttctcccgtggtacgggcctaaggtcaaggtagttaggttaacgaccttaacaacgtttacgccgttaggtaaccacggccaacggaaaaccgttcggaccgtaccgggttacccaaggtcctaccgtaactactaacgttaccttaggtacgggttcaacctaaccgtacccgaacccggaccggggaccctaacgtttcgggtaaccctcccgtaacggtacctttaaccggtttaggccggtagtaacgggtgggtacgttagggactaggtacgttcacgttctaccactacgtacgacgacgacgtcctggactaacgttcgtaacggtaagtttacgtttactaaccgtttaactttaacgtttacttaaccgggtacctaaccggtacctttaaacggtttaacgttaacggggttaacgggggtaacccgttaaccgggttttaacccccggggggacggggtaaaacccggggttacccggggtttaaaggggttaacgtaaaccggggttaaaaccttaaccggttaaaaaaaccgggggtaccgtttaggggtaaacccgggttaaccggaccggtaaacccccgttaaaccgttccggttttaaccgttaccccgggttttttacccttaaccccggtttaaccccgtttttcccccggtaaaccccccggttaacccgg

SEQ ID NO: 74296 - DNA, 753 bp, Homo sapiens
  misc_feature: GYAE6OF01CSXAZ.37.22.B11.1.454.CMB.1.raw
  modified_base (704)..(704): a, c, t, g, unknown or other
  misc_feature (704)..(704): n is a, c, g, or t
  modified_base (750)..(750): a, c, t, g, unknown or other
  misc_feature (750)..(750): n is a, c, g, or t
tcagtagtgtagatcacgaccggtgctcgatttagacgacagctcaggggtccctgagactctcctgtgcagcctctggattcaccttcagcagctatgccatgacctgggtcccgccaggctccgaggggaagggctggaggtgggtctcgtctattagtggaagtggtgcttatacaaactacgcagcctccgtgaagggcctctcaccatcctccagacgactatccaaagcgctacttctagtattctagacaaaattacgaaacacgcccttggaacgtcggacccggaaggaaccgaccggtaccccttaattaactttaagttgtaggaacgtaaaggtgggtaggggggggaggtcgggggccttaccggttcgtgggttacgttttacgacgttacggtcggggaccgaacggggacgtccccgtagggtccccaccggttcccgtcccgtccgtaccggtcccctaccgaaacccggaccgggtccctaaccggtttcccggtcccgtttacccccccgtgggacccgtcccccttaccggtccttacccggaacggccgtaccgaccccgttaccggacgaccggaccgaaccgaccgggacccgggtccggtccggggtaccgttccggtacccggtagggttacccgaacggtacttacccgtaccgtactaccgtactaaccgttacggnggtaaccgggcggtaccgtcgggactaaccgggacgattacgagtnacg

SEQ ID NO: 74297 - DNA, 787 bp, Homo sapiens
  misc_feature: GYAE6OF01EZXOU.37.22.B11.1.454.CMB.1.raw
  modified_base (139)..(139): a, c, t, g, unknown or other
  misc_feature (139)..(139): n is a, c, g, or t
  modified_base (167)..(167): a, c, t, g, unknown or other
  misc_feature (167)..(167): n is a, c, g, or t
  modified_base (455)..(455): a, c, t, g, unknown or other
  misc_feature (455)..(455): n is a, c, g, or t
  modified_base (719)..(719): a, c, t, g, unknown or other
  misc_feature (719)..(719): n is a, c, g, or t
tcagtagtgtagatcacgaccggtgctcgatttagacgacagctcaggaactgctcagttaggacccagacggaaccatggaagccccagcgcagcttctcttcctcctgctactctggctccagatactcactggganaaatgtgatgaccgctacgtcctccacncccaccctctctggtcgtacctacgaggaagaaagccgccctacccttcgtcctaggtacgggcctagtacgaaggtgttagtagacctaacgtaaacgttcgccgttacggaaccacgtactaacggaaaccgtcgggtcccgtaacgggttcccgaacggtcctaccacttactacgttccttaaggtcgggtcctaacctaaccgtacccgtaaccgggaccgggtaccctaaccgttacggtaacccgtacccctaaccggtacccgttaaccgttttaacggnggtacccggtaagggttccggggtacggtaaacgggtacgtaacggttacgttaccctacttacccgtacctaacgtactacggacgaccgtaccggtcctaacgcgtacggtacgtaaggtaagtttaccgtttgaacgtttaacgtttacttaccgtaagtaaccgtaaaccgttaagtaacgttaagtacggttaccgtacggttccttaccgtagtttacccggttaacgggcggtaaacggtacggtaaggtacggtanaaccggtaaacgaacggtacgtggtactacctcgaaccttcggaacttgttccttactccgttacccg

SEQ ID NO: 74298 - DNA, 597 bp, Homo sapiens
  misc_feature: GYAE6OF01EEYJE.37.22.B11.1.454.CMB.1.raw
  modified_base (561)..(563): a, c, t, g, unknown or other
  misc_feature (561)..(563): n is a, c, g, or t
  modified_base (565)..(567): a, c, t, g, unknown or other
  misc_feature (565)..(567): n is a, c, g, or t
  modified_base (569)..(597): a, c, t, g, unknown or other
  misc_feature (569)..(597): n is a, c, g, or t
tcagtagtgtagatcacgaccggtgctcgattttagacgacagctcagggaagggactggagtgggtctcgtctattagtggaagtggtgcttatacaaactacgcagcctccgtgaagggcccgcttcaccatctccagagactattccaagagcactctgtatctgcaaatgaacagcctgagtgccgaggacacggccctatattattgtgcgaaagtggtggggggagtgggggctactccgtggtcgttttgactacgtggggccgaggcgtccgtcggtccaccgtctcctcgaccgccctaccgaacccgaccggccctacgttcccggttccccgttccccgtcggcccgtcccgtcgcccgtaccgacggaccgacccgtaccgtaccgacgaccgaccgaaccggcggcccgggtcccgtcgggccgtccggtccggtacgggtaccgtaaccggttaccttaacccttaccgtacttaccgtaaccgtaaccgttaccggtacgggccgggtacgggtcgtacgggaaccgacgggaccgacgtagtacnnncnnngnnnnnnnnnnnnnnnnnnnnnnnnnnnnn

SEQ ID NO: 74299 - DNA, 174 bp, Homo sapiens; identical to SEQ ID NO: 74223
  misc_feature: GYAE6OF01CICJM.37.22.B11.1.454.CMB.1.raw
  modified_base (170)..(174): a, c, t, g, unknown or other
  misc_feature (170)..(174): n is a, c, g, or t

SEQ ID NO: 74300 - DNA, 178 bp, Homo sapiens
  misc_feature: GYAE6OF01E0BEY.37.22.B11.1.454.CMB.1.raw
  modified_base (170)..(178): a, c, t, g, unknown or other
  misc_feature (170)..(178): n is a, c, g, or t
tcagtagtgtagatcacgaccggtgctcgatttagacgacagctcagggcccatcggtcttcccctggcgccctgctccaggagcacctccgagagcacagcggccctgggctgcctggtcaaggactacttccatctacactactgagcgggctggcaaggcgcatagnnnnnnnnn

SEQ ID NO: 74301 - DNA, 727 bp, Homo sapiens
  misc_feature: GYAE6OF01DTWOG.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctcccagatatcactggaagaaatgtgatgacgcagtctccacgccctaccctctctgtcgtctcgaaggaagaaagcgccctaccgtctccgtaggtacgggacctagtacaggtacgttgtacgtcctaactaacgttacgccgtacggtaccaggacctaacgtaaaccgcggtaccctaccggttcccgaggtcctcgatccacgttcgtaagttcgggtcacctacctaccgaccggacgggtcctacgtcgtacctcccacgtaccttacgtttgcggctaggggtcggtacgacggactacgtacgtccacttccgcctaccagtcgacgacacgtccgtgtacctacgtatacgtaacgttagttttcgaccgttttaagtttacttaagtccgtaacgtaacgttacgtaactacggttctaaccgttccgtacccgtttaccgttacggttaccgggtttacccggggaagggttaaccgggaacgtttagggaaccggtaaagtaacccgttaaaacggtaacggtaacgttcggttaacgggcgttaaccgaccgttaacttcgttaaccgttcggtttcccttcgttaacccccg

SEQ ID NO: 74302 - DNA, 1016 bp, Homo sapiens
  misc_feature: GYAE6OF01CICI4.37.22.B11.1.454.CMB.1.raw
  modified_base (1013)..(1013): a, c, t, g, unknown or other
  misc_feature (1013)..(1013): n is a, c, g, or t
tcagtagtgtagatcacgaccggtgctcgatttagacgacagctcaggggtccctgagactctcctgtgcagcctctggattcaccttcagcagctatgccatgaccgtgggtccgccaggctccgaggggaagggacgtggaggtgggtctcgtctattaggtggaagtgggtgtcttataacaaactacgcagtccttccggtaggaacggggcccgtcttaccaccactcctacccgaaggacgtaaccttaactttacccaaaggagtacccaaccttccttaggttacttctacgaactaaaatacggaaacgacgccgtaggtaaggtcgggacccggtaacgggaaccgtaccccgggtaccccttaagtttaacgttttagttttacgggtacgggtaagggttaaaacggggtggggggggttacggggggggggtacgggggttacgggggggttccccgttttaaacccggttccggggttttcggggtttacgggttttttacgggtaacccggtttaccgggggtacggggggtaccccggtaacggggggtacccggtccccggtttaccgggtcccggttaccccgtttcccgtccccgtaccgtacccggtacccccgtacccgaacccggaacccgggtcccttacccggttccccggggtttaccccctttccccccggggtccggggtcccccggttcccccgttaccgggtaccccgttacccggggacggtacccggtaccccggtaccccgtaacccgggtaccgggaacccggttaccccggaaccgggccccggggtttaccccgggccccgggtttcgggggtcccgttacccggggtcccgggttaccgggtaaccggttaaacccgggttaccccttaaccgttcccgtaaccgttacccttaaccgttaacccggtaacgggttcgggaacggggtcccgggtacgggtccggtaaccggggtacccggacggacagggtccggnacg

SEQ ID NO: 74303 - DNA, 792 bp, Homo sapiens
  misc_feature: GYAE6OF01EP4VT.37.22.B11.1.454.CMB.1.raw
  modified_base (201)..(201): a, c, t, g, unknown or other
  misc_feature (201)..(201): n is a, c, g, or t
tcagtagtgtagatcacgaccggtgctcgatttagacgacagctcaggggtccctgagactctcctgtgcagcctctggattcaccttcagcagctatgccatcgacctgggtccgccaggctccgagggaagggactggagtggtctcgtctattagtggagtggtgtcttatacaactacgcagcctcgtgaacggccncttaccaccatcctaccgagacgtaacttacttccaagacgccacttctgttactctagactaaatcgaacacgcctaggagtcggaccggaacggaccgaccggtaccctttaagttacttttaggttaggtacggtaacggtaaagggttgggggttagggggggacgggttcggggggtaccttacccgttaccggttcgggtttaccggtttttacggaaccgttacggggtcgggggaccggtaacggggtacccgtcccggttcggttccccgtaacccggttccttacccgttacccgaccgtaccccgtacccgaacccgggaaccggtccccgtacgttccccggtttaccccgtccccccggtggtacccccgtccccgtcgacccgtaccggtacgacccgtaccctacccggtaaccggacggaccgtaccgaaccggaccgggccgtccccgggtgggaccgtccggtaccggttacggtaactaaccggttaccgttacctaccgtacgttacctaacctacggtacgttagggaccggtccgggacttgggaacccgtacggaccgatacgtgcag

SEQ ID NO: 74304 - DNA, 686 bp, Homo sapiens
  misc_feature: GYAE6OF01DPSS7.37.22.B11.1.454.CMB.1.raw
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaacggccgcttcaccatctccagagactattccaagacgcactctgtatcgtcgacaatgaacagcctgagtcgccgaggacacggcccttatattacttgtagacgaagtgggtgggggaggtggggactaccgtcgtcggtcgtttgacgtacgtcgggccaggggacgcccgtggtccgaccgtcctccgtcgacgtcctcccgaccgacgggtccctacgttcccgggttccctttcccccggtacggtcccgtccccgttcgcccgttcccgacgggtaccgcccgtacccgtccggaaggccgaccgaccgacgggtcccggtacccggtcgggccgttccgggccgttacgggtaccgaacgggtacccttaccgttaccctacgttaccctaacccgtaaccgttaccggtcgggtaaccgggtcccgggtaccgggtacgggtaccggtaaacgggtccccggtaagtaacggttagccgagg

SEQ ID NO: 74305 - DNA, 695 bp, Homo sapiens
  misc_feature: GYAE6OF01AWG17.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagcccaccctctctgtgtcctccaggagaaagacgcccaccctctcctggtacgggccagtcagagtgttagctacaacttagcctggtaccagcaacgaaccgtcggccacggttcccaggtctacatcatctagtggtcgctactccgaccgagggccctaactcggtacctccccagacccttaccgtttaggcggtacgtaggttcgggtacgtacgggtaacagtacgttctacctacctacaccctagtccacgccgacgtccctacgtccgtacggttacgtaaggtaaacgttacgtttttaggaccttttaaggtttttaacgtttacctacggttaaacccaacgtaaggttaacctaagttcggtaaccgttaccgtcccttacgtttccgttaacccggtttcgggaacccggggtaacgggtaaccggtaaggggtacggtaagtaaaccgtacggaaaccggttacgtcgggtcgacgttacgacccgtaccttacgttcttacggtttcctcgttacccg

SEQ ID NO: 74306 - DNA, 581 bp, Homo sapiens
  misc_feature: GYAE6OF01EM6MF.37.22.B11.1.454.CMB.1.raw
  modified_base (351)..(351): a, c, t, g, unknown or other
  misc_feature (351)..(351): n is a, c, g, or t
  modified_base (547)..(547): a, c, t, g, unknown or other
  misc_feature (547)..(547): n is a, c, g, or t
  modified_base (550)..(581): a, c, t, g, unknown or other
  misc_feature (550)..(581): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgacaaatgaacagcctgagtgccgaggacaccggccctaagtattattgtgacgaaagtggtgggggggagtgggggcttaccgtcctggtcgttttgacgtacgtggggccagggacgcccgtggtccaccgtctcctcacgccctaccaccgaacgggccccaagtccggttcccttcccccgnggcccgtcccgtcgcctccgaacgggacgtaccaaccgtccgagaacgccaaccgacgccgggtacccgtgggcctcggtccgttgggtaaccgaaaacggtaccttaaccgttacccgtaattaccgtaactaaccgtaacgttacgggacgggccggggtacgtcgggaacgaaagggccgaacgaatagcgancgnnnnnnnnnnnnnnnnnnnnnnnnnnnnnnnn

SEQ ID NO: 74307 - DNA, 754 bp, Homo sapiens
  misc_feature: GYAE6OF01CXZMS.37.22.B11.1.454.CMB.1.raw
  modified_base (182)..(182): a, c, t, g, unknown or other
  misc_feature (182)..(182): n is a, c, g, or t
  modified_base (583)..(583): a, c, t, g, unknown or other
  misc_feature (583)..(583): n is a, c, g, or t
  modified_base (751)..(751): a, c, t, g, unknown or other
  misc_feature (751)..(751): n is a, c, g, or t
  modified_base (754)..(754): a, c, t, g, unknown or other
  misc_feature (754)..(754): n is a, c, g, or t
tcagtagtgtagatcacgaccggtgctcgatttagacgacagctcaggggtccctgagactctcctgtgcagcctctggattcaccttcagcagctatgcatgaccgtgggtccgccgaggctccgaggggaagggactgggagtcgggtcttcgtcttagttagtaggaagtggtgcttanacaactacgcagcctcgtgacggccgtctcaccatctacagacgtactattaccgaagacgcactcgtagtactctgactaaagtacgaacgacgaccgtgaggtaccgacggaacggaccgaccggtacctaagttactttagttacggtcggacggtaaagttcggggtaggggggtacggttgggggacttaccggtccggtacggttacgttttcggtacttaaccgggtggggtacccgacggggtacgcccgttcgggtaccctacccggttcctacccgttacgacgtaccccgtaccgaaccggtaacccgggaccgttaccggttcccggttacccgttccccccgtacgggtccccgtccccgttacggcccgttaccggacgggtaaccncccggtaccgtaccgacgacgtaccgacggacccgtaccggtcccgtacggccggtacgcccggttacgggtacgtaacctaccgttaacccgttctaaccgtcgttaaccctacggtacgtaaggacggccgggtacgggtacgaaccggtacggacgaacagtcgngtn

SEQ ID NO: 74308 - DNA, 669 bp, Homo sapiens
  misc_feature: GYAE6OF01ELKAQ.37.22.B11.1.454.CMB.1.raw
  modified_base (667)..(667): a, c, t, g, unknown or other
  misc_feature (667)..(667): n is a, c, g, or t
tcagtagtgtagatcacgaccggtgctcgatttagacgacagctcaggggtcccttagactctcctgtgcagcctctggattcaccttcagcagctatgccatcgacccttcgggtccgccaggcctccgaggggaagggactgggagtgggtctcgtctattagtggaagtggtgctttatacaaactacgcagcctccgtgaacgggtccgcttcaccatcctccagagactattaccaagagctactctgtactctagacaatgaacacgtccgtgagtcgaccggacgaccaccggcctaattaattatgtagacgtaaagtggggtagggggaggtcggggtactaccgtcgttggttacggttttgacgttaccggtcgggacgagggcgccgtggcctacgtctccacgacgccctaccgaacgacggtccctacgtcccgttacctccccgtcggcccgtccctcgcctaccgacggtaccacccgtacccgtccggaccgtacggacccgaacgacccggtccgggtacccgtcggggtacctcgggtcccgtacgggttacctaaacggtacccgtaccgttaccacgttaacctacccgtacgtaccgtcgggaggtaccggtcgacgggtaacgaccggtacactacgtgccgtncg

SEQ ID NO: 74309 - DNA, 757 bp, Homo sapiens
  misc_feature: GYAE6OF01ARAJ1.37.22.B11.1.454.CMB.1.raw
  modified_base (173)..(173): a, c, t, g, unknown or other
  misc_feature (173)..(173): n is a, c, g, or t
  modified_base (209)..(209): a, c, t, g, unknown or other
  misc_feature (209)..(209): n is a, c, g, or t
  modified_base (753)..(753): a, c, t, g, unknown or other
  misc_feature (753)..(753): n is a, c, g, or t
  modified_base (755)..(755): a, c, t, g, unknown or other
  misc_feature (755)..(755): n is a, c, g, or t
  modified_base (757)..(757): a, c, t, g, unknown or other
  misc_feature (757)..(757): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccgaggggaaggactggagtgggttctcggttctattagtggaagtggtgnttatacaaaacgtcgcagtcctccgtgaacgggccncgttccaaccgatcctcccaaggacgtacttacttccaaagctcgtaactccgtagtacttctacggactaaataggaaccagcccgttggagttccggaccggaggaacctaccggtccccttaagttagttttacgttaggttcggaacgtaaagtggggtaggggggacggtcggggtacttacgtcgtcggttggttttcgacttaccggtgggccgagggtacgtcccgtggtcccgtacccgttctcccgtccacgtacccctacccgaaccggaccgggtaccccctagttcccggtttacccctttccccccgggaggttcccccgccccgttacggtcccgttacccgaacgggtaccctcccgaaaccccggttacccggagaaccgttaccgaccgtaacgggccccggtaccggtcggggtcctaccgggtcccggtaaggttacccggaacgttaccttaacccgtataccgtccttaaacccgcctaggcgttagggaccccggtgtaccgaagtcggaccctagtacgngngn

SEQ ID NO: 74310 - DNA, 680 bp, Homo sapiens
  misc_feature: GYAE6OF01BKU42.37.22.B11.1.454.CMB.1.raw
  modified_base (138)..(138): a, c, t, g, unknown or other
  misc_feature (138)..(138): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactgganaaatagtgatgacgcagtcctccagcccaccctctctgtgtctccgaggagaaacgcgcccaccctctccgtggtacgggccagtcaggtagtgttacgctactaacttcgcctggtaccagacaacgaaaccgtggaccgtacggttcccgaggtcctcatcctagttctagtcggtcgacactcccgaccgacgggcctacgtcggtacctcccgacgtaccgtaggttcgaggtcggcgtaggtcggggtcgtagggactacggtacttccgacctcctaccactagtccgacgaccgtacgtccgtcggtacgtcgttacgtagtaacgtttagttttacgagtttgtttttaacgttcgtacggtactatagttaacttaattaacgttcgtccgtacccgttacggtacggttacgggtaccgttacggaaacccggttaagggaaccgtaaaggggaaaccgttaactaaacggtaaacggttacgttgggtaccggtacgtacgaacctagtagtttacttcggttccttaccg

SEQ ID NO: 74311 - DNA, 170 bp, Homo sapiens; identical to SEQ ID NO: 74221
  misc_feature: GYAE6OF02GPGOR.37.22.B11.1.454.CMB.1.raw
  modified_base (170)..(170): a, c, t, g, unknown or other
  misc_feature (170)..(170): n is a, c, g, or t

SEQ ID NO: 74312 - DNA, 174 bp, Homo sapiens
  misc_feature: GYAE6OF02G1DCT.37.22.B11.1.454.CMB.1.raw
  modified_base (170)..(174): a, c, t, g, unknown or other
  misc_feature (170)..(174): n is a, c, g, or t
tcagtagtgtagatcacgaccggtgctcgatttagacgacagctcagggcccagtcggtcttccctggcgccctgctccaggagcacctccgagagcacagcggccctgggctgcctggtcaaggactacttccatctacactactgagcgggctggcaaggcgcatagnnnnn

SEQ ID NO: 74313 - DNA, 427 bp, Homo sapiens
  misc_feature: GYAE6OF02IF6UQ.37.22.B11.1.454.CMB.1.raw
  modified_base (424)..(427): a, c, t, g, unknown or other
  misc_feature (424)..(427): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtgggggagtgggggctactcctggcgttttgactactggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnn

SEQ ID NO: 74314 - DNA, 182 bp, Homo sapiens
  misc_feature: GYAE6OF02IT5TO.37.22.B11.1.454.CMB.1.raw
  modified_base (170)..(182): a, c, t, g, unknown or other
  misc_feature (170)..(182): n is a, c, g, or t
tcagtagtgtagatcacgaccggtgctcgatttagacgacagctcagggcccatcggtcttcccctggcgccctgctccaggagcacctccgagagcacagcggccctgggctgcctggtcaaggactacttccatctacactactgagcgggctggcaaggcgcatagnnnnnnnnnnnnn

SEQ ID NO: 74315 - DNA, 182 bp, Homo sapiens; identical to SEQ ID NO: 74314
  misc_feature: GYAE6OF02HC7T9.37.22.B11.1.454.CMB.1.raw
  modified_base (170)..(182): a, c, t, g, unknown or other
  misc_feature (170)..(182): n is a, c, g, or t

SEQ ID NO: 74316 - DNA, 170 bp, Homo sapiens; identical to SEQ ID NO: 74221
  misc_feature: GYAE6OF02GMW40.37.22.B11.1.454.CMB.1.raw
  modified_base (170)..(170): a, c, t, g, unknown or other
  misc_feature (170)..(170): n is a, c, g, or t

SEQ ID NO: 74317 - DNA, 528 bp, Homo sapiens
  misc_feature: GYAE6OF02I4P9M.37.22.B11.1.454.CMB.1.raw
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattactgtacgaaaatggcctacggatatgactactattggtactggtacttcgatctctggggcctggcacctggtcactgtctcctcagcctccaccaagggccccatccggtcttcccctggccgccctgctcccaggacgccacctccgagacgccacgacgccggccctggggcctcggccctgggtccaagggcctaccgttccattcctacactactggacgccgggctcgggcaggcg

SEQ ID NO: 74318 - DNA, 172 bp, Homo sapiens
  misc_feature: GYAE6OF02H9BFE.37.22.B11.1.454.CMB.1.raw
  modified_base (171)..(172): a, c, t, g, unknown or other
  misc_feature (171)..(172): n is a, c, g, or t
tcagtagtgtagatcacgaccggtgctcgatttagacgacagctcagggcccatcggtccttcccctggcgccctgctccaggagcacctccgagagcacagcggccctgggctgcctggtcaaggactacttccatctacactactgagcgggctggcaaggcgcatagnn

SEQ ID NO: 74319 - DNA, 523 bp, Homo sapiens
  misc_feature: GYAE6OF02G0VQS.37.22.B11.1.454.CMB.1.raw
  modified_base (520)..(523): a, c, t, g, unknown or other
  misc_feature (520)..(523): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctacgtcctggtcgttttgactacgtgggccaggggagccctggtcaccgtctcctcacgcctccaccaacgggcccagtccggtcttcccccgtggccaccctcctccaacgacgccacctcgtggggcacgacgcggccctgggctcgccgtggtcaaggactactccatctacactactgacgcggctggcaaggcgcatagnnnn

SEQ ID NO: 74320 - DNA, 508 bp, Homo sapiens
  misc_feature: GYAE6OF02GWLUM.37.22.B11.1.454.CMB.1.raw
  modified_base (428)..(428): a, c, t, g, unknown or other
  misc_feature (428)..(428): n is a, c, g, or t
  modified_base (445)..(445): a, c, t, g, unknown or other
  misc_feature (445)..(445): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (502)..(502): a, c, t, g, unknown or other
  misc_feature (502)..(502): n is a, c, g, or t
  modified_base (507)..(508): a, c, t, g, unknown or other
  misc_feature (507)..(508): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctacgtcctggtcgttttgactacgtgggccagggacgccctggtcaccgtctcctcagcctccaccaacgggcccagtccggtccttcccccgtggccgccctgcctccaggcnccacctccgagcgcacngccgcctgggctgcctggtcaaggctactcatctacnctcngagcggctggcaggcncatgnn

SEQ ID NO: 74321 - DNA, 525 bp, Homo sapiens
  misc_feature: GYAE6OF02F31FZ.37.22.B11.1.454.CMB.1.raw
  modified_base (504)..(504): a, c, t, g, unknown or other
  misc_feature (504)..(504): n is a, c, g, or t
  modified_base (520)..(520): a, c, t, g, unknown or other
  misc_feature (520)..(520): n is a, c, g, or t
  modified_base (524)..(525): a, c, t, g, unknown or other
  misc_feature (524)..(525): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctactccgtggcgttttgactacgtgggccaggggagccctggtcaccgtctcctcacgcctccaccaagggcccagtccggtccttcccccgtggccgcccctgcctcccgaggcgccacctccgagacgcacacgccggccctgggcctcgcccttgggtccaaggacctacttccatctacactacngagcggctggcaggcnatgnn

SEQ ID NO: 74322 - DNA, 170 bp, Homo sapiens; identical to SEQ ID NO: 74221
  misc_feature: GYAE6OF02G1E9L.37.22.B11.1.454.CMB.1.raw
  modified_base (170)..(170): a, c, t, g, unknown or other
  misc_feature (170)..(170): n is a, c, g, or t

SEQ ID NO: 74323 - DNA, 465 bp, Homo sapiens
  misc_feature: GYAE6OF02F2P1D.37.22.B11.1.454.CMB.1.raw
  modified_base (438)..(438): a, c, t, g, unknown or other
  misc_feature (438)..(438): n is a, c, g, or t
  modified_base (443)..(465): a, c, t, g, unknown or other
  misc_feature (443)..(465): n is a, c, g, or t
tcagtagtgtagatcacgaccggtgctcgatttagacgacagctcaggggaagggactggagtgggtctcgtctattagtggaagtggtgcttatacaaactacgcagcctccgtgaagggccgcttcaccatctccaggagactattcctaagagcactctgtatctgcaaatgaacagcctgagtgccgaggacgacggccctatattattgtgcgaaatgtggggggagtgggggctactcctggcgttttgactacgtggggggccagggacgccctggtcaccggtctcctcagcctccacccaagggccccactcggtccttcccccgtggccgccctgctccaggcgcacctccgagagccacgagcggcctggggctgcctggtcaaggactacgttccatcctacactactgagcgggctggcaaggcncatgnnnnnnnnnnnnnnnnnnnnnnn

SEQ ID NO: 74324 - DNA, 681 bp, Homo sapiens
  misc_feature: GYAE6OF02IDMC1.37.22.B11.1.454.CMB.1.raw
  modified_base (603)..(603): a, c, t, g, unknown or other
  misc_feature (603)..(603): n is a, c, g, or t
  modified_base (607)..(607): a, c, t, g, unknown or other
  misc_feature (607)..(607): n is a, c, g, or t
tcagtagtgtagatcacgaccggtgctcgatttagacgacagctcagggtaagggacctaggagtcgggtctcggtctatttacgtggaagtggtgcttactacaaactacgcagcctccgtgaagggccgcttctaccagtctccagagactattaccaagagccactcctgtatctagcaaatgaacagcctgagtgccgaggacacggcccgtatagttattgtgcgaaatgtggggggatggggctactccgttggcgttttgactactggggcctagggagcccgtggtcgaccgttctcctacgacgtcctccaccgaagggccccaagttccgggtccttccccccgtggccgaccccgtaggccttcccgaaggacgccgaaccctccggaagtacgccgaccaggaccggccccgtggggcccttacggcccgttgggtaccaaacgggtacccttaaaccgtttacccaacgttaccgttaacccgtaaccgtttaaccgtacggtaacggacccgggggtaccgttacggggaaccgtaaacggggaccggtaccgaaacgttaacggccacgactagtacgtgtcgcgcgngcgngtagtagtcgacgtactactatatacgtacgtcgtacgtcgtacgacgagacgacgacgtacgtcgtccgcgcg

SEQ ID NO: 74325 - DNA, 569 bp, Homo sapiens
  misc_feature: GYAE6OF02JYEAI.37.22.B11.1.454.CMB.1.raw
  modified_base (150)..(150): a, c, t, g, unknown or other
  misc_feature (150)..(150): n is a, c, g, or t
  modified_base (279)..(279): a, c, t, g, unknown or other
  misc_feature (279)..(279): n is a, c, g, or t
  modified_base (294)..(294): a, c, t, g, unknown or other
  misc_feature (294)..(294): n is a, c, g, or t
  modified_base (341)..(341): a, c, t, g, unknown or other
  misc_feature (341)..(341): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(569): a, c, t, g, unknown or other
  misc_feature (539)..(569): n is a, c, g, or t
tcagtagtgtagatcacgaccggtgctcgatttagacgacagctcagggaagggactgggagtgggtctcggtctattagtggaagtggtgcgttatactaaactacgcagccctccgtgaagggccgcttcacccatctccagagactnttccaagagcactctgtatctgcaaatgaacagcctgagtgcccgaggacacggccctatattattggtgcgaaaatgtggggggagtgggggctactccgtggcgttttgactctggggccagggtcnccgtggtcaccggtntccctcagccctccaccgaagggccccaagtccggtccttcccccgnggggcccgccccgttggttccccgaggggacnccgtaccgtccggaggaacncgaacctacgggccgtccccgtgggggtcctggccctggggtaccaacgggtacccttaaccgtttccgaacttccgtaaccgtaaccttaaccgtggtaacggccgggtacctgggacaacggcgtcaaagtgcacacgtnancnnnnnnnnnnnnnnnnnnnnnnnnnnnnnnn

SEQ ID NO: 74326 - DNA, 508 bp, Homo sapiens
  misc_feature: GYAE6OF02GXI7V.37.22.B11.1.454.CMB.1.raw
  modified_base (476)..(476): a, c, t, g, unknown or other
  misc_feature (476)..(476): n is a, c, g, or t
  modified_base (500)..(500): a, c, t, g, unknown or other
  misc_feature (500)..(500): n is a, c, g, or t
  modified_base (506)..(508): a, c, t, g, unknown or other
  misc_feature (506)..(508): n is a, c, g, or t
tcagtagtgtagatcacgaccggtgctcgatttagacgacagctcaggggtcccttagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatcggtcttcccctggcgccctgcctccaggacgcacctccgagagccacagcggccctgggcctgcctggtcaagactactccatctacnctactgagcgggctggcaacggcncatagnnn

SEQ ID NO: 74327 - DNA, 515 bp, Homo sapiens
  misc_feature: GYAE6OF02F9HKL.37.22.B11.1.454.CMB.1.raw
tcagtagtgtagatcacgaccggtgctcgatttagacgacagctcagggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctcggcgccctcgcctccaggacgcacctccgagagcacagcggccctgggctgcctgtcaaggactacttccatcgtacactactgagcggctggccaaggcgcatacg

SEQ ID NO: 74328 - DNA, 507 bp, Homo sapiens
  misc_feature: GYAE6OF02HI0IA.37.22.B11.1.454.CMB.1.raw
  modified_base (196)..(196): a, c, t, g, unknown or other
  misc_feature (196)..(196): n is a, c, g, or t
tcagtagtgtagatcacgaccggtgctcgatttagacgacagctcgaagggaactgctcagttaggacccagacggaaccatggaagccccagcgcagcttctcttccctcctgctactctggctcccagatatcgactggagaaatagtgatgacgcagtctccagccaccctctctgtgtctccaggagaaagngcccaccctctcctgtagggccagtcagagtgttagctacaacttagcctggtaccagcagaaacctggccaggttcccaggctcatcatctatggtgcatccaccagggccactggtatccccagccctacctttagtggcaggtgggtctggggacagagttcactctcaccatcagcacgcctgcagtctagaagtatttgctagtttattactgtacaacagtacaatgactggcctctctacgtttcggcggaggaccgagggtgagtatacgaaacgactggtgctgcaccatcgtgttctctac

SEQ ID NO: 74329 - DNA, 847 bp, Homo sapiens
  misc_feature: GYAE6OF02J391B.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctccagatatcacgtggaagtaaatagtgatcgacgctacgtcctccacgccctaccctctcgtgtcgtacctaccgaagggaacgaaacgccgccctacccgttcgtccgtagggtaccgggacctaggttaccgaaggtaggttacgttacgaccttaaaccgtaacgtttacggccgttacggtaacccagaccgaacgtaacccgtcgggacctacggttccccgaggtctactactacgtacttccgtagtcggtacgacctacgtacccggaccggtacggtacctaccgttcgggtaacctcccgtacgttacccgttaacggtttagggcggacgtacgggttcggggtacgtacgggaactacggtacgttacctaccgtacctaccaaccgtacgtccgacggtacctacggtaccgttaggtacgttaacggttacgtttaacggttaaacgttttacttttaccggaacgttttaacggttttacttaaccggtaacgttaaaccgtaaccgttaacggttaacctacggttacggttacccgtccggttacccgttacgttaaccgggttaccgggttaacgggggaccgtaaacgggtaaccgtaagggtaccggtactaccggtaacggaaacccggttggtaccggttaccgtaccgtaccgtacccttaccgttaccgtttccgttaccgttaccgttacccttaccccgg

SEQ ID NO: 74330 - DNA, 601 bp, Homo sapiens
  misc_feature: GYAE6OF02GLWYD.37.22.B11.1.454.CMB.1.raw
  modified_base (344)..(344): a, c, t, g, unknown or other
  misc_feature (344)..(344): n is a, c, g, or t
  modified_base (380)..(380): a, c, t, g, unknown or other
  misc_feature (380)..(380): n is a, c, g, or t
tcagtagtgtagatcacgaccggtgctcgatttagacgacagctcaggtaacttggctcagtttaggacccagacggaaccatggaagccccagcgcagcttactacttcctcctgcctactcttggcctcccagatagtcactggacgaaatagtggatgaccgcagtctccagccaccctctcgtgtcggtcctccgaggagaaagagccctacccgtctccctgtacgggccagtcagagtgttagctacaacttagcctggtaccagcagaacctggcctaggttcccagggctcgatccatctacgtggtcgcagtccaccgagggccacgttggtacncccagtccacctttagcgctacgtcggtctgggacngagttcactctcaccatcagcagcctgcacgtctagaagtagtttacgcttagtttacttacgtcgtacaactacgtaacaattcgtaacgttcggtaccttacctcgttaccgtttccgggaccggtacgggtaaccgacgggtacggagtacgtacgtaaacggtaacgttcggtacggtcgtagtaccgtaccgtacgtcgtacggttcttacgtacg

SEQ ID NO: 74331 - DNA, 488 bp, Homo sapiens
  misc_feature: GYAE6OF02JVA6D.37.22.B11.1.454.CMB.1.raw
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccacctctcctgtagggccagtcagagtgttagctacaacttagcctggtaccagcagaaacctggccaggttcccaggctcatcatctatggtgcatccaccagggccactggtatcccagccacctttagtggcagtgggtctgggacagagttcactctcaccatcagcagcctgcagtcngaagtntttgctagtttattactgtacaacagtacaatgactggctctctacgtttcggcggacggaccgaggtgagatacgaacgacgtgtgctgacacatctgtctctac

SEQ ID NO: 74332 - DNA, 448 bp, Homo sapiens
  misc_feature: GYAE6OF02J1DXJ.37.22.B11.1.454.CMB.1.raw
  modified_base (417)..(417): a, c, t, g, unknown or other
  misc_feature (417)..(417): n is a, c, g, or t
  modified_base (434)..(434): a, c, t, g, unknown or other
  misc_feature (434)..(434): n is a, c, g, or t
  modified_base (439)..(448): a, c, t, g, unknown or other
  misc_feature (439)..(448): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtgggggatgggggctacgtcctggcgttttgactactgggggccagggagccctggtcaccggtctcctcagcctccaccaagggccccatccggtcttcccccctggccgccctagttcccaggtacgccacctcccgagacgccacagcggccctggggcctgccctggtcaaggctacttccatcctacactacngacgcggctggcaggcncatgnnnnnnnnnn

SEQ ID NO: 74333 - DNA, 504 bp, Homo sapiens
  misc_feature: GYAE6OF02HU0AP.37.22.B11.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctntcctgcagggccagtcagagtgtagcagcaacttagcctggtaccagcagaaacctggccaggctccaggctcctcatctatggtgcatccaccagggccatggtatcccagccaggttcagtggcaggtgggtctgggacaggagttcactctcaccatcagcacgcctgcagtctagaagtattttgcttagtttatttctgttcagtctagttattaattactcggtcctcgtacgtggtacgttcggaccgaagggaccaggtgaaagtcgaaacgacgtgtggctgacacatctgtctc

SEQ ID NO: 74334 - DNA, 512 bp, Homo sapiens
  misc_feature: GYAE6OF02I4LNL.37.22.B11.1.454.CMB.1.raw
  modified_base (511)..(512): a, c, t, g, unknown or other
  misc_feature (511)..(512): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctacgtcctggcgttttgactacgtgggccaggggagccctggtcaccgtctcctcagcctacaccaagggcccatccggtcttccccctggccgccctgctccaggcgccaccgtccgagagccacagccggccctgggctgcctggtcaaggctacttccatctacactactgacgcgggctggacaggcgcatgnn

SEQ ID NO: 74335 - DNA, 430 bp, Homo sapiens
  misc_feature: GYAE6OF02FTTHW.37.22.B11.1.454.CMB.1.raw
  modified_base (426)..(430): a, c, t, g, unknown or other
  misc_feature (426)..(430): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactgggggccagggagccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnn

SEQ ID NO: 74336 - DNA, 170 bp, Homo sapiens; identical to SEQ ID NO: 74221
  misc_feature: GYAE6OF02F783Q.37.22.B11.1.454.CMB.1.raw
  modified_base (170)..(170): a, c, t, g, unknown or other
  misc_feature (170)..(170): n is a, c, g, or t

SEQ ID NO: 74337 - DNA, 429 bp, Homo sapiens
  misc_feature: GYAE6OF02H2BK7.37.22.B11.1.454.CMB.1.raw
  modified_base (320)..(320): a, c, t, g, unknown or other
  misc_feature (320)..(320): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (422)..(429): a, c, t, g, unknown or other
  misc_feature (422)..(429): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtgggggagtgggggctactcctgtcgttttgactactgggggccagggagccctggtcaccgtctcctcagcctccaccaagggcccatcggtcttccccnggcgccctgctccaggncacctccgagngcacagcggccctgggctgcctggtcaaggctactccatctacactactgagcgggctggcaagggcgcatagnnnnnnnn

SEQ ID NO: 74338 - DNA, 514 bp, Homo sapiens
  misc_feature: GYAE6OF02FXOIK.37.22.B11.1.454.CMB.1.raw
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctactcctggcgttttgactacgtggggccaggggagccctggtcaccgtctcctcagcctccaccaagggcccatcggtccttccccctgggccgcccctgcctccgaggacgccacctccgagacgcacagcggccctgggctgcctggtcaaggctactcatcacactactgacggcggctggcaaggccncatagn

SEQ ID NO: 74339 - DNA, 436 bp, Homo sapiens
  misc_feature: GYAE6OF02HDITH.37.22.B11.1.454.CMB.1.raw
  modified_base (425)..(425): a, c, t, g, unknown or other
  misc_feature (425)..(425): n is a, c, g, or t
  modified_base (431)..(436): a, c, t, g, unknown or other
  misc_feature (431)..(436): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctactcctggcgttttgactactgggggccaggggagccctggtcaccgtctcctcagcctccaccaagggccccatccggtcttccccctggccgccctgctccaggagcacctccgagagcacagcggccctgggctgcctggtcaaggactacttccatctacactactgagcgggctggcaaggcncatagnnnnnn

SEQ ID NO: 74340 - DNA, 170 bp, Homo sapiens; identical to SEQ ID NO: 74221
  misc_feature: GYAE6OF02IXHNT.37.22.B11.1.454.CMB.1.raw
  modified_base (170)..(170): a, c, t, g, unknown or other
  misc_feature (170)..(170): n is a, c, g, or t

SEQ ID NO: 74341 - DNA, 506 bp, Homo sapiens
  misc_feature: GYAE6OF02I4UD0.37.22.B11.1.454.CMB.1.raw
  modified_base (274)..(274): a, c, t, g, unknown or other
  misc_feature (274)..(274): n is a, c, g, or t
  modified_base (326)..(326): a, c, t, g, unknown or other
  misc_feature (326)..(326): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttccaggctnatcatctatggtgcatccaccagggccactggtactcccagccacctttagngcagtgggtctgggacagacgttcactctcaccatcagcagcctgcagtctagaagtatttgctagtttattctgtcagctagtataattactggtcctccgtacgtggtacgttcggacctaagggaccaaggtacgaaatacgaaacgtaactggtgctgcactatctcgtcttctac

SEQ ID NO: 74342 - DNA, 538 bp, Homo sapiens
  misc_feature: GYAE6OF02FJ4DZ.37.22.B11.1.454.CMB.1.raw
  modified_base (304)..(304): a, c, t, g, unknown or other
  misc_feature (304)..(304): n is a, c, g, or t
tcagtagtgtagatcacgaccggtgctcgatttagacgacagctcgtagggaacctgctcacgttaggacccagacggaccatggaagccccagcgcagcttctcttcctccctgctactcctggctcccagatatcactggaggaaatacgtgactgacgcagtctccagccaccctcgtctgtgtctccaggacgaaaggagcccaacccgtctcctgtagggccagtcagacgtgttagctacaacttagcctggtaccagcagaaacctggccaggttcccaggctcatcatctatggtncatccacagggccactggtatcccgagccctacctttagtcggcaggttggtctgggactagagttcactctcaccatcagcgagcctgcagtctagaatatttcgctagtttatactgtacaactagttacaatcgactggacctcttctacgtttcgggcggtacgggaccaaggtgagagtaccaaacggtactggtacgctacgcctaccattcctggtcctacgtaccg

SEQ ID NO: 74343 - DNA, 509 bp, Homo sapiens
  misc_feature: GYAE6OF02G7RLT.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccgagggccactggtactcccagccctacctttagcggcaggtggggtctggggacaggagttcactctcaccatcagcacgcctgcagtctgaagtatttgctagtttattacttgtacaacagtacaatgacgtgtcctctctacgtttcggcggaggaccgaggtggagactacgaaacgtactggtcgctagcacctatctcgtcttctac

SEQ ID NO: 74344 - DNA, 196 bp, Homo sapiens
  misc_feature: GYAE6OF02IOD93.37.22.B11.1.454.CMB.1.raw
  modified_base (172)..(196): a, c, t, g, unknown or other
  misc_feature (172)..(196): n is a, c, g, or t
tcagtagtgtagatcacgaccggtgctcgatttagacgacagctcagggcccatcggtcttcccctggcgccctggctccaggagcacctccggagagcacagcggccctgggctgcctggtcaaggactacttccatctacactactgagcgggctggcaaggcgcatagnnnnnnnnnnnnnnnnnnnnnnnnn

SEQ ID NO: 74345 - DNA, 521 bp, Homo sapiens
  misc_feature: GYAE6OF02F4R7W.37.22.B11.1.454.CMB.1.raw
  modified_base (520)..(521): a, c, t, g, unknown or other
  misc_feature (520)..(521): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctactccgtggcgttttgactacgtgggccaggggagccctggtcaccgtctcctcagcctccaccaagggcccagtccggtcttccccctggccgccctgctccaggcgccacctccgagacgcacacgccggccctgggcctcgcctgggtaccaaggcctacttccatcctacactactgacgcgggctggcaggcgcatagnn

SEQ ID NO: 74346 - DNA, 484 bp, Homo sapiens
  misc_feature: GYAE6OF02JN34T.37.22.B11.1.454.CMB.1.raw
  modified_base (458)..(458): a, c, t, g, unknown or other
  misc_feature (458)..(458): n is a, c, g, or t
  modified_base (460)..(484): a, c, t, g, unknown or other
  misc_feature (460)..(484): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggccccatccggtcttcccccctgggccgcccctcggcctcccgaggacgccacccgtccgagacgcaccacggccggcccgtcggggctacgccctgggtccaaggacctacttcccatctaccactactgagcgggctggcgaaggcgcatacgngnnnnnnnnnnnnnnnnnnnnnnnnn

SEQ ID NO: 74347 - DNA, 451 bp, Homo sapiens
  misc_feature: GYAE6OF02GFF0P.37.22.B11.1.454.CMB.1.raw
  modified_base (445)..(451): a, c, t, g, unknown or other
  misc_feature (445)..(451): n is a, c, g, or t
tcagtagtgtagatcacgaccggtgctcgatttagacgacagctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactacgtggggccaggggagccctggtcaccgtctcctcagcctccaccaagggccccagtccggtcttcccccctggccgccctgcctccaggacgccacctccgagacgcacagcggccctgggcctgccctggtcaacggacctacttccatctacactactgagcgggctgggcaacgggcgcataggnnnnnnn

SEQ ID NO: 74348 - DNA, 711 bp, Homo sapiens
  misc_feature: GYAE6OF02I6GX6.37.22.B11.1.454.CMB.1.raw
  modified_base (144)..(144): a, c, t, g, unknown or other
  misc_feature (144)..(144): n is a, c, g, or t
  modified_base (185)..(185): a, c, t, g, unknown or other
  misc_feature (185)..(185): n is a, c, g, or t
  modified_base (242)..(242): a, c, t, g, unknown or other
  misc_feature (242)..(242): n is a, c, g, or t
  modified_base (256)..(256): a, c, t, g, unknown or other
  misc_feature (256)..(256): n is a, c, g, or t
tcagtagtgtagatcacgaccggtgctcgatttagacgacagctcaggaactgctcagttaggacccagacggaaccatggaagccccagcgcagtcttctccttcctcctgctactcgtggcctccagatactcacgtggaanaaattgtcgatcgacgcagtcctcagcccacctctctggtnttccacgaggagaaaacgctcccaccctctccgtaggacggccagtcagtgtgtacnctaactaacgttcnccgttacggaaccagacgaaacgtaaacccgtcggaccgttaccggttaccccgaggtccctacacttactaacttaccgttaagtcgggtcgtccaacttacccgaaccggaccgggacctacggttacggtacctacccgacggtacccctaaccggttttggccggtaccgtacgggttcggggttcgtaccgggaaacgtacggttacgtttaccgaacctttccggttaaccaaccccgttagtaccgaacggtacgtaccgtaccggtcgaacgtcggtactacggtaattacgtttacgtaccgttattttacgttacgttacgtactaaacgacgtactaagtcgtactcgcctctacgtcgttcggacggacggtaacgagtcgagtactacgaacgtactggtagtccgtagaccgtaccgtactcgtactttcgtaccttaccg

SEQ ID NO: 74349 - DNA, 526 bp, Homo sapiens
  misc_feature: GYAE6OF02HTF4W.37.22.B11.1.454.CMB.1.raw
  modified_base (325)..(325): a, c, t, g, unknown or other
  misc_feature (325)..(325): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacacttagcctggtaccagcagaaacctggccaggttcccaggctcatcatctatggtgcatccaccagggccactggtatcccagccacctttagnggcagtgggtctgggacagagttcactctcaccatcagcagcctgcagtctgaagtatttgctagtttattactgtacaacagtacaatgtactaggcctctctacgtttcggcggtacgggaccaagggtcggagtagtaccgaaacggtaacttaggtacggcgtaggaccaccgtactcgttcgttaccttctaaccg

SEQ ID NO: 74350 - DNA, 507 bp, Homo sapiens
  misc_feature: GYAE6OF02GRRD4.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcactcccaccagggcccactggtactcccagccctacctttagtggcaggtgggtctgggacagagttcactctcaccatcagcacgcctgcagtctagaagtatttgctagtttattactgtacaactagtactaatgacgtgccttctctacgtttcggcggtaggaccgagggtgagatacgaaacgaacgtgtgtctgacactatctgtctctac

SEQ ID NO: 74351 - DNA, 521 bp, Homo sapiens
  misc_feature: GYAE6OF02H14Y3.37.22.B11.1.454.CMB.1.raw
tcagtagtgtagatcacgaccggtgctcgatttagacgacagctcaggggtccctgagactctcctgtgcagcctctggattcaccttcagcagctatgccatgacctgggtccgccagtctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattactgtacgaaaatggcctacggatatgactactattggactggtacttcgatctctggggccgtggcaccctggtccactgtctcctcacgcctccaccaacgggcccatcggtcttccccctggcccgccctcgcctccgacggacgccacctccgagacgcacagccggcccgtgggcctcgccgtggtcaacggactacgtccatctacactactgacgcggctggcaggccg

SEQ ID NO: 74352 - DNA, 488 bp, Homo sapiens
  misc_feature: GYAE6OF02G6RP6.37.22.B11.1.454.CMB.1.raw
  modified_base (287)..(287): a, c, t, g, unknown or other
  misc_feature (287)..(287): n is a, c, g, or t
  modified_base (328)..(328): a, c, t, g, unknown or other
  misc_feature (328)..(328): n is a, c, g, or t
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacacttagcctggtaccagcagaaacctggccaggttcccaggctcatcatctatggtncatccaccgaggccacgtggtactcccagccaccgtttagnggcagtgggtctggggacagagttcactctcaccatcagcacgcctgcagtctagagtatttgactagtttattactgtacaagtagtacatgactggcctctctacgttcggcggtaggacgagtgagatacgaacgatgngctgcncatctntntctc

SEQ ID NO: 74353 - DNA, 493 bp, Homo sapiens
  misc_feature: GYAE6OF02FQAS4.37.22.B11.1.454.CMB.1.raw
  modified_base (326)..(326): a, c, t, g, unknown or other
  misc_feature (326)..(326): n is a, c, g, or t
  modified_base (490)..(490): a, c, t, g, unknown or other
  misc_feature (490)..(490): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccagggccactggtatcccagccacctttagnggcagtgggtctgggacagagtcactctcaccatcagcagcctgcagtctgaagtatttgctagtttattactgtacaacagtacaatgactggcctctcacgtttcggacggaggacctaaggtggagatacgaaacgactggtggctgcactatctgtcctntac

SEQ ID NO: 74354 - DNA, 437 bp, Homo sapiens
  misc_feature: GYAE6OF02ICXJG.37.22.B11.1.454.CMB.1.raw
  modified_base (353)..(353): a, c, t, g, unknown or other
  misc_feature (353)..(353): n is a, c, g, or t
  modified_base (428)..(437): a, c, t, g, unknown or other
  misc_feature (428)..(437): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactgggggccagggagccctggtcaccggtctcctcagcctccaccaaggccccatcggtcttccccctggcgcccctgctccaggagccacctccganacgcacagcggccctgggctgcctggtcaaggctacttccatctacactactgagcgggctggcaggcgcatagnnnnnnnnnn

SEQ ID NO: 74355 - DNA, 595 bp, Homo sapiens
  misc_feature: GYAE6OF02IENP2.37.22.B11.1.454.CMB.1.raw
  modified_base (170)..(170): a, c, t, g, unknown or other
  misc_feature (170)..(170): n is a, c, g, or t
  modified_base (291)..(291): a, c, t, g, unknown or other
  misc_feature (291)..(291): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctntctgtgtctccaggagaaagagcccaccctctcctggtagggccaagtcagagtgttagctacaacttagcctggtaccagcagaaacctggccaggttcccaggctcatcatctatggtncatccacagggccacgtggtactcccgagccctacgttttagcggctaggttcgggctggggacaggtagtttcactcgtacaaccgtatcgagccagcctcgctacgtactgtaaagtatttgacttaagttttattacgttgtacaaacgtagtaacaatagtaccgtggtcccttacttcctaaccggttttcgggacggggtaacggaaccgtaaggggttcgaacggtacgtacgaaaacggtaacttgggtacggaccgttggacctaaccgcgtttacgtcgttaccttctaacccg

SEQ ID NO: 74356 - DNA, 438 bp, Homo sapiens
  misc_feature: GYAE6OF02IOBDB.37.22.B11.1.454.CMB.1.raw
  modified_base (396)..(396): a, c, t, g, unknown or other
  misc_feature (396)..(396): n is a, c, g, or t
  modified_base (427)..(438): a, c, t, g, unknown or other
  misc_feature (427)..(438): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccatatattattgtgcgaaacttccttttgactggttattatcccctagtgaccactggggccagggaaccctggtcaccgtctcctcagcctccaccaagggcccatcggtccttccccctggccaccctcctccaagacgcacctcgtcgggggcacagcggccctgggctcgctggtcaaggctactccatctacnctactgacgcgggctggcaaggcgacatagnnnnnnnnnnnn

SEQ ID NO: 74357 - DNA, 465 bp, Homo sapiens
  misc_feature: GYAE6OF02HA8KR.37.22.B11.1.454.CMB.1.raw
  modified_base (351)..(351): a, c, t, g, unknown or other
  misc_feature (351)..(351): n is a, c, g, or t
  modified_base (455)..(465): a, c, t, g, unknown or other
  misc_feature (455)..(465): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactacgtgggggccaggggagccctggtcaccgtctcctcagcctccaccaagggccccatccggtcttcccccctggccgcccctgcctccgagggacnccaccctccgagcgcaacagccggccctggggcctcgcctggtccaaaggtacttacttccaattcctaccactacgtgcgcgggctgggcaagggcgcatagnnnnnnnnnnn

SEQ ID NO: 74358 - DNA, 733 bp, Homo sapiens
  misc_feature: GYAE6OF02H6NDB.37.22.B11.1.454.CMB.1.raw
  modified_base (179)..(179): a, c, t, g, unknown or other
  misc_feature (179)..(179): n is a, c, g, or t
  modified_base (197)..(197): a, c, t, g, unknown or other
  misc_feature (197)..(197): n is a, c, g, or t
  modified_base (731)..(731): a, c, t, g, unknown or other
  misc_feature (731)..(731): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccgaggggaagggactgggagtgggtctcggtctagttaggtggaagtggtgcttanacaactacgcagcctcgngaaggccgcttcaccatctcagagactatccaaagagcactctgtactctagacaaatagaacagacctgagtcgacgacggacgacggaccctatacttatcgtgacgaaagtggagggggtaggtgggggctacgtcgttgggtcgtttttaggaccttaggtcggggccgtaaggggaccgtccggtacggtttaccgaccggttcgttcccgtacaacgtcccttaccgaacccgaacggggcccctacggtcccggtttcccttccccggtccgggtcccgtcccgttccggcccgttacccgagggtaccgtccgtaaccccgtccggaacgacccgcgaaccgaccggggccgggtccccggtcgggggtcctaccggggacccgtttcggggtaccgaaaccggggttacctaaccccgtttacctaactaccggttaaccctacccggttaacgttcccggacgggtccgggtaccggttacgggaccggttaaaccgggccgggaaaccgttacgtaaccgggnac

SEQ ID NO: 74359 - DNA, 593 bp, Homo sapiens
  misc_feature: GYAE6OF02IW240.37.22.B11.1.454.CMB.1.raw
  modified_base (186)..(186): a, c, t, g, unknown or other
  misc_feature (186)..(186): n is a, c, g, or t
  modified_base (191)..(191): a, c, t, g, unknown or other
  misc_feature (191)..(191): n is a, c, g, or t
  modified_base (290)..(290): a, c, t, g, unknown or other
  misc_feature (290)..(290): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccagganaaagngccaccctctcctgtagggccagtcagagtgttagctacaacttagcctggtaccagcaagaaacctggaccaggttcccaggctcatcatctatggtncatccacgagggccagtgtactcccagcctaccttagtgcaggtgggtctgggacagagttcactctcaccatccagcagcctgactagtctagtaagtatttgctagtttatacttcgtacaactataacaattgtaacctggtaccctcttaccgtacgtttacgggacggtaacggggtaaccgtaagggtacgggacgtaacgtaaccgaaaaccggtaacggttcgggttaccgggtacgtaccggacccttaaacccggtacgtttaccggttacgtttaccctttacccgtaaccg

SEQ ID NO: 74360 - DNA, 520 bp, Homo sapiens
  misc_feature: GYAE6OF02H1HUI.37.22.B11.1.454.CMB.1.raw
  modified_base (230)..(230): a, c, t, g, unknown or other
  misc_feature (230)..(230): n is a, c, g, or t
  modified_base (328)..(328): a, c, t, g, unknown or other
  misc_feature (328)..(328): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctanaacttagcctggtaccagcagaaacctggccaggttcccaggctcatcatctatggtgcatccaccagggccactggtactcccagccaccgtttagnggcaggtggtctgggacagtagttcactctcaccatcagcagctgcagtctgaagtatttgctagtttattacgtgtacaacagtacaagtgtactggtcctctctacgtttcgggcggaggaccaagggtgagactacgaaacgtacgtggtaggtcgtagccaccgtacttccgtcgttaccttcgtacc

SEQ ID NO: 74361 - DNA, 587 bp, Homo sapiens
  misc_feature: GYAE6OF02IP8JL.37.22.B11.1.454.CMB.1.raw
  modified_base (437)..(437): a, c, t, g, unknown or other
  misc_feature (437)..(437): n is a, c, g, or t
tcagtagtgtagatcacgaccggtgctcgatttagacgacagctcaggaactgctcagttaggacccagacggaaccatggaacgccccagcgcagcttctccttcctcctgctactctggcctcccagatatcacgtggaagaaatagtgatgacgcagtctccagcccaccctctctgtgtcctccgaggagaaagcgcccaccctctcctggtacgggccagtcagtagtgttagctaacaacttagcctggtaccagcaagaaacctggccaggttcccaggctcatcatctagtggtgcatccaccgagggccacgtggtactcccagtccctaccgttttaggcggacctagggtcgggtcgtggggacaggtacgttcacgttctaccaaccgtatccagccacgtccctgcctagtctaggtaaagttntttgacttagtttaacttacgtgtacaacgtagtacaattcgacgtcggtcctctaccgtacgtttcgggacggtaacggaccgaagggtgagtataccgaaacgtcgtaggtcggacgtcgaccacgtcttcgtcgttacctctacccg

SEQ ID NO: 74362 - DNA, 519 bp, Homo sapiens
  misc_feature: GYAE6OF02GC1OH.37.22.B11.1.454.CMB.1.raw
  modified_base (514)..(514): a, c, t, g, unknown or other
  misc_feature (514)..(514): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccagggccactggtatcccagccacctttagtggcaggtgggtctgggacagagttcactctcaccatcagcagcctgcagtctgaagtatttgctagtttattacttgtacaacagtaacaatgactggacctctccgtacgttttcggaccggtagggaccgtaagggtggagagtaccgaaacgtaacgtggtagtcgtgacaccgatctgttcttntaccg

SEQ ID NO: 74363 - DNA, 435 bp, Homo sapiens
  misc_feature: GYAE6OF02IBZNJ.37.22.B11.1.454.CMB.1.raw
  modified_base (429)..(435): a, c, t, g, unknown or other
  misc_feature (429)..(435): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagccctggtcaccgtctcctcagcctccaccaagggccccatcggtcttccccctgggcgccctgcctccaggagcacctccgagagcacagcggccctgggctgcctggtcaaggactacttccatcctacacctactgagcgggctggcaaggcgcatgnnnnnnn

SEQ ID NO: 74364 - DNA, 453 bp, Homo sapiens
  misc_feature: GYAE6OF02GSQWJ.37.22.B11.1.454.CMB.1.raw
  modified_base (324)..(324): a, c, t, g, unknown or other
  misc_feature (324)..(324): n is a, c, g, or t
  modified_base (347)..(347): a, c, t, g, unknown or other
  misc_feature (347)..(347): n is a, c, g, or t
  modified_base (433)..(433): a, c, t, g, unknown or other
  misc_feature (433)..(433): n is a, c, g, or t
  modified_base (438)..(453): a, c, t, g, unknown or other
  misc_feature (438)..(453): n is a, c, g, or t
tcagtagtgtagatcacgaccggtgctcgatttagacgacagctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgatgacacggccctatattattgtgcgaaatgtggggggagtgggggctactcctggcgttttgactactggggccaggggagcccgtggtccaccggtctcctcagcctccaccaggccatcgtctcccctggcnccctcctccaagcgccacctcgnggggcacgacgccggccctgggctggccgtcggtcgaacggactaccttccatctacactactgaggcgggcgtggacaagggcgnatagnnnnnnnnnnnnnnnn

SEQ ID NO: 74365 - DNA, 567 bp, Homo sapiens
  misc_feature: GYAE6OF02G4GP5.37.22.B11.1.454.CMB.1.raw
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccaggggaagggactggagtgggtctcgtctattagtggaagtggtgcttatacaaactacgcagcctccgtgaagggccgcttcaccatctccagagactattccaaagngcactctgtatctgacaaatgaacngcctgagtgccgagacacggccctatattagttgtgacgaaagtggtggggggagtggggctacgtcgtggtcgttttgacgtacgtcgggccgagggcgcccgtggtccaccgtctcctcacgcctaccacgaacggcccacgtccggtcccttccccgtcggcccgtcccgtcgccgtccgacggtacgcctaccgtccgagacgcacgcgccggccgtggccgtcgccgtggtacaacggtactaccgtccactactaccaccgtacgtcgacggtccggcgtcggacgacggccgagatcgatcg

SEQ ID NO: 74366 - DNA, 700 bp, Homo sapiens
  misc_feature: GYAE6OF02FQS2I.37.22.B11.1.454.CMB.1.raw
  modified_base (227)..(227): a, c, t, g, unknown or other
  misc_feature (227)..(227): n is a, c, g, or t
  modified_base (259)..(259): a, c, t, g, unknown or other
  misc_feature (259)..(259): n is a, c, g, or t
  modified_base (503)..(503): a, c, t, g, unknown or other
  misc_feature (503)..(503): n is a, c, g, or t
tcagtagtgtagatcacgaccggtgctcgattttagacgacagctctagggtaacgtgctcaggttaggacccgagaccggaaccacttgggaagtcccccaagtcgttcagtcttctcttcctcctgctactactggctcccgagatactcacgtggtaggaaataggtgatggacgtcaggtctcctagtacctacctctactgtgtcgtccgaggactaaaggngcctacccgtcgtaccgtgttacggggtaccncgtcgaggtacgtagttacgcctactaacgttaggcctaggttaccaggctacgtaacctgccgtacggttcccaggctcgaactcgactcctagtcggtcgacgacgtccaacggacgggtcctacggtcggttactacccgtaagaccgtaaccgttttaggcggtcgtacgggtcggtaacgtacgggtactacggtacgtttccacgttcctacgacctagtcacgtaccgtacgtccgngtacgagttcgtagtaacgtatttcggacttagttttactacgtgttaactaactagtaactaacgtcgtaaccgtcgtacctacgtaccgttaaccgtttcgggaaccgtacgggtaacctaagggttaggtacacgtaacgtaaccggagttcgacggtcgtacgctaaccgtctcgtacttacctgtaacccgg

SEQ ID NO: 74367 - DNA, 449 bp, Homo sapiens
  misc_feature: GYAE6OF02HIR8L.37.22.B11.1.454.CMB.1.raw
  modified_base (290)..(290): a, c, t, g, unknown or other
  misc_feature (290)..(290): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (429)..(449): a, c, t, g, unknown or other
  misc_feature (429)..(449): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactggggccagggagcccctggtcaaccgtctcctnagcctcaccaagggcccatcggtctccccctggcnccctgctccaggancacctccgagagcacagcggccctgggctgcctggtcaaggactacttccatctacactactgacgcgggctggctaagggcgctatagnnnnnnnnnnnnnnnnnnnnn

SEQ ID NO: 74368 - DNA, 461 bp, Homo sapiens
  misc_feature: GYAE6OF02G2IC5.37.22.B11.1.454.CMB.1.raw
  modified_base (324)..(324): a, c, t, g, unknown or other
  misc_feature (324)..(324): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
  modified_base (430)..(461): a, c, t, g, unknown or other
  misc_feature (430)..(461): n is a, c, g, or t
tcagtagtgtagatcacgaccggtgctcgatttagacgacagctcagggaaggggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctagtattattgtgcgaaatggtggggggatggggggctactcctggcgttttgactactgggggccaggggagccctggtcaccgtctcctcagcctccaccaagggcccatcggtctccccnggccgccctgctccaggcgcacctccgagngcacagcgcctgggcngcctgtcaaggctactccatctacactactgacgcgggctgggcaagggccacatacgcnnnnnnnnnnnnnnnnnnnnnnnnnnnnnnnn

SEQ ID NO: 74369 - DNA, 574 bp, Homo sapiens
  misc_feature: GYAE6OF02H2K5P.37.22.B11.1.454.CMB.1.raw
  modified_base (186)..(186): a, c, t, g, unknown or other
  misc_feature (186)..(186): n is a, c, g, or t
  modified_base (317)..(317): a, c, t, g, unknown or other
  misc_feature (317)..(317): n is a, c, g, or t
  modified_base (406)..(406): a, c, t, g, unknown or other
  misc_feature (406)..(406): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccagganaaagacgccaccctctcctggtacgggccagtcaggagtgttagctacaacttagcctggtaccagcagaaacctggacctaggttcccaggctcatcatctatggtgcatccacgacggccagtggtacnccagcctacctttagcggtcaggttgggtctagggacaggtacgttcactctcaccgtatcaagcacgcctgcgtagtctagtaagttntttgcttagttttatacgttgtacaactagtaactaatcgtacgtcggtccttcctcgtacgtttccgggacgggaggtaaccgagggtacgacgtaataaccgtaaacggtaacgttggtacgtacacggtacctaccgtattcccgtacggttccttacgtacccg

SEQ ID NO: 74370 - DNA, 511 bp, Homo sapiens
  misc_feature: GYAE6OF02GRO1X.37.22.B11.1.454.CMB.1.raw
  modified_base (507)..(507): a, c, t, g, unknown or other
  misc_feature (507)..(507): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctatggtgcatccaccagggccactggtactccccagccctacctttagtgtcaggtgggtctgggacagagttcactctcaccatcagcagcctgcagtctagaagtatttgctagtttattactgtacaacagtacaatgactcggcctctctacgtttcgggcggtacggaccgtaagggtgagatacgaaacgtactggtggactgacacctatctgttcttntacc

SEQ ID NO: 74371 - DNA, 570 bp, Homo sapiens
  misc_feature: GYAE6OF02HIPC5.37.22.B11.1.454.CMB.1.raw
  modified_base (568)..(568): a, c, t, g, unknown or other
  misc_feature (568)..(568): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgacgaaagtggtgggggagtgggggctacgtccgtggtcgttttgacgtacgtcgggccgaggggcgcccgtggtccaccgtctcctcgacgcctcccaccgaacgggcccagtccggtccttcccccgtggcccgtccctcgcctccgacggcgaccaccgtccgagacgcacgacggccgtcccgtgggccgtcgccgtcggtacaacgggtacctaccgttccatcctaactaccgtacgtgacggcggtcgtacggcgacggcgtacgagtagncg

SEQ ID NO: 74372 - DNA, 638 bp, Homo sapiens
  misc_feature: GYAE6OF02I4MJS.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagcgccacctctcctgtaggccagtcagagtgtagctacaacttagcctggaccagcaagaacctgccaggtcccaggctcatcatctagtggtgcactccaccgagggccctacgttcggtactacccgacgtccccttaaccgttttaggcggacctagggttcggggtcgtaggggaacaggtacgttccaacctttcgtaccaacctatcgaacgcgtacgtcccgtgacgtagtctagaacgttatttggacttagttttaacttacgttcgttacaaacgtacgtaaactaacttacgaacgttccgtacctttcctaacgttaccggtttaccggggaccgggtaaggtaaccggtaagggtcggaagttaacgaacggtaaaacgtacgtcggtacggaccttacgacgtaccgtacgtttacgtccggttcttacctaccg

SEQ ID NO: 74373 - DNA, 539 bp, Homo sapiens
  misc_feature: GYAE6OF02G1A89.37.22.B11.1.454.CMB.1.raw
  modified_base (393)..(393): a, c, t, g, unknown or other
  misc_feature (393)..(393): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagagccaccctctcctgtagggccagtcagagtgttagctacaacttagcctggtaccagcagaaacctggccaggttcccaggctcatcatctagtggtgcactccaccagggccactggtactcccagccctactttagcggcaggtgggtctgggacaggagttcactctcacctatcagcacgcctgctagtctagaagtntttgacttagtttacttactgtactaactagtacaagtgactcgtcctctcgtacgtttcggacggtacggacgtaggtaggagtaacgtacgaaacgtacgtggtacgacgtacgaccgtactacgttcgtcttacgtactaccg

SEQ ID NO: 74374 - DNA, 633 bp, Homo sapiens
  misc_feature: GYAE6OF02FIRB2.37.22.B11.1.454.CMB.1.raw
  modified_base (540)..(540): a, c, t, g, unknown or other
  misc_feature (540)..(540): n is a, c, g, or t
  modified_base (559)..(559): a, c, t, g, unknown or other
  misc_feature (559)..(559): n is a, c, g, or t
  modified_base (566)..(566): a, c, t, g, unknown or other
  misc_feature (566)..(566): n is a, c, g, or t
  modified_base (580)..(580): a, c, t, g, unknown or other
  misc_feature (580)..(580): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (620)..(620): a, c, t, g, unknown or other
  misc_feature (620)..(620): n is a, c, g, or t
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
  modified_base (632)..(632): a, c, t, g, unknown or other
  misc_feature (632)..(632): n is a, c, g, or t
tcagtagtgtagatcacgaccggtgctcgatttagacgacagctcaggggaacgggacgtcggagtgggtctcgtctattagtggaagtcggtcgcttatacaaactacggccgagcctccggtgaacgggccgcctttcaccatcgtccagagacctattccaagagcactctgtatctgcaaatgaaccacgcctgagtcgaccgaggaccacggcccctatagttaattgtgcgaaatcgtggggggagtcgggggctactcgttggcgtttttggacttaccgtgggggcccagggacgcccctgggtccacccgtcctccgtccaagcccttccgaccaacggggccccctaagtccggtactttcccccgtggccgccccttggccttcccagggtacgccaacccgttccgaggacgccaacaggccgggcccttggggctacggccctgggtccaaacgggtcttaccgtttcccagtccgtaacctacgtacctcggacggccggggtctcgggacccgaaacggggtccnccgtaacttacggcactcncgtaccnctcgtcctcgctcncgacgacgcgcgtgcgacgcacgtcgcgcncncncncgcncncncncncncnc

SEQ ID NO: 74375 - DNA, 527 bp, Homo sapiens
  misc_feature: GYAE6OF02F1QXJ.37.22.B11.1.454.CMB.1.raw
  modified_base (401)..(401): a, c, t, g, unknown or other
  misc_feature (401)..(401): n is a, c, g, or t
  modified_base (425)..(425): a, c, t, g, unknown or other
  misc_feature (425)..(425): n is a, c, g, or t
  modified_base (454)..(454): a, c, t, g, unknown or other
  misc_feature (454)..(454): n is a, c, g, or t
  modified_base (526)..(527): a, c, t, g, unknown or other
  misc_feature (526)..(527): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtgggggagtgggggctactcctggcgttttgactacgtgggccagggagcccgtggtcaccgtctcctcagcctccaccaacgggcccatcggtcttcccccnggccgccctgcctccagggcaccnccgtcgagcgacacgcgccgtccgcggcncgtccgtggacgaacgtacttacctactctacactactcgtagacgggcgagtcggacgacggcatagtacnn

SEQ ID NO: 74376 - DNA, 527 bp, Homo sapiens
  misc_feature: GYAE6OF02HLPNN.37.22.B11.1.454.CMB.1.raw
  modified_base (426)..(426): a, c, t, g, unknown or other
  misc_feature (426)..(426): n is a, c, g, or t
  modified_base (445)..(445): a, c, t, g, unknown or other
  misc_feature (445)..(445): n is a, c, g, or t
  modified_base (518)..(518): a, c, t, g, unknown or other
  misc_feature (518)..(518): n is a, c, g, or t
  modified_base (525)..(526): a, c, t, g, unknown or other
  misc_feature (525)..(526): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggccatatattattgtgcgaaagaccccaacggtgaccacattggagtcttttgacttcgtgggccaaggggacaacggtcaccgtctcttcagcctccaccaacgggcccatccggtccttcccccgtggccgcccctgcctccgaggacnccgacctccgagacgcacncgccggccctgggcctcgcctggaccaacgggactactccatctacacttactggacgcgggctggcaaggcncatacgnnc

SEQ ID NO: 74377 - DNA, 556 bp, Homo sapiens
  misc_feature: GYAE6OF02IQN0V.37.22.B11.1.454.CMB.1.raw
  modified_base (346)..(346): a, c, t, g, unknown or other
  misc_feature (346)..(346): n is a, c, g, or t
  modified_base (366)..(366): a, c, t, g, unknown or other
  misc_feature (366)..(366): n is a, c, g, or t
  modified_base (514)..(514): a, c, t, g, unknown or other
  misc_feature (514)..(514): n is a, c, g, or t
  modified_base (517)..(519): a, c, t, g, unknown or other
  misc_feature (517)..(519): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (529)..(530): a, c, t, g, unknown or other
  misc_feature (529)..(530): n is a, c, g, or t
  modified_base (533)..(541): a, c, t, g, unknown or other
  misc_feature (533)..(541): n is a, c, g, or t
  modified_base (543)..(548): a, c, t, g, unknown or other
  misc_feature (543)..(548): n is a, c, g, or t
  modified_base (550)..(556): a, c, t, g, unknown or other
  misc_feature (550)..(556): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggctacgtcctggtcgttttgacttacgtggggggccaggggacgccccgttggtcctaccggtctccctcacgccctccaaccgaacggccccagtccggtccttcccccgnggccgccctgcctccaggcncaccctcgagacgcacgagccggccctggggcctcggccgtgggttaccgaaacggtacccttacgtttccacttacctaaccgtacctaacgtcggaacggccgggtacgtcgggaaccgaaacgggccgtacgaacgttaacgcgngcnnngcncngngcnncgnnnnnnnnngnnnnnncnnnnnnn

SEQ ID NO: 74378 - DNA, 480 bp, Homo sapiens
  misc_feature: GYAE6OF02FHFH2.37.22.B11.1.454.CMB.1.raw
  modified_base (462)..(480): a, c, t, g, unknown or other
  misc_feature (462)..(480): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtggggggctactcctggcgtttttgactactgggggccagggagccctggtcaccgtctcctcagcctccacacgggcccagtccgtccttccccgtggccgcccgtcgcctccgaggacgccacccgtccgagacgccacgacggccggcccgtgggctcgccgtggtacgaaacggtctaccttaccatcctacactactgacggcgggtctggacaacgggccacagtagnnnnnnnnnnnnnnnnnnn

SEQ ID NO: 74379 - DNA, 550 bp, Homo sapiens
  misc_feature: GYAE6OF02GMBVI.37.22.B11.1.454.CMB.1.raw
  modified_base (191)..(191): a, c, t, g, unknown or other
  misc_feature (191)..(191): n is a, c, g, or t
  modified_base (371)..(371): a, c, t, g, unknown or other
  misc_feature (371)..(371): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagngccaccctctcctgtacgggccagtcagagtgttagctacaacttagcctggtaccagcagaaacctggaccaggttcccaggctcatcatctatggtgcatcccaccgacgggccacgtggtactccccagcccctaccgttttaggcggacaggtgggtctgggacagagttcactcncacatcagcgagctgctagtctagtagtatttgactagtttattactgtacaacgtagtacctaatcgtacgtggtacctcgtactacgtttcggcgggtacggaccgaagggtggagtataccgaaacgtacgttggtcgacgtacgcctacgtattaccgtcgttacctacttaccg

SEQ ID NO: 74380 - DNA, 170 bp, Homo sapiens; identical to SEQ ID NO: 74221
  misc_feature: GYAE6OF02GX5UG.37.22.B11.1.454.CMB.1.raw
  modified_base (170)..(170): a, c, t, g, unknown or other
  misc_feature (170)..(170): n is a, c, g, or t

SEQ ID NO: 74381 - DNA, 467 bp, Homo sapiens
  misc_feature: GYAE6OF02HIGUV.37.22.B11.1.454.CMB.1.raw
  modified_base (453)..(467): a, c, t, g, unknown or other
  misc_feature (453)..(467): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggcccctctattactgtgcgagagatcagacggagtatagcagcagctctgactactggggccacggaaccctggtcaccgtctcctcagccctccaccaacgggcccagtccggtccttccccctggccacccctcctccaagacgccacctcgtgggggccacgacggccggcccgtcgggctcgcccgtgggtcaacggtactacgttccacttcctactactactgacggcgggcgtggacaaggcgacagtgnnnnnnnnnnnnnnn

SEQ ID NO: 74382 - DNA, 432 bp, Homo sapiens
  misc_feature: GYAE6OF02HME0U.37.22.B11.1.454.CMB.1.raw
  modified_base (418)..(418): a, c, t, g, unknown or other
  misc_feature (418)..(418): n is a, c, g, or t
  modified_base (423)..(432): a, c, t, g, unknown or other
  misc_feature (423)..(432): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactactgggggccagggagccctggtcaccgtctcctcagcctccaccaagggccccatccggtcttccccctggccgccctgctccaggacgcacctcgagagcacagcggccctgggctgcctggtcaaggctactcatcacactactgagcggctggcaaggcnatagnnnnnnnnnn

SEQ ID NO: 74383 - DNA, 582 bp, Homo sapiens
  misc_feature: GYAE6OF02HLRWB.37.22.B11.1.454.CMB.1.raw
  modified_base (233)..(233): a, c, t, g, unknown or other
  misc_feature (233)..(233): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccaggggaagggactgggagtgggtctcgtctattagtggaagtggtgcttatacaaactacgcagcctccgtgaagggccgcttcaccatctccagagactattccaagngcactctgtatctgcaaatgaacagcctgagtgccgaggacacggccctatattattgtgcgaaatggtggggggagtgggggctacgtcgtggtcgtttgactacgtgggccagggacgcccgtggtcaccgtctcctcacgcctacaccgacgggcccagtccggtccttccccgtgggccgcccgtcgccgtccgacggacgtccaacccgtccgaagacgccacgacggccggcccggtgggaccctcgccgttcgggtacgaaccggtacctaccgttccacttacctactaccgtactcggaggccgggtccgtaggccgaacgggccgacgtactaggatcg

SEQ ID NO: 74384 - DNA, 178 bp, Homo sapiens
  misc_feature: GYAE6OF02H0KYU.37.22.B11.1.454.CMB.1.raw
  modified_base (171)..(178): a, c, t, g, unknown or other
  misc_feature (171)..(178): n is a, c, g, or t
tcagtagtgtagatcacgaccggtgctcgatttagacgacagctcagggcccatcggtcttccccctggcgccctgctccaggagcacctccgagagcacagcggccctgggctgcctggtcaaggactacttccatctacactactgagcgggctggcaaggcgcatagnnnnnnnn

SEQ ID NO: 74385 - DNA, 675 bp, Homo sapiens
  misc_feature: GYAE6OF02H533I.37.22.B11.1.454.CMB.1.raw
  modified_base (192)..(192): a, c, t, g, unknown or other
  misc_feature (192)..(192): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtcgtctccaggagaaagngcccaccctctcctgtacgggccagtcagagtgttagctacaacttagcctggtaccagcagaaacctggccaggttcccaggctcatcatctagtggtgcactcccaccgacgggccacgtggtactcccacgtccctaacctttaggcggactaggtgggtcgtgggacaggtagttcacgtcctcacctagtccagccacgccctgccagttcctaggtaagttatttgaccgttagttttaactttaacgttcgttaaccaaacgtacgttaacaaagttcgtaccgttacggtcccttaccgttaccgttaccggttttaccggggaaccggggtaaccggggtaaacccgtaagggggttacgggtaacgtaacggttaaaccgaaaaaccgggttaacgttacgggttacgggtacccgttaggaccccgtaaccgttaacgttacccgtttcggtttacccttacgttaaccccg

SEQ ID NO: 74386 - DNA, 739 bp, Homo sapiens
  misc_feature: GYAE6OF02GCNGL.37.22.B11.1.454.CMB.1.raw
  modified_base (198)..(198): a, c, t, g, unknown or other
  misc_feature (198)..(198): n is a, c, g, or t
  modified_base (309)..(309): a, c, t, g, unknown or other
  misc_feature (309)..(309): n is a, c, g, or t
tcagtagtgtagatcacgaccggtgctcgatttagacgacagctcaggaacgtgctcagttaggacccagacggaaccatggaagccccagcgcagcttctcttcctcctgcctactctggctcccagactatcactggaagtaatgtgatgacgcagtctccagcccaccctctcgtgtgtctccgaggagaaacgngcccaccctctccgtggtacgggccagtcagagtgttagctaacacttgccgtggtaccagcagaacctggaccacggcctcccgaggtcctcctcgactcgtagtggtcnctaccgtcccgaaccggacgggccctacggttcgggtaacctccccgtaaggtcccgtaacggttccgaacgggttcggtaaccgtaggggttcggggttaccggtaggggaaacctagggtaccgttaccgtaccttacgttacccaccgtagtccgacgcccgtacggtccctaggaccgtaaccggtgttaacggtaaacgtttcgttttacggtacgttttaacggttttactttacgtcggttacctaagggtctaacggtttaattaaccgttacgttcccggtaccttaccggtttacggtcgggttacccgtacggtaaccggaacgggtaaccggtaaggtaacgtaaaccggtaacgtaaaccggtacgtcggtacgtacgtcgtaccgtaaccgttacgtcgttaccggttccttaccg

SEQ ID NO: 74387 - DNA, 608 bp, Homo sapiens
  misc_feature: GYAE6OF02FG102.37.22.B11.1.454.CMB.1.raw
  modified_base (203)..(203): a, c, t, g, unknown or other
  misc_feature (203)..(203): n is a, c, g, or t
  modified_base (416)..(416): a, c, t, g, unknown or other
  misc_feature (416)..(416): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccaggggaagggactggagtgggtctcgtctattagtggaagtggtgcttatacaaactacgcagcctccatgaagggccncttcaccatcctccagagactattccaagagcactctgtatctgcaaatgaacagcctgagtgccgaggacacggccctatattatgtgcgaaatggtggggggagtgggggctacgtcctgggtcgttttgactacgtggggccaggggacgcccgtggtcaccgtctcctcagccctccaccagggcccagtccgtccttccccctggccncccgtgcctccgagggagccacccgtccgagcgccacgacggccgcccgtgggcctggcccttagggtaccaaacggggtaccctaccccgttacccacgttccctaacccgtaacccgtaccgttcgggaaaccgggtcccgggtaccgttacggggacccgtaacggggccggtacccgaagttacgggc

SEQ ID NO: 74388 - DNA, 634 bp, Homo sapiens
  misc_feature: GYAE6OF02IBQ08.37.22.B11.1.454.CMB.1.raw
  modified_base (199)..(199): a, c, t, g, unknown or other
  misc_feature (199)..(199): n is a, c, g, or t
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccaggggaaggactggagtgggtctcgtctatagtggaagtggtgcttatacaaactacgcagcctcgtgaaggccnctcaccatcncagagactatcaagncactctgtatctgacaaatgaacagcctgagtgccgaggacacgcctatattatgtgacgaaagtgggtaggggaggtggggctacgtccgtggtcgtttgactacgtcgggaccagggactccgtggtcaccgtctcctcacgccctaccaccgaacgggcccagttccggtacccttccccccgtaggcccgtcccgtcgccgtaccgacgggtacacccgtacccgtaccgaagacgaaccgacgaccggcccgggtaccccgtggggacctcgacccggttacgggtaaccgtaaacgggtaacccttaaccgttcccgaattacccctaaacctaaccgttaacgaccggtacgggcccgggtcgtacgggaacctacggggacctacccgaagttccgagtacg

SEQ ID NO: 74389 - DNA, 565 bp, Homo sapiens
  misc_feature: GYAE6OF02GW3UH.37.22.B11.1.454.CMB.1.raw
  modified_base (337)..(337): a, c, t, g, unknown or other
  misc_feature (337)..(337): n is a, c, g, or t
  modified_base (371)..(371): a, c, t, g, unknown or other
  misc_feature (371)..(371): n is a, c, g, or t
  modified_base (430)..(430): a, c, t, g, unknown or other
  misc_feature (430)..(430): n is a, c, g, or t
  modified_base (479)..(479): a, c, t, g, unknown or other
  misc_feature (479)..(479): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (539)..(539): a, c, t, g, unknown or other
  misc_feature (539)..(539): n is a, c, g, or t
  modified_base (562)..(562): a, c, t, g, unknown or other
  misc_feature (562)..(562): n is a, c, g, or t
tcagtagtgtagatcacgaccggtgctcgatttagacgacagctcagggaaggggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtgggggcttacgtccgtggtcgttttgactacgtgggggccaggggacgtcccgtggtcaccgtctcctcagcctccaccaacgggcccatccggtccttcccccgnggccgccctgcctccaggcgccacctccggagcncacgcgccggcccgtgggctcgccgtggtcgaaacgcttaccttccattctacactacnggacgcgggctgggacgaagggccgacgatacggactgactgctacacncgtntacgctaccnctctctacgacgacgacgtacgcgtacgtacactacgtacgtacgngtcgtacgcgtactacgtacgtntcg

SEQ ID NO: 74390 - DNA, 573 bp, Homo sapiens
  misc_feature: GYAE6OF02H7OZQ.37.22.B11.1.454.CMB.1.raw
  modified_base (313)..(313): a, c, t, g, unknown or other
  misc_feature (313)..(313): n is a, c, g, or t
  modified_base (535)..(535): a, c, t, g, unknown or other
  misc_feature (535)..(535): n is a, c, g, or t
  modified_base (539)..(539): a, c, t, g, unknown or other
  misc_feature (539)..(539): n is a, c, g, or t
  modified_base (541)..(543): a, c, t, g, unknown or other
  misc_feature (541)..(543): n is a, c, g, or t
  modified_base (545)..(573): a, c, t, g, unknown or other
  misc_feature (545)..(573): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgacgaaatggtggggggagtggggggctacgtccgtggcgttttgactacgtggggccgagggagccgtggtcgaccgtctcctcagcctccaccaacgggnaccccccccccccccgtgtccttcccccgtcggccgccctcgcctccgacggacgccgacctaccgacgacgaccaccgacggccggtccccgtgggcgtcggccgtacgggtaccgaaacgggtaaccttaacgtttcccaacttacctaacctaaccgttaacctacgggaacgggcggggtaccgtcgggaccgaaacgggccggaccgaacgttacgnagangnnngnnnnnnnnnnnnnnnnnnnnnnnnnnnnn

SEQ ID NO: 74391 - DNA, 496 bp, Homo sapiens
  misc_feature: GYAE6OF02HHLLE.37.22.B11.1.454.CMB.1.raw
  modified_base (318)..(318): a, c, t, g, unknown or other
  misc_feature (318)..(318): n is a, c, g, or t
  modified_base (386)..(386): a, c, t, g, unknown or other
  misc_feature (386)..(386): n is a, c, g, or t
  modified_base (399)..(399): a, c, t, g, unknown or other
  misc_feature (399)..(399): n is a, c, g, or t
  modified_base (470)..(470): a, c, t, g, unknown or other
  misc_feature (470)..(470): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaaagagccacctctcctgtagggccagtcagagtgtagcagcagctacttagcctggtaccagcagaaacctggccaggctcccaggctcctcatctatgtcatcctcaagggccactggcactccccganaggttcagtggtcgtgggtctgggacagacttcactctcaccatcagcagactagacgccgaagctgngcagtgtatttcngtcagcagtatggcagctcacctcggacgttcgaccaagggacaaggtcggaaatacaaaacgaagttcgnggtctgaccaacgattacctgttacc

SEQ ID NO: 74392 - DNA, 948 bp, Homo sapiens
  misc_feature: GYAE6OF02JPYY3.37.22.B11.1.454.CMB.1.raw
  modified_base (189)..(189): a, c, t, g, unknown or other
  misc_feature (189)..(189): n is a, c, g, or t
  modified_base (219)..(219): a, c, t, g, unknown or other
  misc_feature (219)..(219): n is a, c, g, or t
tcagtagtgtagatcacgaccggtgctcgatttagacgacagctcaggggtccctgagactctcctgtcgcagcctctggattcaccttcagcagctatgccatgacctgggtccgccaggtctccgaggggaacgggacctgggacgtggggtcctcggtctaattagtggaagtgggtcgcgtttanacaaactcgcagccctcgaggacgggtccncgttacacctatccctacaggtagacttactccaagaacgcaaccttctagttactaccgtgacctaaagtacgaaccgtacgccgtttaggaacggttcggaccccggaaggggtaccaccgggtcccctttaaataccgttttaaaccgaggttaaaccggaaaacgttcgggaacccgttaaacggggtataaccgttaaggtaacccgtttaacgttaaacggttttagggggtaacccgtttacggtttaaccgtttaacggaccttttaacccggtttaggggtccgggggttaaccccgggtttagggcccctaaacccgggtttcgggtaaacccgtattcccgggtttaaccgttccccgttagaacccggtaccccgtaaccccgtaaccgaccggggttaacccctacggtttacccggttccccgtttaaccccgtccgggtaacccctcccgggtcctcccgttaccgtaaaccgggcccgttaaacccggcccgttaacccggtaaggaccccggtaaccgaaaccccgggttaacccggtcccgggaaccccgggttaccggggtaccgttcccggtaaacccgggtccgggtttaaacccgaggggtttaaacccctaccgtttaaccccggaactttacccgggtaacccttaacccgtaaccgttccgggaaccggtccgggtaccgtcccgggggttaacacccgggtac

SEQ ID NO: 74393 - DNA, 592 bp, Homo sapiens
  misc_feature: GYAE6OF02IAFQ1.37.22.B11.1.454.CMB.1.raw
  modified_base (434)..(434): a, c, t, g, unknown or other
  misc_feature (434)..(434): n is a, c, g, or t
  modified_base (524)..(524): a, c, t, g, unknown or other
  misc_feature (524)..(524): n is a, c, g, or t
  modified_base (589)..(589): a, c, t, g, unknown or other
  misc_feature (589)..(589): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaaagagcactctgtatctgctaaatgaacagacctgagtgccgaggcacggccctatattattgtgacgaaagtggtgggggagtgggggctacgtccgtggtcgttttgactacgtcgggccaggggacgtccgtgtcgaccgtctcctcacgcctccaccgacggccctatcggtcctcccccgtggccgcctcgctccaggacnccaccgtccgagacacgaccacggccggccccgtgggcctcgtcccgtgggttaccgaaaggtcctaaccgttaccacgttccttaaccncgttaacccgtaggtaaccgggcccgggtattccgggaccgaacgggccgtacgaacgttacggnacg

SEQ ID NO: 74394 - DNA, 866 bp, Homo sapiens
  misc_feature: GYAE6OF02HJRTO.37.22.B11.1.454.CMB.1.raw
tcagtagtgtagatcacgaccggtgctcgatttagacgacagctcaggggtccctgagactctcctgtgcagcctctggattcaccttcagcaactatggcatgcactgggtccgccaggctccaggcaaggggctggaggtgggtggcagttatatcagatgatggagtgtgaggatatgacgagacctccggtaggaacgggccgtattaccaccattcctaccgaaggtacgaacctaaacttaccgaaacgaacctacctaaccttacctacttctacggaacaaataggaaccaacggtccctaggaacgaacgtacgggaacggtaaccgtaaccgggtccgttaggttcggttaacgtccgtaaccgttggtaacggtaacccgggtaaacgggttaagggggggttttacggaaggtacgtacggaccgtaggtcggtagggggtagggtaggtttggtttagggtttttaggtaagttttacggggtacggggtaacggtaaacggggtaacgtaacgggttaccggttaccgtaccggtttaccgtttacgtacccggttaaccggtaccccctaacccgaacgggtaaacccggacccgttaaccggtttcccgggttacccccttcccccgtacgggacccccttaccccgttacgtaccggaaacggtccctaaccggacccgttcgggacccggggacctaaccggtccggcccggggtacccgggtcgggttccgtacccggtaccgttacgggttaccccggtaaggtaacccgtttaacccgtaccgtaacgtttaccctaacggttaaccgtaccggtacggccgggtacccgggttacggtaacggg

SEQ ID NO: 74395 - DNA, 457 bp, Homo sapiens
  misc_feature: GYAE6OF02G41BC.37.22.B11.1.454.CMB.1.raw
  modified_base (413)..(413): a, c, t, g, unknown or other
  misc_feature (413)..(413): n is a, c, g, or t
  modified_base (432)..(432): a, c, t, g, unknown or other
  misc_feature (432)..(432): n is a, c, g, or t
  modified_base (440)..(457): a, c, t, g, unknown or other
  misc_feature (440)..(457): n is a, c, g, or t
tcagtagtgtagatcacgaccggtgctcgatttagacgacagctcagggaagggactggagtgggtctcgtctattagtggaagtggtgcttatacaaactacgcagcctccgtgaagggcctcttcaccatctccagagactattccaagagcactctgtatctgcaatgaacagcctgagtgccgaggacacggccctatattagttgtgcgaaaagtggtggggggagtggggggctactcctggcgttttgactactggggccacggaaccctggtcaccgtctcctcacgcctccaccgaacgggcccatccgggtccttccccctggccaccctcctccaagacgcacctcgtgggggcacacgcggccctgggctggcctggcaaggctacttccatctacactcngaggcggctgggcaaggcncagtacgnnnnnnnnnnnnnnnnnn

SEQ ID NO: 74396 - DNA, 614 bp, Homo sapiens
  misc_feature: GYAE6OF02FND40.37.22.B11.1.454.CMB.1.raw
  modified_base (614)..(614): a, c, t, g, unknown or other
  misc_feature (614)..(614): n is a, c, g, or t
tcagtagtgtagatcacgaccggtgctcgatttagacgacagctcagggggtccctgagactctcctgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcacttctgtatctgacaaatcgaacagcctgagtgccggaggacaccggccctatattattgtgacgaaagtggtagggggggagtcggggggctacgttccgtgggtcgtttttagacgttacgtggggacccgacgggaaccctgggtaccacccgttctccctcacgtccctacccacccgaacgggcccctacgtccggttccctttccccccgtggcccctacccttccctaccaacgacgcctaccgtcggtcggggccacgcgccggccctgggctcgcgtcggtcaacggaccttaccttcacttactaccaccgttactggacggccgggtcgacgggacgaacgggcccgacgaagtacggatcgagtacn

SEQ ID NO: 74397 - DNA, 487 bp, Homo sapiens
  misc_feature: GYAE6OF02FMU9E.37.22.B11.1.454.CMB.1.raw
  modified_base (335)..(335): a, c, t, g, unknown or other
  misc_feature (335)..(335): n is a, c, g, or t
  modified_base (471)..(487): a, c, t, g, unknown or other
  misc_feature (471)..(487): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatggtggggggagtggggggctactcctggcgttttgactacgtgggggccaggggacgccctggtccaccgtctcctcacgcctcccaccaacgggcccagtccggtccttcccccgnggccgccctggcctccgaggacgccaccctccgagacgccacacggccggcccgtgggcctggcccgtgggtaccaaagggtactaccgttccatcctaacactacgtgacgcgggtctggacaggcgacactagnnnnnnnnnnnnnnnnn

SEQ ID NO: 74398 - DNA, 681 bp, Homo sapiens
  misc_feature: GYAE6OF02GN794.37.22.B11.1.454.CMB.1.raw
  modified_base (172)..(172): a, c, t, g, unknown or other
  misc_feature (172)..(172): n is a, c, g, or t
  modified_base (226)..(226): a, c, t, g, unknown or other
  misc_feature (226)..(226): n is a, c, g, or t
tcagtagtgtagatcacgaccggtgctcgatttagacgacagctcagggaactgctcagttaggacccagacggaaccatggaagccccagcgcagcttctcttcctcctgctactctggctcccagatatcactggagaaatagtgatgacgcagtcctccagccaccctntctgtcgtctccgaggagaaagcgcccaccctctcctggtacgggccagtcagngtgttagctacaacttgcctggtaccagcagaacctcggcctacggttccaggcctcatcattctagtggtcgactactcccaacgacggccacgtcggtactccccagtccccttaacgtttgcggtccgtaggttcggggtctacggggaactacggtacgttaccgacctttccgtaccaacctacgttccaacggtccgtacggtccctgaccgtagttacgtaggtaagtttactttggaccgtttaagtttttacttaacgttcgttaacctaacgtaacgttacctaagttcggaaccgttcgttacccgtacttacggtaccgtttcggggaaccggtaacgggaaccgtaaggggtcggaacgttaagtaccggtaaaaccggttagttcggtacggtcctcggaacccgttacgtcgtttaccgttcggttccttacgttacccg

SEQ ID NO: 74399 - DNA, 704 bp, Homo sapiens
  misc_feature: GYAE6OF02JB64Y.37.22.B11.1.454.CMB.1.raw
  modified_base (171)..(171): a, c, t, g, unknown or other
  misc_feature (171)..(171): n is a, c, g, or t
  modified_base (304)..(304): a, c, t, g, unknown or other
  misc_feature (304)..(304): n is a, c, g, or t
tcagtagtgtagatcacgaccggtgctcgatttagacgacagctcaggaactgctcagttaggacccagacggaaccatggaagccccagcgcagcttctcttcctcctgctactctggcctcccagatatcactggagaaatagtgatgacgcagtctccagccaccctntctgtgtctaccaggagaaaagcgacccaccctctcctggtacgggccagtcagagtgtacgctacaattagcctaggtaccagacaagaaacctggaccctaggttcccaggctacatccaatctatggtcncgtaactcccgaaccgagggccctaacgtggtaacctacccgagtaccccttaacgtttaggcggactaggtaggggttcctagggacgtaagtaggttccaacttacgtaccgacctaagtaccgacgtaccacggtaccctggactacgggtacgtaggacgggtattagggtcggtaacgttagttttaaacttcgttacgccgtaagtaccttaaggttaaacttttaacaaaacttcccgttacccttaaccgggtacggtttaacccggaacccgtaaaacgggttaaccgaaagggttaaccgaaagttaaccgtaaaacgaacgttaggtaccggttaccgacgttaccgaaccctttgacccgtttagtcctttaacgtcccttaaccccg

SEQ ID NO: 74400 - DNA, 753 bp, Homo sapiens
  misc_feature: GYAE6OF02F0FVC.37.22.B11.1.454.CMB.1.raw
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagcccaccctctctgtgtctccaggagaaagagccaccctctcctgtacgggccagtcagagtgttagactacaacttacgcctggtaccagacacgaaacctggaccaggcctacccgaggcctcctacacttactacgtggtcgactacgtcccgaccgtacgggccctacgttacggtaacctccccgaacggtccccttaaccgttttaacggtcggggaccgttagggtaccgggggttcctagggggaacctacggtacggtttaccaccgttcctaccaacctacgtaccaacggtccacggtccgtacgtaccgtaggttcctaagggtaaaagtttcgttttacgccgttttaagttttacgttcgttacgttacgtacgtacgttaagtttaacttaacgttaccgtacggtaccccgtttaccgttacggtacggggttaacccgtttacggaaccggtaaacggggtaaccgtaagggttacggtaaactaccgggtaaaaacgtacggtttaccggtacggtccgtaacgggccctaaaccggttcgttaccggttacgtttacccgtacgttaccccgg

SEQ ID NO: 74401 - DNA, 773 bp, Homo sapiens
  misc_feature: GYAE6OF02FHBSZ.37.22.B11.1.454.CMB.1.raw
tcagtagtgtagatcacgaccggtgctcgatttagacgacagctcaggggtccctgagactctcctgtgcagcctctggattcaccttcagcagctatgccatgacctgggtcccgccagtctccgaggggaaggggctggagtgggtcggccaacatacagggaggtggtggtacgaaaaactatgtggactctgtgcgggccattcaccatctcagagacaacgaccaaaaactcactgtactctgacaaagtgggaccggcctagagtactccggacggacgacggcttggttagttagtttattggtcgacggtagaagttatttaacgtaactaaacgttaaaggttttccgaagggttacgtaccgttagggttacttaggtacgttcgtaccgtttagtacggtaaccgttaccggggtacgggggaacccgaaacggggacctaggttaccggtacctacccggtttctacctttccgacgtcccctacccgaaccggtaaccgggtcccctacggttcccggtttacccccgtttcccccggtacgggtccccgtccccttcggttaccccgtaccgtacgggaacccgtcccgtaccccggtaaccggaacggaccgaccgtaaccgaccgggtccccggtacccggttcggggacctttccgggacccgttacgggtaaccgtacggtaccctttacccgttactaccgttacctaaccgtaaccgtcgtaggaccggcgggtacacgggtacgacggtccg

SEQ ID NO: 74402 - DNA, 458 bp, Homo sapiens
  misc_feature: GYAE6OF02FTLWO.37.22.B11.1.454.CMB.1.raw
  modified_base (447)..(458): a, c, t, g, unknown or other
  misc_feature (447)..(458): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaatgaacagcctgagtgccgaggacacggccctatattattgtgcgaaatgtggggggagtgggggctactcctggcgttttgactacgtgggggccagggagccctggtcaccgtctcctcagcctccaccaagggcccagtccggtccttcccccgtggccgcccctgcctccgaggacgccaacctcccggagacgcaccgagccggccctgggctcgcctggtcaaggcctacttccatcctacactactgacggcggcgtggcgaaggcgcatgnnnnnnnnnnnn

SEQ ID NO: 74403 - DNA, 652 bp, Homo sapiens
  misc_feature: GYAE6OF02H8PX5.37.22.B11.1.454.CMB.1.raw
  modified_base (114)..(114): a, c, t, g, unknown or other
  misc_feature (114)..(114): n is a, c, g, or t
  modified_base (168)..(168): a, c, t, g, unknown or other
  misc_feature (168)..(168): n is a, c, g, or t
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
tcagtagtgtagatcacgaccggtgctcgatttagacgacagctcaggggtccctgagactctcctgtgcagcctctggattcaccttcagcagctatgccatgacctgggtcncaggctccagggaggactggagtgggctcgtctatagtggaagtggtgccttanacaaactacgcagcctaccgtgaacggccncttcacatcncagngactntcaaagncatctgtatctganaatnaacagcctgatggaccgaagacacggtaccctaatatttacttgacgtacgaaagtgggtgggggaggtgggtacgtactcgtcggtgtttcgactaggtcggacgagggctccgtggtcacgtcctccgtgaccgtcccaccgaccgaccggccctacgtccgttccctaccccgtggcccgcccttgccgttaccgacgggtcaccgtaacccgtacctacgggacaccgaaccggtcggtacccgggtcccgttaccgggacggttcccggtaccgggttccgggttaacgtaacccggggattaacccggtttacctaaccgtacccgttaacctaccggtaaccgttaacgggacggtaccggggtcgttacgggacgaccgggtaacaggtaccgtagagtacg

SEQ ID NO: 74404 - DNA, 642 bp, Homo sapiens
  misc_feature: GYAE6OF02HGSXT.37.22.B11.1.454.CMB.1.raw
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
tcagtagtgtagatcacgaccggtgctcgatttagacgacagctcaggaactgctcagttaggacccagacggaaccatggaagccccagcgcagcttctcttcctcctgctactctggctcccagatatcactggagaaatagtgatgacgcagtctccagccaccctctctgtgtctccaggagaaagacgcccaccctctcctggtacgggccagtcagagtgttagctacaacttagcctggtaccagcaagaacctggacctaggttcccaggctcatcactctagtggtncactaccaccgaggccacgtgtactccgacgccttaccgttagnggctagggtcgggtcgtgggacaggtcgttaccacttctacacatcgacgacgacgccgtgactaggtctaggtaagttagtttcgactttaagttttaacttacgttacgtaacctaaacgtacttaacaagttacggtaccgtcggtcccttaccgtacgttaccgttaccggggaccgggtaaacgggtacccgtaaggggtcggtaacgtaaccggtaaacggtaaacgtaacggttcggtaacggtccgttacgaacccgttacctagttcccgtttggtttaccttcgttaacccg

SEQ ID NO: 74405 - DNA, 703 bp, Homo sapiens
  misc_feature: GYAE6OF02HQR1Z.37.22.B11.1.454.CMB.1.raw
  modified_base (136)..(136): a, c, t, g, unknown or other
  misc_feature (136)..(136): n is a, c, g, or t
  modified_base (157)..(157): a, c, t, g, unknown or other
  misc_feature (157)..(157): n is a, c, g, or t
  modified_base (168)..(168): a, c, t, g, unknown or other
  misc_feature (168)..(168): n is a, c, g, or t
  modified_base (191)..(191): a, c, t, g, unknown or other
  misc_feature (191)..(191): n is a, c, g, or t
  modified_base (335)..(335): a, c, t, g, unknown or other
  misc_feature (335)..(335): n is a, c, g, or t
  modified_base (442)..(442): a, c, t, g, unknown or other
  misc_feature (442)..(442): n is a, c, g, or t
  modified_base (674)..(674): a, c, t, g, unknown or other
  misc_feature (674)..(674): n is a, c, g, or t
tcagtagtgtagatcacgaccggtgctcgatttagacgacagctcaggaactgctcagttaggacccagacggaaccatggaagcccagcgcagcttctcttcctcctgctactctggctccagatatcatggaanaaatagtgatgacgtcagtcncacgccacctntctgtctctcgaggaagaaagcncccacccttctccgtaggtacggacctagtacaggtagttgttacgacctaactaacttaggccttaggtaaccagtacggaaactaaaccgtggaccctaacggttcccgaggccttacgaactctaagtactaaggtcggtnactacctaccgacggacggacctagtcgtaactccacgtacccttaacgttaggcgacgtggttcgggtacgtaggaacaggttacgtcctaacttccacgaaactntacgacgtacgacgtcctagtacgtagtacgtaagtaaacgtttattcggacttttaaagttacgttacgttacgtaacgtaaactaagtaacctagtaccgacgttacctacccggttacttacggtacgggttaccggggacgggtaaacggaaaccgggtaaggtacgggtaactaacggtaaaccggaaacggtaccgttagggccgttaacgacgaccgttaacgtntttaacccggtgttaccttacgtacccgg

SEQ ID NO: 74406 - DNA, 647 bp, Homo sapiens
  misc_feature: GYAE6OF02G3JMU.37.22.B11.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (333)..(333): a, c, t, g, unknown or other
  misc_feature (333)..(333): n is a, c, g, or t
  modified_base (644)..(644): a, c, t, g, unknown or other
  misc_feature (644)..(644): n is a, c, g, or t
tcagtagtgtagatcacgaccggtgctcgatttagacgacagctcaggggtccctgagactctcctgtgcagcctctggattcaccttcagcagctatgccatgaccttgggccgccaggctccagggaaggactggagtgggtctcgtctattagtggaagtggtgcttatacaaacgtcgcagcctcgtgaagggccncttcaccgtatcgccanacgacttagttaccaagtacgcctacttcgttagttaatccgttagacctaaaagtcggaaacagtccgtggacgttcggaccggaggacctaccggccctaattatttattcggngacgaagttgggaggggggtagtggggtcctacgttccgtgggttacgttttcgaacttcggtcggggtaccaaggggctccccgttgggtaccctccggttccttaccgccacggtcccctaccaaccggagggacccctaagttccccgttccctaccccggtggaccgtcccctaggtccctccggaagcccgacctcccggtacaagccgacacgtcgccgacgtcgctcggaccttgacgagtacctacgtccaagtctaaccgtgactaggcggttcggctacgggaccacgggtccaagtactncga

SEQ ID NO: 74407 - DNA, 689 bp, Homo sapiens
  misc_feature: GYAE6OF02GFE3X.37.22.B11.1.454.CMB.1.raw
  modified_base (256)..(256): a, c, t, g, unknown or other
  misc_feature (256)..(256): n is a, c, g, or t
tcagtagtgtagatcacgaccggtgctcgatttagacgacagctcaggggtccctgagactctcctgtgcagcctctggattcaccttcagtagctatagcatgaactgggtccgccaggctccagggaaggggctggagtgggtctcatccattagtagtagtggtacttacatatactacgcagactcagtgaggggccgattcaccatctccagagacaacgccaagaactcactgtatctgacaaatgaacngcctgagagccgaggacacggctgtagtattacgtgtcgcggagacgtcccctacacctcagcagcgagcggtacgtacgttcggcggggacccaacggggtaaccccgtggttacccgacccgtttccgtcccgtacgaccgtcccctacccgaaccgtaacggggcccctacggttcccggttcccctttcccccgtacggtaccctacccctccgtacccgaaacgcgtacccgaccgttccgggtaccggggaccaccggtaccgggcccgggtacccggtgggtcccgttacggtcccggttcggtaaccgtaacgggtaacccttacccgttacgaccttaccctaaccgtaaccgttaccggtacggtaccgggtaccgggttaacgcgggaacccggtaacgggccgtaccgtaggtcggacgtg

SEQ ID NO: 74408 - DNA, 523 bp, Homo sapiens
  misc_feature: GYAE6OF02F5N3T.37.22.B11.1.454.CMB.1.raw
  modified_base (276)..(276): a, c, t, g, unknown or other
  misc_feature (276)..(276): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
  modified_base (491)..(523): a, c, t, g, unknown or other
  misc_feature (491)..(523): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaaatgaacagcctgagtgccgaggacacggccctatattattgtgcgaaatggtgggggggagtgggggctactccgtggtcgttttgacttacgtgggggccagggngcccgtggtcaccgtctcctcagcctcccacacgggcccagtcggtccttcccccgnggccgccctgccctccgaggacnccacctccgagngccaacncgcggtcccgtcgggtcnggtccctgggtaccaaagggtccttacgttccctatcctaaccacccttaactcgggtaaggccgggcgtcggaccggagggcctagaagttacgcgnnnnnnnnnnnnnnnnnnnnnnnnnnnnnnnnn

SEQ ID NO: 74409 - DNA, 629 bp, Homo sapiens
  misc_feature: GYAE6OF02GGEJU.37.22.B11.1.454.CMB.1.raw
  modified_base (208)..(208): a, c, t, g, unknown or other
  misc_feature (208)..(208): n is a, c, g, or t
  modified_base (531)..(531): a, c, t, g, unknown or other
  misc_feature (531)..(531): n is a, c, g, or t
tcagtagtgtagatcacgaccggtgctcgatttagacgacagctcaggggtccctgagactctcctgtgcagcctctggattcaccttcagcagctatgccatgaccgtgggtccgcaggctccgaggggaaggactgggagtgggtctcgtctagttagtggaagtggtgcttataacaaactacgcacgcctcgtggacggccgtnttcgaccatcctaccagacgactaatccaaacgaacctctcgtctcagtacaatacaacactgacgacgcgagaccgacggcctatacttactagtaaacgtaaagtcggtactaacggtatacgtacgtaactactagtaggacttagtacgttacgtacgtcgtcggtcggggccgtcggcctaccgtggtcctacgtcgttcgtccttcgacgtccctaccgaaccggtaccggtaccctacgttccggttaccccgttcccgtacggcccgtcctccggtcctaccgggacggtcgacccgtaccgaccgtagccgacnccgacggccgccgtcggcgtcgacgtcgacgtacgtaccttcgttcacgtacctactacgtacgcggcggtacgcgttacggacacggtcacgtagcg

SEQ ID NO: 74410 - DNA, 661 bp, Homo sapiens
  misc_feature: GYAE6OF02IXI90.37.22.B11.1.454.CMB.1.raw
  modified_base (575)..(575): a, c, t, g, unknown or other
  misc_feature (575)..(575): n is a, c, g, or t
  modified_base (592)..(592): a, c, t, g, unknown or other
  misc_feature (592)..(592): n is a, c, g, or t
  modified_base (614)..(614): a, c, t, g, unknown or other
  misc_feature (614)..(614): n is a, c, g, or t
  modified_base (618)..(618): a, c, t, g, unknown or other
  misc_feature (618)..(618): n is a, c, g, or t
  modified_base (628)..(628): a, c, t, g, unknown or other
  misc_feature (628)..(628): n is a, c, g, or t
  modified_base (646)..(646): a, c, t, g, unknown or other
  misc_feature (646)..(646): n is a, c, g, or t
tcagtagtgtagatcacgaccggtgctcgatttagacgacagctccagggaagggactggagtggtctcgtctattagtgaagtggtgcttatacaaactacgcagcctccgtgaaggccgcttcaccatctcagagactattccaagagcactctgtatctgacaaatgaacagctgagtgccgaggacaccggccctataattacttagtgtcgtaaagtcggtggggggagttcgggggactaccgttccgtggtcgttttagacctacggtcggggccagggacgtccctggtctaccgtacctccctcgagtccctaccaccgaacgggtccccacgttaccggtccgttccccccgtagggcccgtacccgtcgacctacccggagggaccgtaccgtccctaaccggacgaaggtcccgaacaccggtcccggaccggtacgggcttcggccgttaggtcccgaaacggtaccttacctaccaagttactaccctacttactacgggacggtcggggtcgtacgggtcccggaaacggtccggacgtaacggttagactacggtccgngtcgcgtgtcgtcgtancgcacgttgagtcgtacgtgtntacncgacgtcacncgtacgtgtcgtactctntacgtactgtagtcg

SEQ ID NO: 74411 - DNA, 721 bp, Homo sapiens
  misc_feature: GYAE6OF02GUEEJ.37.22.B11.1.454.CMB.1.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (464)..(464): a, c, t, g, unknown or other
  misc_feature (464)..(464): n is a, c, g, or t
tcagtagtgtagatcacgaccggtgctcgatttagacgacagctcagggggtccctgagactctcctgtgcagcctctggattcaccttcagcagctatgccatgacctgggtccgcaggctccgaggggaagggactggagtgggtctcggtctattaggtggaagtggtgacttatacaaactcgcgagcctccggtgaagggccncttcaccatcctccagngactatccaagaaccnccctagtctcgtgacaaatgaaccacctaggacgagccgaaggaaccacggtaccctaattacttacgtagtaacgaaagtcggactacggatatcgactacgtagttcggacgttggttactacgtacgtctacggacggggccgtgcctaccgtgactactgtcctcgtcaccgtccctacgaaccggacggtaccctacgtccggttaccccttccccgngggtcccacccggttgacccgttccggaggtaccgtacccgtacccgtacggacgtaccgtccgtaaccgccggggcccggtacccggtggggtccggttacccggccggttaacgggttaccctaaaccgggttaccccgttaaccgttaccgttaaccgttacccggttaaaccctacggtttaaaccggtcggtaccggggttaccgggtacggaccgggtaaccgggttaaccggaccgtacggaacttacgg

SEQ ID NO: 74412 - DNA, 822 bp, Homo sapiens
  misc_feature: GYAE6OF02F8OU7.37.22.B11.1.454.CMB.1.raw
  modified_base (204)..(204): a, c, t, g, unknown or other
  misc_feature (204)..(204): n is a, c, g, or t
  modified_base (822)..(822): a, c, t, g, unknown or other
  misc_feature (822)..(822): n is a, c, g, or t
tcagtagtgtagatcacgaccggtgctcgatttagacgacagctcaggggtccctgagactctcctgtgcagcctctggattcaccttcagcagctatgccatgacctgggtccgccaggctccgagggaagggactggagtgggtctcgtctattagtggaagtggtgcttataacaaactacgcagcctccgtgaagggccncttcaccatctccagagactattaccaaagacgcactctgttatctgactaaatacgaaacagtccgtaggtaaggtcggaccgggaacgggtaaccgaccgggtaccccttaattaattttacgttggttacggaacggtaaaggtgggggtgggggggtagggtcgggggtaccttcgtaccggttgggttcgttttaggaaccgttacgggtcggggacccggaaggggtaccgtccccggttacgggtccgtacccgttcctccctacggtacccgtccccttaacccgaacccgggaaccggggtcccctaaacggtttccccgggtttccccctttaccccccgggtcgggtcccccgttaccccggttcgacccccggttaccgggaaccggggtaacccgtaccccggttaaccccgttaccgggaaccggtaaccggtaccccgaaacccggtccggggaccccgggtcccgggtacgggtccgtccggtacccgttagggtacccgtaaacggttaccctttaaccgttacaccgttacctaccgttaacgtcgtacggtacgggtccgggtacgtacggaccgggaaggtccgaagtacggtcagtn

SEQ ID NO: 74413 - DNA, 645 bp, Homo sapiens
  misc_feature: GYAE6OF02GA1SH.37.22.B11.1.454.CMB.1.raw
  modified_base (172)..(172): a, c, t, g, unknown or other
  misc_feature (172)..(172): n is a, c, g, or t
tcagtagtgtagatcacgaccggtgctcgatttagacgacagctcagggaagggactggagtgggtctcgtctattagtggaagtggtgcttatacaaactacgcagcctccgtgaagggccgcttcaccatctccagagactattccaagagcactctgtatctgcaaatnaacagcctgagtgcgaggacacggccctatattattgtgcgaaatgtgggggagtgggggctacgtcctggcgttttgactacgtggggccagggacgccctggtccaccgtcgtcctccagcctccaccaagggcccagtcgtccttccccctggccgccctgcctccgaggacgcacccgtccggagtacgccaacgacggccggaccccgttgggccttacggcccgttagggccgtaaaggacccggttaacccttttcccggaacttacccgtaccgtaaaccttacggacggtacggccggggtaccttcggggaactaaacggggccgtaacccgtagttaaccgggctagacgtacgacgtacgacgtgtacgtacgtacgcgtccgtcgcgtacgtcgacgtacgtacgacgtacgacgacgtacgtcgtacgtcgtacgtacgtacgtacgcgtactagtacg

SEQ ID NO: 74414 - DNA, 839 bp, Homo sapiens
  misc_feature: GYAE6OF02JT73M.37.22.B11.1.454.CMB.1.raw
  modified_base (221)..(221): a, c, t, g, unknown or other
  misc_feature (221)..(221): n is a, c, g, or t
  modified_base (756)..(756): a, c, t, g, unknown or other
  misc_feature (756)..(756): n is a, c, g, or t
  modified_base (830)..(830): a, c, t, g, unknown or other
  misc_feature (830)..(830): n is a, c, g, or t
tcagtagtgtagatcacgaccggtgctcgatttagacgacagctcaggaactgctcagttaggacccagacggaaccatggaacgcccagcgcagcttctctcgtcctgactctctggcctccagatactcgaccgtgggaagtaaattggtagacgttacgaccgtcgagtcctaccacggtcccaaccttcgtacgtcgtacgtccgtacgagggaaanaaacggccacccgaccgttccgttaccggtacgggtacgggacccgtaacgttacgaaggttaggtacggtttacgacctaaccgttaaccggttaacggccgttaaggtacccgaacgtaccgtaacggtaaccgttacgggaaccgttaccgggttaccccgtaacggccttaccggtaaccttacgtaccttaccgttaacggttggtaccgtaccgttaccgaaccgtacccgggttaacggtaccgtaaccgtacggtaaccctacccgtaaccgtccccgtaaagtttacggcggtacgtacgggttccgggtgtacgggtaccgtaaggtccggtaactacgtacctacggacttacggactacggacctagtccgaactgtacgtaccgtagtaaacggtttacttacggtaactttacggttaacttacgtaaccggttaccttaacgtaaacctacggtaacgttaaccgttaacggtccgttacctaacgttcccgttacggttcggtaaacggtaaccggtanaccgggtaatacggacgtaacggtaacgtaccgtaggtaccgacttacggaccgtactacgttctacgttaccncgtttaccg

SEQ ID NO: 74415 - DNA, 167 bp, Homo sapiens
  misc_feature: GYAE6OF01BZKUW.44.57.F02.1.454.CMB.1.raw
  modified_base (160)..(160): a, c, t, g, unknown or other
  misc_feature (160)..(160): n is a, c, g, or t
  modified_base (166)..(167): a, c, t, g, unknown or other
  misc_feature (166)..(167): n is a, c, g, or t
tcagacagtatatacacgaccggtgctcgatttagctcgatatagttgggtttgggggcggagggaccaaactgaccgtcctgggtcagcccaaggctgccccctcggtcactctgttcccaccctcctctatatactgtctgagcgggctggcaaggcncatagnn

SEQ ID NO: 74416 - DNA, 209 bp, Homo sapiens
  misc_feature: GYAE6OF01DVT48.44.57.F02.1.454.CMB.1.raw
  modified_base (186)..(186): a, c, t, g, unknown or other
  misc_feature (186)..(186): n is a, c, g, or t
  modified_base (192)..(209): a, c, t, g, unknown or other
  misc_feature (192)..(209): n is a, c, g, or t
tcagacagtatatacacgaccggtgctcgatttagctcgatatagttgggtttgggactccagccttggtggtggggttttcggcggagggacccgactgaccgtcctaagtcagcccaaggctgccccctcggtcactctgttcccgcctcctctatatactgtctgagcgggctggcaagggcncatagnnnnnnnnnnnnnnnnnn

SEQ ID NO: 74417 - DNA, 164 bp, Homo sapiens
  misc_feature: GYAE6OF02IXS5G.44.57.F02.1.454.CMB.1.raw
  modified_base (164)..(164): a, c, t, g, unknown or other
  misc_feature (164)..(164): n is a, c, g, or t
tcagacagtatatacacgaccggtgctcgatttagctcgatatagttgggtttggggcggagggaccaaactgaccgtcctgggtcagcccaaggctgcccctcggtcactctgttcccgccctcctctatatactgtctgagcgggctggcaaggcgcatagn

SEQ ID NO: 74418 - DNA, 192 bp, Homo sapiens
  misc_feature: GYAE6OF02FFG0L.44.57.F02.1.454.CMB.1.raw
  modified_base (191)..(192): a, c, t, g, unknown or other
  misc_feature (191)..(192): n is a, c, g, or t
tcagacagtatatacacgaccggtgctcgatttagctcgatatagttgggtttgggactccagccttggtggtggggttttcggcggagggacccgactgaccgtcctaagtcagcccaaggctgcccctcggtcactctgttcccgccctcctctatatactgtctgagcgggctggcaaggcgcatagnn

SEQ ID NO: 74419 - DNA, 167 bp, Homo sapiens
  misc_feature: GYAE6OF02IAYPJ.44.57.F02.1.454.CMB.1.raw
  modified_base (166)..(167): a, c, t, g, unknown or other
  misc_feature (166)..(167): n is a, c, g, or t
tcagacagtatatacacgaccggtgctcgatttagctcgatatagttgggtttgggggcggagggaccaaactgaccgtcctgggtcagcccaaggctgccccctcggtcactctgttcccgccctcctctatatactgtctgagcgggctggcaaggcgcatagnn

SEQ ID NO: 74420 - DNA, 507 bp, Homo sapiens
  misc_feature: GYAE6OF01EHYU3.35.19.B08.1.454.CMB.1.raw
  modified_base (414)..(414): a, c, t, g, unknown or other
  misc_feature (414)..(414): n is a, c, g, or t
  modified_base (498)..(498): a, c, t, g, unknown or other
  misc_feature (498)..(498): n is a, c, g, or t
  modified_base (502)..(507): a, c, t, g, unknown or other
  misc_feature (502)..(507): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccaggggaaccctggtcaccgtctcctcagcctccaccaagggcccatcggtcttcccctggcgccctgctccaggcncacctccgagagcacagccggccctgggctgcctggtcaagggacctacttccacgactctgtactgagcgggctggcaggcgnatgnnnnnn

SEQ ID NO: 74421 - DNA, 632 bp, Homo sapiens
  misc_feature: GYAE6OF01CHA0Q.35.19.B08.1.454.CMB.1.raw
  modified_base (622)..(622): a, c, t, g, unknown or other
  misc_feature (622)..(622): n is a, c, g, or t
  modified_base (624)..(624): a, c, t, g, unknown or other
  misc_feature (624)..(624): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagtaaatttcgagggccggtcaccatgaccaggacacgtcagcaacacaactatatggagtgaatggactgagatctgacgacacggctatatactgtgtgcgagatattgactacgtgggccagggaaccctggacaccgtctcctcacgtcctaccgaccgaacgggcccctagtccggtaccctttccccccgtacgggcccgtccccgtcgccctacccgacgggacgacccaacccgtccggaacgaccgccaaccgacggcccgggccccgtggggcccgtcggtcccgtagggttcccgaaacgggtacccttaacccgttcccgaaccggtactaccgttcggtaccgtcgggaacggccggggccgtaggggtacccgaaacgggtccgacgtaacgttacggnancgngngng

SEQ ID NO: 74422 - DNA, 522 bp, Homo sapiens
  misc_feature: GYAE6OF01C4NLP.35.19.B08.1.454.CMB.1.raw
  modified_base (517)..(522): a, c, t, g, unknown or other
  misc_feature (517)..(522): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactgggccagggaaccctggtcaccgtctcctcagcctccaccaacgggccccagtccggtccttccccctcggccgccctcgcctcccaggacgcaccctccgacgagcacagccggccctgggctggcctggtcaaggtactaccttccacgatctgtactgagcgggctggcaaggcgcagtagnnnnnn

SEQ ID NO: 74423 - DNA, 523 bp, Homo sapiens
  misc_feature: GYAE6OF01C1U45.35.19.B08.1.454.CMB.1.raw
  modified_base (516)..(523): a, c, t, g, unknown or other
  misc_feature (516)..(523): n is a, c, g, or t
tcagtacagatcgtcacgaccggtgctcgatttagtgagtcagtaaggggctgaaatgaagaagtctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaaatggactgagatctgacgacacggccgtatattactgtgtgcgagatatgactactggggccagggaccctggtcaccgtctctcagcctccaccaagggcccatccggtccttccccctggcccaccctcctccaagacgccacctcgtgggggcaccgaggcccggccctgggcctgcctggtcaaggacctacgttccacgactctgtactgacgcgggctgggcaaggcgcatagnnnnnnnn

SEQ ID NO: 74424 - DNA, 681 bp, Homo sapiens
  misc_feature: GYAE6OF01BMVSD.35.19.B08.1.454.CMB.1.raw
  modified_base (176)..(176): a, c, t, g, unknown or other
  misc_feature (176)..(176): n is a, c, g, or t
  modified_base (676)..(676): a, c, t, g, unknown or other
  misc_feature (676)..(676): n is a, c, g, or t
  modified_base (679)..(679): a, c, t, g, unknown or other
  misc_feature (679)..(679): n is a, c, g, or t
tcagtacagatcgtcacgaccggtgctcgatttagtgagtcagtaagggctgaaaggtggaagaaagccgtggggccgtcagggtgaaggtctacctgcgaagtacttctggactacgaccttcaccgtaatactttatacactgggtgcgacaggcccgtggaccaaggggtttnagtggctggggcggactcagccctaagagtcggtgccacgactctctggcacaggaaactttcaggccggtacaccatagaccagggaccacgtacagtacaacactaacctataataggaaagttagaagtggtactacgagatacgtaggaccgaacgacggaccgtactacgtttaacgtgttgtcgcgaagtactagttcgacttaccgtacggggacctacgggggaaccctgggtaccaaccgttctacgtcgacgtccgtacccgaccgtaaacggggccctaagttccgggttcccttacccccgttgggcccgaccccttggtccctacccgaggacgcctaaccgtccggaagacgacgaacgacgtccggaccgtgggtcttcgtccgttgggtaccaacgggtacttaccgtttcccgtaattccgttacggtacgtcggtacggaccggggtacgtcgggacgtaagggcacgagtaacggcagagntgncg

SEQ ID NO: 74425 - DNA, 531 bp, Homo sapiens
  misc_feature: GYAE6OF01ALG99.35.19.B08.1.454.CMB.1.raw
  modified_base (527)..(531): a, c, t, g, unknown or other
  misc_feature (527)..(531): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggtgccagggaaccctggtcaccgtctcctcagcctccaccaaggcccagtccggtcttccccctggccgccctgcctcccaggacgccacctccgagacgcacacgcggccctgggctcgcctggtccaaaggaccttacttccgacgtactctgtactggacggccgggctcgggcaagggccgcgacgtagnnnnn

SEQ ID NO: 74426 - DNA, 521 bp, Homo sapiens
  misc_feature: GYAE6OF01DTDZT.35.19.B08.1.454.CMB.1.raw
  modified_base (512)..(512): a, c, t, g, unknown or other
  misc_feature (512)..(512): n is a, c, g, or t
  modified_base (517)..(521): a, c, t, g, unknown or other
  misc_feature (517)..(521): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtcaccgtctcctcagccctccaccaagggccccagtccggtccttccccctcggccgcccctgcctcccgaggacgcaccgtccgagacgcacgagccggccctgggcctgcctggcaagggctacttccacgatctgtactgagcgggctggcaaggcgnatagnnnnn

SEQ ID NO: 74427 - DNA, 568 bp, Homo sapiens
  misc_feature: GYAE6OF01A8KQ3.35.19.B08.1.454.CMB.1.raw
  modified_base (563)..(568): a, c, t, g, unknown or other
  misc_feature (563)..(568): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactagtggggccagggaaccctggtcaccgtctcctcacgcctccaccaagggccccagtccggtccttcccccgtggccacccctcctaccaagacgcacctccgtcggggccacacggccggcccgtgggcctcggccgtcggtccgaaggtacctaccgttcccaacgtactccgtacgtacgtcgaggccggggcgttcgggccgtaaaggggccggcgtaagtacggcacgnnnnnn

SEQ ID NO: 74428 - DNA, 530 bp, Homo sapiens
  misc_feature: GYAE6OF01A4NEO.35.19.B08.1.454.CMB.1.raw
  modified_base (525)..(530): a, c, t, g, unknown or other
  misc_feature (525)..(530): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactactggggccaggggaaccctggtcaccgtctcctcagcctcaccaagggcccagtccggtcttccccctggccgccctgcctccaggacgcacctccgagacgccacacgccggcccgtgggcctcggccgtcgggtcaacgggtacctacttcccacgactcgtgtactgaggcgggcgtggcgaggcgcagtagnnnnnn

SEQ ID NO: 74429 - DNA, 583 bp, Homo sapiens
  misc_feature: GYAE6OF01BT963.35.19.B08.1.454.CMB.1.raw
  modified_base (576)..(576): a, c, t, g, unknown or other
  misc_feature (576)..(576): n is a, c, g, or t
  modified_base (578)..(578): a, c, t, g, unknown or other
  misc_feature (578)..(578): n is a, c, g, or t
  modified_base (580)..(581): a, c, t, g, unknown or other
  misc_feature (580)..(581): n is a, c, g, or t
  modified_base (583)..(583): a, c, t, g, unknown or other
  misc_feature (583)..(583): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccaggggaaccctggtcaccgtctcctcagcctccaccaagggccccagtccggtccttccccccgtggccgcccctgcctccgaggacgccaccgtccgagacgccacacggccggcccgtcggggcctcggcccgttgggtaccgaaacgggtaccttaccttacccgaacggtacttaccgttcggtaccgttggacggtccggggtcgtgggacgaaacgggtccgacgagtagnancnngn

SEQ ID NO: 74430 - DNA, 553 bp, Homo sapiens
  misc_feature: GYAE6OF01EPR2I.35.19.B08.1.454.CMB.1.raw
  modified_base (546)..(553): a, c, t, g, unknown or other
  misc_feature (546)..(553): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccaggggaaccctggtcaccgtctcctcagcctccaccaagggcccatccggtccttccccctggccacccctcctccaaacgacgccacctcgtcggggaccaccgacgccggcccctggggcctcggcccgttgggtaccgaacgggaccttaccgttcccaacgtacttctcggtacctggacgcgggctggcaagggcgcatagnnnnnnnn

SEQ ID NO: 74431 - DNA, 561 bp, Homo sapiens
  misc_feature: GYAE6OF01BKBTR.35.19.B08.1.454.CMB.1.raw
  modified_base (557)..(561): a, c, t, g, unknown or other
  misc_feature (557)..(561): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccaagggaaccctggtccaccgtctcctcacgccctaccaccgaacgggcccctagtccggttccttcccccgtggccgccctcgcctccgacggacgccacccgtccgagacgcaccgacgcccggcccgtcgggctcgccgtaggtaccgaacgggtaccttaccttccgacgtatcgtgtactggacggccggctgggacgagggcgcgagtagcnnnnn

SEQ ID NO: 74432 - DNA, 620 bp, Homo sapiens
  misc_feature: GYAE6OF01CJBKU.35.19.B08.1.454.CMB.1.raw
  modified_base (613)..(620): a, c, t, g, unknown or other
  misc_feature (613)..(620): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgcccacactctctgcacagaaaatttcagggccgggtcaccatgaccagggcacgtccaagcaacacaaacctataatggaggtgaaatggaactgagatctgacgacacggccgtatattactgtgtgcgagatattgactaacgtggggacctacggggaaaccctggtcaacccggtctcctacagccctccaaccaaggggccccaatccggtcctttcccccctgggcccacccctccctacccaaacgacgaccaacctaccgtggggaaccaccaacggcccggccccttggggcctcggacccgttcgggtaccgaaacgggtaacccgttaacctttcccgaaacgtacgttaccctaggtaacccttggaacggccggggtcttcggggaccaaagggccgccaagtagnnnnnnnn

SEQ ID NO: 74433 - DNA, 508 bp, Homo sapiens
  misc_feature: GYAE6OF01DF7PN.35.19.B08.1.454.CMB.1.raw
  modified_base (503)..(508): a, c, t, g, unknown or other
  misc_feature (503)..(508): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaaccctggtcaccgtctcctcagcctccaccaagggcccatccggtcttccccctggccgccctgctccaggacgcacctccgagacgcacagcggccctgggctgcctggtcaaggctacttccacgatctgtactgagcgggctggcaaggcgcatagnnnnnn

SEQ ID NO: 74434 - DNA, 539 bp, Homo sapiens
  misc_feature: GYAE6OF01DSZDX.35.19.B08.1.454.CMB.1.raw
  modified_base (320)..(320): a, c, t, g, unknown or other
  misc_feature (320)..(320): n is a, c, g, or t
  modified_base (534)..(539): a, c, t, g, unknown or other
  misc_feature (534)..(539): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtattattactgtgtgcganatattgactacgtggggccaggggaaccctggtcaccgtctcctcagccctccaccgaaacgggcccatccggtccttccccctggcccgccctcgcctccgaggacgccacctccgagacgcacgagccggccctgggcctcgccgtcggtcgaacggtaccttaccttccacgtactcctgtactggagcgggctgggcaaggcgcagtagnnnnnn

SEQ ID NO: 74435 - DNA, 593 bp, Homo sapiens
  misc_feature: GYAE6OF01BYR39.35.19.B08.1.454.CMB.1.raw
  modified_base (588)..(593): a, c, t, g, unknown or other
  misc_feature (588)..(593): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggagtgaatggactgagatctagacgacacggctatatactgtgtgcgagatattgactacgtggggaccaagggaaccctgggtaccacccggtctacctcacgccctaccaccgaaacgggccccagtccggtcccttccccctggcccgccctcgcctccgaggacgtccaccctcggagacgccacgacggccggcccgtgggccttcggcccgttagggtacccgaaagggtacccttaccgttcccgaacgtacttccgtaggtaccgttggaacggtccgggaccgttgggaccgaacgggccgaccagtacggnnnnnn

SEQ ID NO: 74436 - DNA, 579 bp, Homo sapiens
  misc_feature: GYAE6OF01BHW0D.35.19.B08.1.454.CMB.1.raw
  modified_base (572)..(572): a, c, t, g, unknown or other
  misc_feature (572)..(572): n is a, c, g, or t
  modified_base (574)..(579): a, c, t, g, unknown or other
  misc_feature (574)..(579): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccaggggaaccctggtcaccgtctcctcacgcctccaccaacgggcccatccggtcttccccctggccaccctcctaccaacgacgccaccgtccgtgggggccaacgacggccggccccgtggggcctcggcccgtgggttccaaagggtacctaccgttacccacgtacttccgtcggtaacctggacggccggggccgttagggacccgtaagggccgaccgaacgttacggncnnnnnn

SEQ ID NO: 74437 - DNA, 583 bp, Homo sapiens
  misc_feature: GYAE6OF01AIEST.35.19.B08.1.454.CMB.1.raw
  modified_base (576)..(576): a, c, t, g, unknown or other
  misc_feature (576)..(576): n is a, c, g, or t
  modified_base (579)..(581): a, c, t, g, unknown or other
  misc_feature (579)..(581): n is a, c, g, or t
  modified_base (583)..(583): a, c, t, g, unknown or other
  misc_feature (583)..(583): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggagtgaatggactgagatctgacgacgacggccgtatattactgtgtgcgagatattgactacgtgggccaggggaaccctggtccaccgtctcctcacgcctccaccgaacgggccccagtccggtccttcccccgtggccgtccctcgcctcccgacggacgccacccgtccgagacgccacgacggccggcccgtgggcctcggcccgtggtaccgaacgggtaccttaccgttcccgacgtactccgttggtaccttgggacggtccggggcgttcgggaccgaacggggccgacgaagtacggnagnnngn

SEQ ID NO: 74438 - DNA, 525 bp, Homo sapiens
  misc_feature: GYAE6OF01C3U9S.35.19.B08.1.454.CMB.1.raw
  modified_base (520)..(525): a, c, t, g, unknown or other
  misc_feature (520)..(525): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtttgcgagatattgactactggggccagggaacctggtcaccgtctcctcacgcctccaccaacggcccatccggtccttcccctcggccgcccctgcctccgaggacgccaccctccggagacgcacacgccggccctgggctcgcctggcaaggacctacttccacgatctcgtactggacgcggctggacaagggcgacatagcnnnnnn

SEQ ID NO: 74439 - DNA, 499 bp, Homo sapiens
  misc_feature: GYAE6OF01DYMO9.35.19.B08.1.454.CMB.1.raw
  modified_base (332)..(332): a, c, t, g, unknown or other
  misc_feature (332)..(332): n is a, c, g, or t
  modified_base (489)..(489): a, c, t, g, unknown or other
  misc_feature (489)..(489): n is a, c, g, or t
  modified_base (494)..(499): a, c, t, g, unknown or other
  misc_feature (494)..(499): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacnggggccagggaaccctggtcacgtctcctcagcctcaccaagggcccatcgtcttcccctgccgccctgctccaggacgccacctccgagagcacagcggccctgggctgcctggcaggactacttccacgatctgtactgagcgggctggcaggcnatagnnnnnn

SEQ ID NO: 74440 - DNA, 534 bp, Homo sapiens
  misc_feature: GYAE6OF01DO0RX.35.19.B08.1.454.CMB.1.raw
  modified_base (292)..(292): a, c, t, g, unknown or other
  misc_feature (292)..(292): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
  modified_base (389)..(389): a, c, t, g, unknown or other
  misc_feature (389)..(389): n is a, c, g, or t
  modified_base (392)..(392): a, c, t, g, unknown or other
  misc_feature (392)..(392): n is a, c, g, or t
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
  modified_base (522)..(522): a, c, t, g, unknown or other
  misc_feature (522)..(522): n is a, c, g, or t
  modified_base (529)..(534): a, c, t, g, unknown or other
  misc_feature (529)..(534): n is a, c, g, or t
tcagtacagatcgtcacgaccggtgctcgatttagtgagtcagtaaggggctgaaatgaagaagtctggggcctcagtgaaggtctcctgcaagacttctggatacaccttcaccgaatactttatacactggtgcgacaggcccctggacaagggtttgagtggctggggcggatcagccctaacagtggtgccacactctctgcacagtaaatttcgagggccggtcaccatgaccagggacacgtccagacaacacaaacctatagtggagtagaatggactgagatcngacgacacggccgtatattactgtgtgcgagatatgactacgngggccagggaacctggcaccgtcnctcacgcctccacgagccatcgtcctcccngcnccctgcctcagcnccacctcgagcgcacgacgccggccgnggcctcgccctaggtaccgaacggtaccttacccgttcgaaccgtactccgtagtaccgtgacggcggggtctagggaccgaaggccganacgtagnnnnnn

SEQ ID NO: 74441 - DNA, 520 bp, Homo sapiens
  misc_feature: GYAE6OF01B033T.35.19.B08.1.454.CMB.1.raw
  modified_base (515)..(520): a, c, t, g, unknown or other
  misc_feature (515)..(520): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccaggggaaccctggtcaccgtctcctcagcctccaccgaagggccccagtccggtcttcccccgtggccgccctgcctccgaggacgccaccctccgagacgcacgagccggccctgggctgcctggtcaaggacctacttccacgatctgtactgagcgggctgggcaggcgcatgnnnnnn

SEQ ID NO: 74442 - DNA, 544 bp, Homo sapiens
  misc_feature: GYAE6OF01A5YOB.35.19.B08.1.454.CMB.1.raw
  modified_base (540)..(544): a, c, t, g, unknown or other
  misc_feature (540)..(544): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaattttcagggccgggtcaccatgaccagggacacgtccagcaacacaacctatatggaggtgaatggactgagatctgacgacacggcctatattactgtgtgcgagatattgactactggggccagggaaccctggtcaccgtctcctcacgcctccaccaacgggccccagtccggtccttccccctggccgccctgcctccgaggacgccaccgtccgagacgccacgacgccggcccgtcgggcctggcccgtggtccgaaacgggtacctaccgttcccacgtactcgtcgtactgaggcgggcgtggcgaaggcgcagtgnnnnn

SEQ ID NO: 74443 - DNA, 541 bp, Homo sapiens
  misc_feature: GYAE6OF01D7RS2.35.19.B08.1.454.CMB.1.raw
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(541): a, c, t, g, unknown or other
  misc_feature (539)..(541): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggatcagccctaaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtgggccagggaaccctggtcaccgtctcctcacgcctccaccaacgggcccatccggtccttcccctggccgccctcgcctccgaggacgccacctccgagagcacgacgccggcccgtgggctcgccgtggtccgaacggtactaccttccaacgactctgtacgtgaggccgggctgggacgtaacggcgacaagtagnancnnn

SEQ ID NO: 74444 - DNA, 525 bp, Homo sapiens
  misc_feature: GYAE6OF01DRI0Z.35.19.B08.1.454.CMB.1.raw
  modified_base (398)..(398): a, c, t, g, unknown or other
  misc_feature (398)..(398): n is a, c, g, or t
  modified_base (520)..(525): a, c, t, g, unknown or other
  misc_feature (520)..(525): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaccctggtcaccgtctcctcacgcctccaccaagggcccatccggtccttccccgnggccgccctgctcccaggacgcacctccgagacgccacgacgccggccctgggcctggccctggtcaagggtctacttccacgtactcgtgtactgacgcgggctgggcaagggcgcagtgnnnnnn

SEQ ID NO: 74445 - DNA, 684 bp, Homo sapiens
  misc_feature: GYAE6OF01DVF68.35.19.B08.1.454.CMB.1.raw
  modified_base (268)..(268): a, c, t, g, unknown or other
  misc_feature (268)..(268): n is a, c, g, or t
  modified_base (673)..(673): a, c, t, g, unknown or other
  misc_feature (673)..(673): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
tcagtacagatcgtcacgaccggtgctcgatttagtgagtcagtaaggggcgtgaaatgaagaagcctgggcctcagtgaaggtctcctgcaagaccttctggatacacctttcaccgaatactttatacacgtgggtgcgacacggcccctggactaagggtttgagtggcgtggggcggatcacgaccctaacgaggtggtgccacacgtctctgcacgagtaaattcgagggccggtacaccgagtgaccgagggacacgtccancggaacactaacctatactcggagtgaatcggtactagagtatcgagacgacgacggcctaagtacttacgtggtgtgacgtagattagtgactacgtcgggacgtaacgggaacccgtggtaccgtaacgtctcctacgacgtcccttaccgaacccggaacgggtccccagttcccgggttccccttacccccgtcgggcccgtcccgttccgaccgtcccgaaggtaccgcccgaacccgtaccggaagaccgaccgacgacggacccggccgtcggggccctacggtcccgtacggtaccgaacgggttaccgtaaccgttcccgaacggtactcgttacgtacgtcggtaacgggtccgggtcgtacgggaccgtaaacgggccgtaaccgagttacggnacngngtgacg

SEQ ID NO: 74446 - DNA, 591 bp, Homo sapiens
  misc_feature: GYAE6OF01DKGF4.35.19.B08.1.454.CMB.1.raw
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (432)..(432): a, c, t, g, unknown or other
  misc_feature (432)..(432): n is a, c, g, or t
  modified_base (586)..(591): a, c, t, g, unknown or other
  misc_feature (586)..(591): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgaggccgggtcaccatgaccagggacacgtcagcaacacaacctatatggaggtnaatggactgagatcngacgacacggcctatattactgtgtgcgagatattgactacgtgggacacgggaaccctggtcacccgtctcctcacgcctccaaccaaacgggtcccaacgtccggttccttcccccgtggcccgccctcgcctccgaggacnccgaccctccgaacgacgcacgacggccggccccgtgggcctcgccgtacgggtacgaaacgggtaccttaaccgtttcccgaaccggtactaccgttgtaaccgttcggacggccgggtaccggtgggaccgaaacgggccgaccagtaacgnnnnnn

SEQ ID NO: 74447 - DNA, 606 bp, Homo sapiens
  misc_feature: GYAE6OF01BZRXU.35.19.B08.1.454.CMB.1.raw
  modified_base (287)..(287): a, c, t, g, unknown or other
  misc_feature (287)..(287): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(606): a, c, t, g, unknown or other
  misc_feature (605)..(606): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaattcgagggccggtcaccatgaccagggacacgtccagcaacacaacctatatggagtgaatggactgagatcngacgacgacggcctatattacgtgtgtgcgaagatattgactacgtggggccagggaccctggtcaccgtctacctcacgccctaccaccgtaacgggcccctagtccggtacccttcccccgtggcccgtcccgtcgtacccgtccgaacgggtaccgaccgaccctaccggaacgacgaccaacgaccggcccggacccgtcgggcctacggcccgttacggaccgaacggtaccttaccttaccgaacgtacttcgtacgtacgtcggacggtcgggtcgtcgggacgtaagggccgtacgagtacgngancngnn

SEQ ID NO: 74448 - DNA, 607 bp, Homo sapiens
  misc_feature: GYAE6OF01EMOID.35.19.B08.1.454.CMB.1.raw
  modified_base (601)..(602): a, c, t, g, unknown or other
  misc_feature (601)..(602): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactacgtgggccagggaaccctggtcaccgtctcctcacgcctcaccgaagggcccatccggtccttcccccgtggccgccctgcctccgaggacgccgacctccgagacgcaccgacgccggcccgtggggcctcggcccgttcgggtaccgaaacgggtacccttaaccgtttaccccaacggtacttaccgttcggtaaccgttcgggaacgggcccggggtaccgttacggggaccggtaaacgggcccggaccgtaacgttaacggctagnngngng

SEQ ID NO: 74449 - DNA, 608 bp, Homo sapiens
  misc_feature: GYAE6OF01BVDCH.35.19.B08.1.454.CMB.1.raw
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
  modified_base (605)..(606): a, c, t, g, unknown or other
  misc_feature (605)..(606): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccaggggaaccctggtccacccggtctcctcgacgccctccaccgaaacggggcccccaagttcccgggtccctttcccccccgtgggccccgtccccgttcggcccttacccgacgggacgcccgacccgtcccggagacgaccaccgacggcccggcccgtcgggcctcggcccgtcgggtaccgaacgggtaccttaccttccgaccgtactccgtagtacctggacggccgggcgtgggccgagggccgcgaagtacggnancnngc

SEQ ID NO: 74450 - DNA, 600 bp, Homo sapiens
  misc_feature: GYAE6OF01D6TIM.35.19.B08.1.454.CMB.1.raw
  modified_base (596)..(600): a, c, t, g, unknown or other
  misc_feature (596)..(600): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcgatcagccctaacagtggtgccacactctctgcacagaaatttcgagggccgggtcaccatgaccagggacacgtccagcaacacaacctatatggaggtgaatggactgagatctgacgacacggccgtatattactgtgtgcgagatattgactacgtgggccaggggaccctggtcaccgtctcctcacgcctccaccgaacgggccccagttccggtccttcccccgtggccgtccctgcctccgaggcgccacccgtccgagacgccacgacggcccgggccctcggggacctcgggcccgttacgggtaccgaaacggggtacccttaaccgtttacccgaacggtacttccgttacggttaacttcgggacgggccggggtcttacggggacgaaacgggccgacgaagtaggcgnnnnn

SEQ ID NO: 74451 - DNA, 559 bp, Homo sapiens
  misc_feature: GYAE6OF01ES3UN.35.19.B08.1.454.CMB.1.raw
  modified_base (425)..(425): a, c, t, g, unknown or other
  misc_feature (425)..(425): n is a, c, g, or t
  modified_base (553)..(556): a, c, t, g, unknown or other
  misc_feature (553)..(556): n is a, c, g, or t
  modified_base (558)..(559): a, c, t, g, unknown or other
  misc_feature (558)..(559): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccaggggaaccctggtcaccgtctcctcagcctccaccaagggccccatccggtccttccccgtggcccgtccctgcctccgaggacnccacctccgagacgcacgacgccggccctgggcctggcccgtgggtaccaagggtaccttaccgttacccacggtacttcgtgtacctggaccggtcggggtctgggacgaaagggccacgatacggnnnngnn

SEQ ID NO: 74452 - DNA, 622 bp, Homo sapiens
  misc_feature: GYAE6OF01CX25Q.35.19.B08.1.454.CMB.1.raw
  modified_base (615)..(615): a, c, t, g, unknown or other
  misc_feature (615)..(615): n is a, c, g, or t
  modified_base (618)..(619): a, c, t, g, unknown or other
  misc_feature (618)..(619): n is a, c, g, or t
  modified_base (621)..(622): a, c, t, g, unknown or other
  misc_feature (621)..(622): n is a, c, g, or t
tcagtacagatcgtcacgaccggtgctcgatttagtgagtcagtaaggggcgtgaaatgaagaagcctggggcctcagtgaaggtctcctgcaagacttctggatacaccttcaccgtaattactttatacactgggtgcgacacggcccctggacaagggtttgagtggcgtggggcggatcagccctaacagtggtcgccacactctctgcacagaaatttcgaggccggtcaccatgaccgagggacacgtccagacaacacaactatatggagtgaatggactgagatcagacgacacggcctatagttactggtgtgacgagtattagtgtactacggtcggggacctaacggggaacccttgggaccctaccgtcctacccgtacgacgccctaccgaccgaaacgggtcccctaagtcccggtacccttccccgtggccctccctcgcctaccgaggacgtccacccgtacgacgacgacacgacggccgtccgtagggcctcggtcgtacggaccgtaacggtaccttaccgttaccgtaacgtacttccgttacgtaaccgtcggaacggcgggtacgtcggaacgtaacgggcgaactagtacgnagnngnn

SEQ ID NO: 74453 - DNA, 596 bp, Homo sapiens
  misc_feature: GYAE6OF01CEXQ1.35.19.B08.1.454.CMB.1.raw
  modified_base (592)..(596): a, c, t, g, unknown or other
  misc_feature (592)..(596): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggcgtggggcggatcagccctaacagtggtgccacactctctgcacagaaatttcgagggccggtcaccatgaccagggacacgtccagcaacacaacctatatggaggtgaaatggactgagatctgacgacacggccgtatattactgtgtgcgagatatgactacgtgggccaggggaaccctggtccacccgtctcctcacgcctccgaaccgaacgggccccaagttcccggtcccttcccccgtcggcccgtcccgtcgcctccgacggacgccaccctccgacgacgccaccgacgccggcccgtgggtccgtcggccgtacggtacgaaacgggtaccttaccttacccgtaacggtactccgttagtaccgtggaacggccgggcgttcgggacgtaacgggccgtacgaacgtaggannnnn

SEQ ID NO: 74454 - DNA, 536 bp, Homo sapiens
  misc_feature: GYAE6OF01B2X68.35.19.B08.1.454.CMB.1.raw
  modified_base (531)..(536): a, c, t, g, unknown or other
  misc_feature (531)..(536): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaccctggtcaccgtctcctcacgccctccaccaaagggccccagtccggtccttccccccgtggccgccctgcctccgacggacgccaccctccgagacgccacacggccggcccgtgggcctgccgtggccgaaggtacctacttccacgatcgtgtactgaggcgggctggcgagggcgcagtagnnnnnn

SEQ ID NO: 74455 - DNA, 570 bp, Homo sapiens
  misc_feature: GYAE6OF01DCJMM.35.19.B08.1.454.CMB.1.raw
  modified_base (399)..(399): a, c, t, g, unknown or other
  misc_feature (399)..(399): n is a, c, g, or t
  modified_base (420)..(420): a, c, t, g, unknown or other
  misc_feature (420)..(420): n is a, c, g, or t
  modified_base (565)..(570): a, c, t, g, unknown or other
  misc_feature (565)..(570): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccaggacacgtccagcaacacaacctatatggaggtgaatggactgagatctgacgacacggccgtatattactgtgtgcgagatatgactacgtggggccaggaaccctggtcaccgtctcctcacgcctccacgacgggcccagtccggtccttcccccgnggccgcccctgctccgaggcncacctcccggagacgccaccgaggccggcccgtggggcctcggcccgttgggtaccgaacgggtaccttaccgttcccaacgtacttcctggttaactcgggacggtccgggggccttggggaccaaacgggccgactagtacgnnnnnn

SEQ ID NO: 74456 - DNA, 667 bp, Homo sapiens
  misc_feature: GYAE6OF01E2LWY.35.19.B08.1.454.CMB.1.raw
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (548)..(548): a, c, t, g, unknown or other
  misc_feature (548)..(548): n is a, c, g, or t
  modified_base (648)..(648): a, c, t, g, unknown or other
  misc_feature (648)..(648): n is a, c, g, or t
  modified_base (658)..(658): a, c, t, g, unknown or other
  misc_feature (658)..(658): n is a, c, g, or t
  modified_base (661)..(667): a, c, t, g, unknown or other
  misc_feature (661)..(667): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggcgtggggcggatcacgccctaacagtggtcnccacactctctgacacgaagtaaacttcgacgggccggtacaccatcgacgagggacaccgcacgacaaaccgactaacctanagtaggagtagaagtgactagacgtactcgacggacgtaccgacgtacgtattagtacgtgtcgtacgacgtaacgtagtactacgtaccggtacggccgggtaaccgtaccggtaccgtcgtaccgtaccctccgtacccgaccgaccgtaccccgtaccggtaacccggtacccgtccccgtaccggttcccccgttcccgtccccgccggtccccaccgtcccgtaccgaccggaacgacccgtcctaccggaccgtaggacccnccgaccggtccggtcccgcgggtccgtacgtcgtaccgttacgaccgtaaccgttccttaccgaccgtagtcctggtacgttcggacggacggcggtcgngacggagcanagnnnnnnn

SEQ ID NO: 74457 - DNA, 648 bp, Homo sapiens
  misc_feature: GYAE6OF01C5MR9.35.19.B08.1.454.CMB.1.raw
  modified_base (190)..(190): a, c, t, g, unknown or other
  misc_feature (190)..(190): n is a, c, g, or t
  modified_base (197)..(197): a, c, t, g, unknown or other
  misc_feature (197)..(197): n is a, c, g, or t
  modified_base (634)..(634): a, c, t, g, unknown or other
  misc_feature (634)..(634): n is a, c, g, or t
  modified_base (643)..(644): a, c, t, g, unknown or other
  misc_feature (643)..(644): n is a, c, g, or t
  modified_base (646)..(648): a, c, t, g, unknown or other
  misc_feature (646)..(648): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctggactaagggtttgagtggcgtggggcggatcagccctaanagtggtnccacactctctgcaacagtaaatttcgagggccggtcaccatcggaccgagggacacgtccagcaaacacaaacctatagtaggaggtagaagtgggactagagattcgacggacgacacggtccttaattacttactggtagtgacgagtattattggaacttacggtcggggaccacggggtaaccctggacctacccgtctccgtacgacgtccctaccgaaccgtaaccgggccctacgttccgggtacccctttccccgacggccccgtcccgtcgcccgtacgacggaccgacccgtaaccgtccgaagacgccaacgacggcccggtccgtcgggctcgtccgtacggtacgaaacgggtaccctaaccttccaacgtcttcgttacggtacgtcgggaacgggtcggacgtaggacggaacggtccganaacgtgacnncnnn

SEQ ID NO: 74458 - DNA, 648 bp, Homo sapiens
  misc_feature: GYAE6OF01EB4A3.35.19.B08.1.454.CMB.1.raw
  modified_base (187)..(187): a, c, t, g, unknown or other
  misc_feature (187)..(187): n is a, c, g, or t
  modified_base (643)..(643): a, c, t, g, unknown or other
  misc_feature (643)..(643): n is a, c, g, or t
  modified_base (645)..(645): a, c, t, g, unknown or other
  misc_feature (645)..(645): n is a, c, g, or t
  modified_base (647)..(647): a, c, t, g, unknown or other
  misc_feature (647)..(647): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacaggcccctggacaagggtttgagtggctggggcgatcagccctaanagtggtgccacactctctgcacagtaaatttcgagggccggtcaaccatcgaccgagggacacgtccagccaacacaacctatagtggaggtagaagttggactgagatctagacgacgacggtccgttatacttacgtggtgtgacgagtattagttgacctaggtcggggacctaacggggtaaccctggtaccacccgttctccctacgacgtaccctaccgaaaccggtaaaccgggcccctaagttcccgggttcccttccccccgtcggcccgtccctcgcccgtacgacggacgccaacccgtccgaagacgaccaacgaccggacccgcccggtggcctcgccgtaggacaacggtaccttaccgttaccgacgtacttccgtagtacgtcggacggtaccgggtcgtagggacgaaccgggtaccgaccgtaaacgtggactagcgngngng

SEQ ID NO: 74459 - DNA, 555 bp, Homo sapiens
  misc_feature: GYAE6OF01CQBPQ.35.19.B08.1.454.CMB.1.raw
  modified_base (541)..(541): a, c, t, g, unknown or other
  misc_feature (541)..(541): n is a, c, g, or t
  modified_base (550)..(555): a, c, t, g, unknown or other
  misc_feature (550)..(555): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggcagggaccctggtcaccggtctcctcacgcctccaccaaagggccccatccggtcctttcccccgtcggcccgccctcggcctcccgaggacgccacccgtccgaagacgccaacgacgccggcccctggggccttgcccttgggtccaagggaccttaccttccacgatccgtgtacctgagccggggtctgggcaacgggcngagtacggnnnnnn

SEQ ID NO: 74460 - DNA, 524 bp, Homo sapiens
  misc_feature: GYAE6OF01BJ3C3.35.19.B08.1.454.CMB.1.raw
  modified_base (484)..(484): a, c, t, g, unknown or other
  misc_feature (484)..(484): n is a, c, g, or t
  modified_base (518)..(521): a, c, t, g, unknown or other
  misc_feature (518)..(521): n is a, c, g, or t
  modified_base (523)..(524): a, c, t, g, unknown or other
  misc_feature (523)..(524): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtcaccgtctcctcacgcctccaccaagggccccatccggtccttccccctggccgccctgcctcccaggacgcaccctccgacgacgcacacgccggccctgggctcgcctggtcaaggtcctacttccacgntctgtactgagcgggctggcaacggcgcagtagnnnngnn

SEQ ID NO: 74461 - DNA, 553 bp, Homo sapiens
  misc_feature: GYAE6OF01BOIGE.35.19.B08.1.454.CMB.1.raw
  modified_base (548)..(553): a, c, t, g, unknown or other
  misc_feature (548)..(553): n is a, c, g, or t
tcagtacagatcgtcacgaccggtgctcgatttagtgagtcagtaaggggctgaaatgaagaagcctggggactcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactacgtggggccagggaaccctggtccaccgtctcctcacgccctccaaccaacgggccccagttccggtccttcccccgtggcccgccctcgcctccgaggacgccaccctccgacgacgccacgacgccggccctgggcctcgccgtggtaccaacggtaccttacttccacgtactcctagtactcgaggccgggactggacgaacggcgcgagtacgnnnnnn

SEQ ID NO: 74462 - DNA, 527 bp, Homo sapiens
  misc_feature: GYAE6OF01BWEA1.35.19.B08.1.454.CMB.1.raw
  modified_base (405)..(405): a, c, t, g, unknown or other
  misc_feature (405)..(405): n is a, c, g, or t
  modified_base (516)..(516): a, c, t, g, unknown or other
  misc_feature (516)..(516): n is a, c, g, or t
  modified_base (522)..(527): a, c, t, g, unknown or other
  misc_feature (522)..(527): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccaggggaaccctggtaccaccgtctcctcagccctccaccaagggcccagtccggtccttcccccnggccgcccctgcctcccgaggacgccacctccgagcgcacagccggccctgggcctgcctggtccaaggtacctacttccacgtatctgtactgagcgggctggcaaggcncagtgnnnnnn

SEQ ID NO: 74463 - DNA, 623 bp, Homo sapiens
  misc_feature: GYAE6OF01BTG34.35.19.B08.1.454.CMB.1.raw
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtcagcaacacaacctatatggaggtgaatggactgagatctgacgacacggccgtatattactgtgtgcgagatattgactacgtggggccaaggggaaccctggtaccaccgtcctcctcacgcctccaccgaacgggccccaagtccggttcccttcccccgtcggccgtccctcgcctccgacggacgccaccgtccgagacgccacgacggccggtcccgtcgggcctcggcccgttggggtaccgaaacgggtacccttaaccgttacccgtaacggtacttccgttacgttaccgtcgggaacgggtccggggtccgttaggggaccgtaaacggggcccgtaccgtaacgttaacggacacggcngngc

SEQ ID NO: 74464 - DNA, 643 bp, Homo sapiens
  misc_feature: GYAE6OF01CONW7.35.19.B08.1.454.CMB.1.raw
  modified_base (635)..(635): a, c, t, g, unknown or other
  misc_feature (635)..(635): n is a, c, g, or t
  modified_base (638)..(639): a, c, t, g, unknown or other
  misc_feature (638)..(639): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgagggccgggtcaccatgaccagggacacgtccagcaacacaacctatatggaggtgaatggactgagatctgacgacacggccgtatattactgtgtgcgagatattgactacgtcggggccacgggaccctggtccaccgtcctcctcacgccctaccgaccgaacgggcccctacgtcccgggttcccttccccccgtagggccccgtccccgtcggtccctccccgaagggtaccgacccgtaaccccgtcccggagaaccggcccgaaccggacgggcccgggccccgtcggggtccctcgggtccccgttggggtacccgaacgggtaccttaccttcccgaacgtacttcgttcggtaccgtggacgggtcgggtccgtagggaccgtaacgggccgacgtaacgtaggnagnngngn

SEQ ID NO: 74465 - DNA, 609 bp, Homo sapiens
  misc_feature: GYAE6OF01A5LE2.35.19.B08.1.454.CMB.1.raw
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccaggggaaccctggtcaccgtctcctcacgcctccaccgaagggcccagtccggtccttcccccgtggccgtccctcgcctccgaggacgccacccgtccgagacgccacacggccggcccgtggggcctcggcccgttacgggtacccgaaacgggtaccttaccgttcccgaacggtacttccgttacggttaaccgttcgggaacgggtccggggtccgttaggggaccggaaacggggtccgaaccgtaagtacggctagcngtncg

SEQ ID NO: 74466 - DNA, 864 bp, Homo sapiens
  misc_feature: GYAE6OF01C0673.35.19.B08.1.454.CMB.1.raw
  modified_base (283)..(283): a, c, t, g, unknown or other
  misc_feature (283)..(283): n is a, c, g, or t
  modified_base (858)..(858): a, c, t, g, unknown or other
  misc_feature (858)..(858): n is a, c, g, or t
tcagtacagatcgtcacgaccggtgctcgatttagtgagtcagtaaggggcgtaggaaatgaagaagcctggggcctcagtgaaggtctcctgcaagacttctggatacaccttcacccgaatacctttatacactgggtgcgacaggcccctggaccaagggtttgagtggctggggcggatcagccctaacagtggtgccacactctctgcacagaatttcgagggccggtacaccatcgaccgagggacacgtccagacaacacaactatatggaggtanaatcgactgagactctagacgacgtacggtaccttaagtactttacgtggtagtcggaccggtagtaagtttagttacgtaaccgttaaccggtcgggggaccctaacgggggtaaccccgttgggtaccctaacccggttcctacccgtaccgaaccggtcccccttaaccccgaacccggtaaaccggggtcccccttaaacggtttcccccggggtttacccccgttttcccccccgggtacggggtaccccccgtcccccggtttacggaccccgttaaccccgggaaaggggtacccggaccccgttaaacccccggttcccgggtaaacggtaaccggaccccaaaccggtacccgggccccgggtacccccggtggggtaaccctttcgggtacccccgttaggggtaaaccccggtaaacggggttacccttttaacccggttaccccggaaacgggtaccgtttaaccggttaccgggttaaacccggcgggtaaaccggggtcccggggtacgttcgggggaacccgtaaacggggcccgtaaccgtaccgtaacggcagtccgntccgac

SEQ ID NO: 74467 - DNA, 547 bp, Homo sapiens
  misc_feature: GYAE6OF01D55Z7.35.19.B08.1.454.CMB.1.raw
  modified_base (274)..(274): a, c, t, g, unknown or other
  misc_feature (274)..(274): n is a, c, g, or t
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
  modified_base (408)..(408): a, c, t, g, unknown or other
  misc_feature (408)..(408): n is a, c, g, or t
  modified_base (535)..(535): a, c, t, g, unknown or other
  misc_feature (535)..(535): n is a, c, g, or t
  modified_base (542)..(542): a, c, t, g, unknown or other
  misc_feature (542)..(542): n is a, c, g, or t
  modified_base (544)..(547): a, c, t, g, unknown or other
  misc_feature (544)..(547): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaaacacaacctatatggaggtnaatggactgagatctgacgacacggcctatattactggtntgcgagatattgactacgnggggaccaggggaaccctggtacaccgtctcctcagcctcacccgagggccccagtccgtccttccccgtggccnccctgctccgacggacgccaacctccgagacgccacacggccggcccgtgggcctcgcccgtgggtaccaacgggtaccttaccgttcccacgtatctggtactgacggcgggctgggcgaaggcanacgtagnannnn

SEQ ID NO: 74468 - DNA, 572 bp, Homo sapiens
  misc_feature: GYAE6OF01AMJWA.35.19.B08.1.454.CMB.1.raw
  modified_base (564)..(564): a, c, t, g, unknown or other
  misc_feature (564)..(564): n is a, c, g, or t
  modified_base (567)..(568): a, c, t, g, unknown or other
  misc_feature (567)..(568): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactacgtggggccagggaaccctggtccaccggtctcctcacgcctcccaaccgaacgggccccagtccggtcccttcccccgtggccgccctgcctccgaggtacgccacccgtccggagacgccacgacgccggcccgtgggcctcgccgtcgggtacgaacggtaccttaccgttaccgacgtatcctggtacctaggacggcgggtcgtgggacgaacgggccgacaagtacggntgnngngn

SEQ ID NO: 74469 - DNA, 632 bp, Homo sapiens
  misc_feature: GYAE6OF01DMISL.35.19.B08.1.454.CMB.1.raw
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (350)..(350): a, c, t, g, unknown or other
  misc_feature (350)..(350): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
tcagtacagatcgtcacgaccggtgctcgatttagtgagtcagtaaggggcgtgaaatgaagaagcctggggcctcgagtgaaggtctcctggctaagacttctcggatacaccttctaccgaattactttatacactgggtgcgacaggcccctggacgaagggtttgagtggctgggggcggatcagccctaacagtggtgccacactctctggcacgagaaactttcagggccggtcaccatcgaccagggaccacgtccagacaacacaactatanaggagtanaatggactgagatcagacgacgacggccgtatacgtactgtgtcgcgatatagtgactacgngggccaagggaccctggtaccaccggtctccgtcgacgccctccgaccgacggggcccagttccggtacccttcccccgtggtcccgccctcgcctccgaggacgacacccgtccggacgacgccaacgacggccggtcccggtgggtccgttcggtccgtcggtacgaacgggtaccttaccgttacctaacggtacttaccgttcggttacgtacggtacgggccggggtacgttagggaccggtaaacgggcggactaacggtaacgcgagcgngngac

SEQ ID NO: 74470 - DNA, 569 bp, Homo sapiens
  misc_feature: GYAE6OF01AT3VD.35.19.B08.1.454.CMB.1.raw
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgagggccggtcaccatgaccagggacacgtccagcaacacaactatatggaggtgaatggactgagatcgtgacgacgacggccgtatattactgtgtgacgagatagttgactacgtcggggccgagggaaccctggtccaccgtctcctcacgcctccaccgaacggcccagtccgtccttccccgtggccgccctgcctccgaggacgccaccgtcgacgcgcacgacgccggcccgtcgggcctcggcccgtcggtaccgaacggtacctaccttcccaacgtactctggtactcggacggccgggtccggtaggacgtacgggccgtacgaacgtagcgantgngn

SEQ ID NO: 74471 - DNA, 717 bp, Homo sapiens
  misc_feature: GYAE6OF01CXBLK.35.19.B08.1.454.CMB.1.raw
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (286)..(286): a, c, t, g, unknown or other
  misc_feature (286)..(286): n is a, c, g, or t
  modified_base (710)..(710): a, c, t, g, unknown or other
  misc_feature (710)..(710): n is a, c, g, or t
  modified_base (714)..(714): a, c, t, g, unknown or other
  misc_feature (714)..(714): n is a, c, g, or t
  modified_base (716)..(717): a, c, t, g, unknown or other
  misc_feature (716)..(717): n is a, c, g, or t
tcagtacagatcgtcacgaccggtgctcgatttagtgagtcagtaaggggctgaaatgaagaagcctgggcctcagtgaaggtctctgcaagacttctggatacaccttcaccgaattactttatacacgtgggtgacgacacggccctggacaagggtttgagtggcgtggggcgatcgagccctaangtggtnccacactctctgacacaagtaactttcgaggggccggtacaccgatacgaccgaggacctacgtcagacaacacaactatagtaggagtanaagtgaactagagatcgtacgacgtacaccggtaccgtatacgttacgtggtaggtggacgtaagtactttagttacgaacgtaacgggtacggggaccgtaaacgggtaaccccgttaggtaccctaaccggttccttacccgtacgtaaccgcccgttaaccccgaaccggtaaccgggccccttaagggttcccccggtacccgtttcccccgtaccgggtaccctccccgttacggtaccccgtaccggaacggtaccgtacccgaacccggttccggaacgaccgacccaaccggccggtaccgggtcccgtacgggtcgtccgtacgtacggtaaccgaacggtaccttaaccgtacccgaacgtacttcggttacgtacgtcggacggtccgggagtcgacgtaaggcctagagagntgantnn

SEQ ID NO: 74472 - DNA, 492 bp, Homo sapiens
  misc_feature: GYAE6OF01A7RLD.35.19.B08.1.454.CMB.1.raw
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
  modified_base (486)..(486): a, c, t, g, unknown or other
  misc_feature (486)..(486): n is a, c, g, or t
  modified_base (489)..(492): a, c, t, g, unknown or other
  misc_feature (489)..(492): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcgatcagccctaacagtggtgccacactctctgcacagaaatttcagggccggtcaccatgaccagggacacgtccagcaacacaacctatatggagtgaatggactgagatctgacgacacggcgtatatacgtgtgtgcgagatatgactacgngggccaggacctggcacgtcnctcagcctcacgacggccatcgtcctcccgngcnccngcncngncaccgtcgcgggcacgcgcgccgnggctcgctcggcgacgactaccgtcacgtntctcgacgngcgcgggngtcggcgaaggccactagagcngannnn

SEQ ID NO: 74473 - DNA, 562 bp, Homo sapiens
  misc_feature: GYAE6OF01AOJ63.35.19.B08.1.454.CMB.1.raw
  modified_base (325)..(325): a, c, t, g, unknown or other
  misc_feature (325)..(325): n is a, c, g, or t
  modified_base (557)..(562): a, c, t, g, unknown or other
  misc_feature (557)..(562): n is a, c, g, or t
tcagtacagatcgtcacgaccggtgctcgatttagtgagtcagtaaggggctgaaatgaagaagcctggggcctcagtgaaggtctcctgcaagacttctggatacacctcaccgaatactttatacactgggtgcgacaggcccctggacaagggtttgagtggctggggcggatcagccctaacagtggtgccacactctctgcacagaaatttcgagggccggtcaccatgaccagggacacgtccagcaacacaacctatatggaggtgaagtggactgagatcgtgacgacgacggccgtatattactgtgtgcgagatntgactacgtgggcagggacctggccaccgtctcctcacgcctccacgacggccctagtccggtccttccccgtggccgtccctcgccgtccgacggacgccacccgtccgagacgaccacgacggcccggcccgtgggtcctcggccgtacggtaccgaacgggtaccttaccgttaccgaccgtatccttacgtacgtggacgggtcgggcgtggacgacggcgcagtcgnnnnnn

SEQ ID NO: 74474 - DNA, 551 bp, Homo sapiens
  misc_feature: GYAE6OF01B03XB.35.19.B08.1.454.CMB.1.raw
  modified_base (273)..(273): a, c, t, g, unknown or other
  misc_feature (273)..(273): n is a, c, g, or t
  modified_base (545)..(548): a, c, t, g, unknown or other
  misc_feature (545)..(548): n is a, c, g, or t
  modified_base (550)..(551): a, c, t, g, unknown or other
  misc_feature (550)..(551): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtnaatggactgagatctgacgacacggccgtatattactgtgtgcgagattattgactacgtggggccagggtaaccctggtccaccggtctcctcacgccctccaccaacgggccccagtccggttccttcccccgtggccctccctgcctccaggacgccaccgtccgagacgccacgacggccggccctgggcctggcccgtggacgaacgtacctacctccgacgtctcgtcgtacgtggacggcggtcgtggacggcggcgagagtagnnnngnn

SEQ ID NO: 74475 - DNA, 693 bp, Homo sapiens
  misc_feature: GYAE6OF01E49DS.35.19.B08.1.454.CMB.1.raw
  modified_base (305)..(305): a, c, t, g, unknown or other
  misc_feature (305)..(305): n is a, c, g, or t
  modified_base (642)..(642): a, c, t, g, unknown or other
  misc_feature (642)..(642): n is a, c, g, or t
  modified_base (683)..(683): a, c, t, g, unknown or other
  misc_feature (683)..(683): n is a, c, g, or t
  modified_base (687)..(688): a, c, t, g, unknown or other
  misc_feature (687)..(688): n is a, c, g, or t
  modified_base (690)..(691): a, c, t, g, unknown or other
  misc_feature (690)..(691): n is a, c, g, or t
  modified_base (693)..(693): a, c, t, g, unknown or other
  misc_feature (693)..(693): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggcgtgggggcggatcacgccctaacagtggtcgccacactctctgcacagtaaatttcgagggccggtcaccatcgaccgagggacaccgtccagacaacacaacctatagtggaggtgaagtggactaggagattccgnggaaccgaccgaccggtccgtaattacgttacgtggttacggtggacgtaagtattagttacgtaaccgttaacgggtacgggggacccgtaaccggggtaaccccgttgggtccctaacccgttcctcccgttaccgacgtcccctacccgaacccgaacgggcccctacgttcccggtccccttccccgcggccccgtcccgtcgccctaccgacggaccgccctaacccgtccgaagacgtacccacggaccggcccggacccgtgggcctcgtcccggtacggtaaccgaacgggtacccttaccgttccgaacgttacttccgtacggtacngggaaccggcgggtagtcgggaccgagggcccgaataacgngacnngnngn

SEQ ID NO: 74476 - DNA, 603 bp, Homo sapiens
  misc_feature: GYAE6OF01BQAW2.35.19.B08.1.454.CMB.1.raw
  modified_base (295)..(295): a, c, t, g, unknown or other
  misc_feature (295)..(295): n is a, c, g, or t
  modified_base (596)..(597): a, c, t, g, unknown or other
  misc_feature (596)..(597): n is a, c, g, or t
  modified_base (601)..(601): a, c, t, g, unknown or other
  misc_feature (601)..(601): n is a, c, g, or t
  modified_base (603)..(603): a, c, t, g, unknown or other
  misc_feature (603)..(603): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggcgtgggggcggatcagccctaacagtggtgccacactctctgcacagaaatttcgagggccggtcaccatcgaccgagggaccacgtccagcaacacaacctatagtggagtgaatggactgagatcgngacgacacggcgtatattactgtgtgcgagtatagttgacttacggtcgggaccgacgggtaaccctggtaccacccgtctcctcgacgtccctaccaaccgaacgggcccctacgttcccggttccccttcccccgtggcccgtcccgtcgcctccggaggacgccacccgtccggagacgccacgacggccggcccgtcggcctcgtccgtacgaccgaacgtacccttaccgttaccgacgtactcgtacgtaccgtggacgggccggtcggtcgggacggacggccgagaacgtagnncggngn

SEQ ID NO: 74477 - DNA, 721 bp, Homo sapiens
  misc_feature: GYAE6OF01C7NGO.35.19.B08.1.454.CMB.1.raw
  modified_base (713)..(713): a, c, t, g, unknown or other
  misc_feature (713)..(713): n is a, c, g, or t
  modified_base (716)..(718): a, c, t, g, unknown or other
  misc_feature (716)..(718): n is a, c, g, or t
  modified_base (720)..(721): a, c, t, g, unknown or other
  misc_feature (720)..(721): n is a, c, g, or t
tcagtacagatcgtcacgaccggtgctcgatttagtgagtcagtaagggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcaacagtaaatttcgagggccgggtcaccatgacgagggacacgtccagcaacacaactatatggaggtgaatggactagagatcgtaggaaccgacaacgggccgtaattattactgtgtgacgaagatattgacgtacgtcgggacgacgggtaacccgtggtactacccgtcgtcacgtaccttccaaccgaacgggcccaacgttcccgggtaccctttcccccggtcgggcccgtccccgttcggcccgtaccggaacggggaaccgcctaacccggttcggggtaccggggggacctaccggaaccgggcccgggccccggttcggggtcccgttcgggtaccccggttacggggtttaaaccgaaacggggttacccttaaacccggtttaccccggaaccgttaacgtttaccgttacggttacccgggtaggtaccgggtccgggggtaccgtccggggaaaccggtaacggggcccgtacgtaacggtaaggctanagnnngnn

SEQ ID NO: 74478 - DNA, 601 bp, Homo sapiens
  misc_feature: GYAE6OF01DNKBE.35.19.B08.1.454.CMB.1.raw
  modified_base (449)..(449): a, c, t, g, unknown or other
  misc_feature (449)..(449): n is a, c, g, or t
  modified_base (596)..(599): a, c, t, g, unknown or other
  misc_feature (596)..(599): n is a, c, g, or t
  modified_base (601)..(601): a, c, t, g, unknown or other
  misc_feature (601)..(601): n is a, c, g, or t
tcagtacagatcgtcacgaccggtgctcgatttagtgagtcagtaaggggctgaaatgaagaagtctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgagggccgggtcaccatcgaccgagggacacgtccagcaacacaacctatatggaggtgaagtggactgagatctgacgacacggccgtatattactgtgtgcgagtattattgactacgtcggggaccaacggggaaccctggtccacccgtctcacgtccttcccaaccgacgggccctagtccggttcccttcccccgtggcccgtcccgtcgcctaccgacgggacnccaccgtcggtcggggccacgacggcccggtcccgtcgggcctcggccgttagggtaccgaacggtaccttaccgttaccgacgtactcgtacgtacgtggacggtccgggtacgtcgggaccgaagggccgacgtacgtgactgcnnnngn

SEQ ID NO: 74479 - DNA, 588 bp, Homo sapiens
  misc_feature: GYAE6OF01EDAOJ.35.19.B08.1.454.CMB.1.raw
  modified_base (580)..(580): a, c, t, g, unknown or other
  misc_feature (580)..(580): n is a, c, g, or t
  modified_base (583)..(584): a, c, t, g, unknown or other
  misc_feature (583)..(584): n is a, c, g, or t
  modified_base (586)..(586): a, c, t, g, unknown or other
  misc_feature (586)..(586): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagtatattgactacgtggggccagggaaccctgggtcacccgtctcctcacgccctccaccgacgggccccagtccggttccttcccccgtggcccgccccgtgccctcccgaggacgccacccgtccgagacgccacgacggccggccccgtgggcctcggtccctagggtaccaacgggtaccttaccgttcccaaggtacttccgtagtaccgtaggacggcggggtccgtggggacaacggggccgacgagttacggnagnngncg

SEQ ID NO: 74480 - DNA, 658 bp, Homo sapiens
  misc_feature: GYAE6OF01A45VR.35.19.B08.1.454.CMB.1.raw
  modified_base (126)..(126): a, c, t, g, unknown or other
  misc_feature (126)..(126): n is a, c, g, or t
  modified_base (188)..(188): a, c, t, g, unknown or other
  misc_feature (188)..(188): n is a, c, g, or t
  modified_base (229)..(229): a, c, t, g, unknown or other
  misc_feature (229)..(229): n is a, c, g, or t
  modified_base (289)..(289): a, c, t, g, unknown or other
  misc_feature (289)..(289): n is a, c, g, or t
  modified_base (329)..(329): a, c, t, g, unknown or other
  misc_feature (329)..(329): n is a, c, g, or t
  modified_base (650)..(650): a, c, t, g, unknown or other
  misc_feature (650)..(650): n is a, c, g, or t
  modified_base (654)..(654): a, c, t, g, unknown or other
  misc_feature (654)..(654): n is a, c, g, or t
  modified_base (656)..(656): a, c, t, g, unknown or other
  misc_feature (656)..(656): n is a, c, g, or t
  modified_base (658)..(658): a, c, t, g, unknown or other
  misc_feature (658)..(658): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttanacactgggtgcgacaggcccctggacaagggtttgagtggctggggcggatcagccctaacngtggtgccacactctctgcacagaaatttcgagggccggtnaccatcgaccgagggaccacgtccagacaacacaacctatatggagtgaatggactgagntcgtgacgacgacggcgtattacttactgtgtgcgaagtnttattgacgttacgcggggccaacggggtaccctgggtccaccgttctcctcaacgtccctaccgaaccgaacgggtcccagttcccggttacccttcccccgtcggtcccgtcccgtcgcccgtaccggacggtaccgaccctaacccgtacccgaacgaccggaccaacgaccggcccggcccggtcgggccgtcgtcccggtacgggtacccgaacgggttacccttaccgttacccgaacgttacgtcccgttggtaccgttagggaccgggtccgggtaccggtccggaacggtaccggacccgtagaacgtcganagcngngn

SEQ ID NO: 74481 - DNA, 598 bp, Homo sapiens
  misc_feature: GYAE6OF01EEGAB.35.19.B08.1.454.CMB.1.raw
  modified_base (588)..(588): a, c, t, g, unknown or other
  misc_feature (588)..(588): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactacgtggggccagggaaccctggtcaccgtctcctcacgcctccaccaacgggcccagtccggtccttcccccgtggccgccctgcctccgacggacgccaccgtccgagacgccacacggccggcccgtggggcctcggcccgtgggtaccgaaacgggtaccttaaccgttcccgaaccggtacttccgtacgttaccgttgggaacgggtccggggccgttaggggaccggaaacggggcccgacgtaacggttaggnagtcngngng

SEQ ID NO: 74482 - DNA, 639 bp, Homo sapiens
  misc_feature: GYAE6OF01CRQZ2.35.19.B08.1.454.CMB.1.raw
  modified_base (190)..(190): a, c, t, g, unknown or other
  misc_feature (190)..(190): n is a, c, g, or t
  modified_base (604)..(604): a, c, t, g, unknown or other
  misc_feature (604)..(604): n is a, c, g, or t
  modified_base (635)..(639): a, c, t, g, unknown or other
  misc_feature (635)..(639): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctggactaagggtttgagtggcgtggggcggatcagccctaanagtggtgccacactctctgcacagtaaatttcgacgggccggtcaccatgaccagggacacgtccagaccaaacacaaacctatagtgggaggtgaaagtggactggagatctggacgacgaccggtctattacttactgtgtgacgagtattatgactacggtcggggaccacggggtaaccctggtccacccggtctcctacgacgcctacccgaacgaaccgggtccctaacgttcccggttcccttccccccggtcgggtccccgtcccgtccgtcccgtaccggaacgggacgcccgacccggtaccgaacggaccgacccgaccggtaccggcccgggcccggtcgggccgtcggtccgtcggtaccgaacgggtacctaccgtaccgacgtactcgtgtacgtcggnggaccggtgcggacgacggcgactagacgcnnnnn

SEQ ID NO: 74483 - DNA, 591 bp, Homo sapiens
  misc_feature: GYAE6OF01EYQPU.35.19.B08.1.454.CMB.1.raw
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (589)..(591): a, c, t, g, unknown or other
  misc_feature (589)..(591): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactacgtggggaccagggaaccctggtcaccgttcctcctcacgccctaccaacccgaaacgggccccaacgttcccgggttaccctttcccccccgtggcccgtcccctcgccctccgaaggacgccacccgtccgagacgcaccgacggcccggcccgtcgggccgtcgcccgtacggtaccgaaggtaccttaccttccgacgtacttccgtagtacctggacggtccggggctagggacgaacgggcgacagtagncngnnn

SEQ ID NO: 74484 - DNA, 631 bp, Homo sapiens
  misc_feature: GYAE6OF01CP7MW.35.19.B08.1.454.CMB.1.raw
  modified_base (272)..(272): a, c, t, g, unknown or other
  misc_feature (272)..(272): n is a, c, g, or t
  modified_base (629)..(629): a, c, t, g, unknown or other
  misc_feature (629)..(629): n is a, c, g, or t
  modified_base (631)..(631): a, c, t, g, unknown or other
  misc_feature (631)..(631): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaactatatggaggtnaatggactgagatctgacgacacggccgtatattactgtgtgcgagtatattgactacgtcggggccacggggaaccctggtccaccggtctacctcacgccctcccaccgaacgggccccagttccggtccctttcccccgtggcccgtcccctcgcccttcccgaaggtacgcctaacccgtccgacgacgccaaccgacggccgggaccccgtgggccgtcggtcccgtacgggttaccgaaacgggtccttaaccttcccgaaccggtcttaccgttaggtaccgttacgggacggtccgggggtccgtaggggacccgtaaacgggccgtaccgaacgttacggcagctcgngn

SEQ ID NO: 74485 - DNA, 723 bp, Homo sapiens
  misc_feature: GYAE6OF01A20VA.35.19.B08.1.454.CMB.1.raw
  modified_base (268)..(268): a, c, t, g, unknown or other
  misc_feature (268)..(268): n is a, c, g, or t
  modified_base (289)..(289): a, c, t, g, unknown or other
  misc_feature (289)..(289): n is a, c, g, or t
  modified_base (323)..(323): a, c, t, g, unknown or other
  misc_feature (323)..(323): n is a, c, g, or t
  modified_base (715)..(715): a, c, t, g, unknown or other
  misc_feature (715)..(715): n is a, c, g, or t
  modified_base (719)..(719): a, c, t, g, unknown or other
  misc_feature (719)..(719): n is a, c, g, or t
  modified_base (721)..(721): a, c, t, g, unknown or other
  misc_feature (721)..(721): n is a, c, g, or t
  modified_base (723)..(723): a, c, t, g, unknown or other
  misc_feature (723)..(723): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcgatcagccctaacagtggtgccacactctctgcacagaaatttcgacgggccggtcaccatcgaccgagggacacgtccagcaacacaactatanggagtgaatggactgagatcngaccgacgacggccgtattattctgtgtgcgtanattatcgacttacggcgggaccacgggtaccctggtaccaccgttctcctacgacgtccctaccgaaccggaacgggcccctaacgttccgggttacccctttcccccggtaggtcccgtccccgtcggtacccgttacccggaacgggtaccgtacccgaaccccgtacccgggaaggaaccggacccgaaaccgtacccgggtaccccgggtccccggttacgggggacccgttacgggtcccggttaacgggttacccggaaacggggttaacccctttaccgtttaccccgaacgttaccgttacgttaccggttaacggtcgggtaccgggtaccggggtacgttaccggggaccggtaaacgggtccacggtaacgtacgggtacngacngngn

SEQ ID NO: 74486 - DNA, 691 bp, Homo sapiens
  misc_feature: GYAE6OF01C8PBI.35.19.B08.1.454.CMB.1.raw
  modified_base (189)..(189): a, c, t, g, unknown or other
  misc_feature (189)..(189): n is a, c, g, or t
  modified_base (688)..(688): a, c, t, g, unknown or other
  misc_feature (688)..(688): n is a, c, g, or t
  modified_base (690)..(691): a, c, t, g, unknown or other
  misc_feature (690)..(691): n is a, c, g, or t
tcagtacagatcgtcacgaccggtgctcgatttagtgagtcagtaagggctgaaatgaagaagcctggggcctcagtgaaggtctcctgcaagacttctggatacaccttcaccgaattacttttatacacgtgggtgcgacacggcccctggacaagggtttgagtggctggggcgatcagccctaanggtggtgccacactctctgcaacagtaaactttcgagggccggtacaccgagtcgaccgagggtacacgtccaagaccaaactaccaaactatagtggagtagaagtggactgagatcgtagaccgacacgggtaccttaattacttacgtgtacgtggacgaagacttagtcgaaccttacggcgggaccaacggggtacccctggtacctaccgtcctaccgtaccacggttccctacccgaaccggaaccgggccccctaaggttccccggttccctttccccccggtccggtacccgtcccgtcgtcccgtacccggacggaccgaccgtacccgtacgacgacgaccgaccgtaccggccggtacccggtcgggtaccgtcggtacccgttacgggtaccggaacggtaccgttacccttaccgaccgtacgttcgtacgtacgtcggacggccgggtacgtagggaccgaacggccgtactacgtacgatgcngnn

SEQ ID NO: 74487 - DNA, 518 bp, Homo sapiens
  misc_feature: GYAE6OF01B861V.35.19.B08.1.454.CMB.1.raw
  modified_base (229)..(229): a, c, t, g, unknown or other
  misc_feature (229)..(229): n is a, c, g, or t
  modified_base (491)..(491): a, c, t, g, unknown or other
  misc_feature (491)..(491): n is a, c, g, or t
  modified_base (513)..(518): a, c, t, g, unknown or other
  misc_feature (513)..(518): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtnaccatgaccagggacacgtccagcaacacaacctatatggaggtgaatggactgagatctgacgacacggccgtatattactgtgtgcgagatattgactactggggccaggggaaccctggtcaccgtctcctcagcctccaccaagggcccatcggtcttcccccgtggccgccctgctccgaggacgcaccctccgagacgcacgagccggccctgggcctggcctggtacaagggtacctacttcgacgatctgtacngagcggctggcaggcgcatagnnnnnn

SEQ ID NO: 74488 - DNA, 639 bp, Homo sapiens
  misc_feature: GYAE6OF01CIPTI.35.19.B08.1.454.CMB.1.raw
  modified_base (132)..(132): a, c, t, g, unknown or other
  misc_feature (132)..(132): n is a, c, g, or t
  modified_base (198)..(198): a, c, t, g, unknown or other
  misc_feature (198)..(198): n is a, c, g, or t
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (634)..(636): a, c, t, g, unknown or other
  misc_feature (634)..(636): n is a, c, g, or t
tcagtacagatcgtcacgaccggtgctcgatttagtgagtcagtaaggggctgaaatgaagaagccgtggggcctcagtgaaggtctcctgcaagacttctggataccaccttcaaccgtaattacttttanacacgtgggtgcgacgacggcccctggacgtaagggtttgagtggcgtggggcgatcagccctaangtggcgccacactctcngcagagtaaattcgagggccggtacacagngacgaggacacgtcagcaaacacaactagtagtaggagtgaaagtggacngagattcgagacgacgacgcgttaattatactggtgtagacgtatattaagttcgaacgttacggcgggactaaaccgggtacctggaccgtacccgtctaccgtccgaacgccctaaccggaccgtaaacgggtcccctaacgtcccggtttccccttacccccgtggtccctacccgtgtcccgtacgacggacgacccgaccgtacggacgacggaccacgtcggccgtaccggtggtaccgtcgtacccgtcgtaacgaaccgtccttaacctaccgtaacgtactacgtacgtacgtggaacggcgggtacgaggacggacgcgctaaagcgannntgc

SEQ ID NO: 74489 - DNA, 649 bp, Homo sapiens
  misc_feature: GYAE6OF01EP99J.35.19.B08.1.454.CMB.1.raw
  modified_base (266)..(266): a, c, t, g, unknown or other
  misc_feature (266)..(266): n is a, c, g, or t
  modified_base (645)..(649): a, c, t, g, unknown or other
  misc_feature (645)..(649): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatanggaggtgaatggactgagatctgacgacacggccgttattaattactggtgtgcgtagtattattcgacttacggtcggggacccgaacggggtaaccccttgggtaccctaacccggttcctacccgtccaacggtcccctacccgaacccgaaacggggccccctaaggttcccggtttacccctttccccccggtacgggccccgtcccccgttacggcccttacccggacgggaccgccctaacccgtccggacgacgccacgacggcccggcccgtcgggcctcggccgttcgggtaccgaacgggtaccttacccgttccgaacgtactcgtaggtacctggacggcgggtctggacgaggcgacacgtagcnnnnn

SEQ ID NO: 74490 - DNA, 585 bp, Homo sapiens
  misc_feature: GYAE6OF01AXO72.35.19.B08.1.454.CMB.1.raw
  modified_base (581)..(581): a, c, t, g, unknown or other
  misc_feature (581)..(581): n is a, c, g, or t
  modified_base (585)..(585): a, c, t, g, unknown or other
  misc_feature (585)..(585): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccaggggaaccctggtccaccgtctcctcacgccctccaccaacgggcccagtccggtccttcccccgtggccgcccctgcctccacgggacgccacccgtccgagacgcaccgacggccggccccgtgggcctcggcccgtgggtaccaaacgggtaccttaccgttacccaacgtacttccgtcgtacgtcggacggccggggtcgtacgggaccgaaacgggccgacctagtaacgcagcngcgn

SEQ ID NO: 74491 - DNA, 601 bp, Homo sapiens
  misc_feature: GYAE6OF01ARQMG.35.19.B08.1.454.CMB.1.raw
  modified_base (136)..(136): a, c, t, g, unknown or other
  misc_feature (136)..(136): n is a, c, g, or t
  modified_base (333)..(333): a, c, t, g, unknown or other
  misc_feature (333)..(333): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(599): a, c, t, g, unknown or other
  misc_feature (598)..(599): n is a, c, g, or t
  modified_base (601)..(601): a, c, t, g, unknown or other
  misc_feature (601)..(601): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtncgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgnggggacacgggaaccctggtcaccgtcgtcctcgacgccctccgaaccaacgggcccacgtccggtcccttcccccgtcggtccgtccctcgcctccgacggtacgcctaccgtccgagacgccacgacgccggcccgtgggcctcggcccgtaggtaccgaacggtacctaccgtttccgaaccgtacttaccgttcgtaccgttcgggaacggtccggggtcgttgggacccgtaaggggcccgaacgtacgttacggngncnngn

SEQ ID NO: 74492 - DNA, 662 bp, Homo sapiens
  misc_feature: GYAE6OF01EHCCY.35.19.B08.1.454.CMB.1.raw
  modified_base (449)..(449): a, c, t, g, unknown or other
  misc_feature (449)..(449): n is a, c, g, or t
  modified_base (654)..(655): a, c, t, g, unknown or other
  misc_feature (654)..(655): n is a, c, g, or t
  modified_base (657)..(658): a, c, t, g, unknown or other
  misc_feature (657)..(658): n is a, c, g, or t
  modified_base (660)..(660): a, c, t, g, unknown or other
  misc_feature (660)..(660): n is a, c, g, or t
  modified_base (662)..(662): a, c, t, g, unknown or other
  misc_feature (662)..(662): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcgatcagccctaacagtggtgccacactctctgcacagaaatttcgagggccggtcaccatcgaccagggacacgtccagacaacacaacctatagtggaggtgaatggactgagatctgacgacacggccgtattattactggtgtgcgtagtattagttgacttacggtcggggacccagggggtaacccctggtcctaacccggtccttaccctcgaccgtccctaccgaacccgaaccgggccctaacgttcccgggtaccctttccccccgngggcccgtccccgttcgcccgttacccggaagggaccgccctaacccggttcccgaagggtacgaccaccgacggcccggccgttcgggcctacggccgtacggtaccgaacgggtacccttaccgttaccgaccgtattccgtacgttacgacgggacggtccgggtaccggtagggaccggtaacggccgtacgagtaccggnngnngngn

SEQ ID NO: 74493 - DNA, 656 bp, Homo sapiens
  misc_feature: GYAE6OF01A6R4K.35.19.B08.1.454.CMB.1.raw
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (270)..(270): a, c, t, g, unknown or other
  misc_feature (270)..(270): n is a, c, g, or t
  modified_base (620)..(620): a, c, t, g, unknown or other
  misc_feature (620)..(620): n is a, c, g, or t
  modified_base (631)..(631): a, c, t, g, unknown or other
  misc_feature (631)..(631): n is a, c, g, or t
  modified_base (648)..(648): a, c, t, g, unknown or other
  misc_feature (648)..(648): n is a, c, g, or t
  modified_base (650)..(652): a, c, t, g, unknown or other
  misc_feature (650)..(652): n is a, c, g, or t
  modified_base (654)..(656): a, c, t, g, unknown or other
  misc_feature (654)..(656): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctggacaagggtttgagtggcgtgggcgatcagccctaangtggtgccacnctctctgacacagtaaatttcgacgggccggtacaccagtcgaccgaggcctacgtccagaccaacacactntagtggagtagatggtactgagtatcgtcggaaccgacgtaccggtcttaattacgttcgtggttggtacgtagtaagttaactttaagttacggaacgtacgggttacggggacccgtaacgggggtaaccccttgggtacccacccgttacccgttcctccgacctcccggtaacccaaccgggaccggtccctaacggttcccggttaccccttccccggtcgtccccgtccgtacgacccgtaccgtacggaccgtacccgtaccgtacgacgtacgcaccgtcggccgtcggtcgcgtacgccgtataccgacggtaccttccgtcgtactacgttccagttcgnggtacggtcgngtcgagtcgacctgacncnnncnnn

SEQ ID NO: 74494 - DNA, 673 bp, Homo sapiens
  misc_feature: GYAE6OF01DUN9P.35.19.B08.1.454.CMB.1.raw
  modified_base (666)..(667): a, c, t, g, unknown or other
  misc_feature (666)..(667): n is a, c, g, or t
  modified_base (669)..(669): a, c, t, g, unknown or other
  misc_feature (669)..(669): n is a, c, g, or t
  modified_base (673)..(673): a, c, t, g, unknown or other
  misc_feature (673)..(673): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcgatcagccctaacagtggtgccacactctctgcacagaaatttcgagggccggtcaccatcgaccgaggacacgtccagcaacacaactatatggagtagaagtgactgagatcgtgacgacacggctattattactgtgtgcgagattagttcgactacggtcgggaccaacggggacccttggtccacccggtccttccgtcacgtccctaccacccgaaccggggcccctagttccccggttccctttcccccgcggtcccgtccccgtcggtccctacccggacgggtaccgcccgtaaccccgtcccggaacgaccggtaccaacccggacggccccgggtccccggtcgggcccgttcggtccccggttacgggtaccgaaaccggtacccgtttaaccttcccgaacgttactcccgttaggttaaccgtcgggtaccgggccgggtccgttaggggacccgtaacgggacccgtagtacgtcganncncggn

SEQ ID NO: 74495 - DNA, 693 bp, Homo sapiens
  misc_feature: GYAE6OF01D5B2K.35.19.B08.1.454.CMB.1.raw
  modified_base (285)..(285): a, c, t, g, unknown or other
  misc_feature (285)..(285): n is a, c, g, or t
  modified_base (480)..(480): a, c, t, g, unknown or other
  misc_feature (480)..(480): n is a, c, g, or t
  modified_base (679)..(679): a, c, t, g, unknown or other
  misc_feature (679)..(679): n is a, c, g, or t
  modified_base (687)..(687): a, c, t, g, unknown or other
  misc_feature (687)..(687): n is a, c, g, or t
tcagtacagatcgtcacgaccggtgctcgatttagtgagtcagtaaggggctggaaatgaagaagcctggggcctcagtgaaggtcctcctgcaaggacttctggataccaccttcacccgaattactttatacactgggtgcgacacggcccctgacaagggtttgaggtggcgtggggcgatcacgccctaacgagtggtcgacccacactcgtctcgacacagtaatttcgaggggccggtcaccgatcgaccgaggacctacgtcagacaacgacaactanagtcggaggtagaacgtcggactgagatcgacgacgacgacggccgttaattacttacgtcggtgtacgaggtacgtattagttacgaacttacgggcggggtacccgaacgggtacccgtgggtaccaccggtcctccgtcgaccggtccctaccgaacccgacggtcccagttcccggttacccttccccggnggcccgcctggcctacgacggcgaccaccgtccggaagtcggacgtccgacggtccggtccggtcggaccgttcggccggttacgggtacccgtaacggtaccgttaccgttacccgaacgttacgtccgttacgtaccgtacgggaccggcggggtaccgtagggaaccggacggggaccctacggaacgtcccgganacacgttnccgacg

SEQ ID NO: 74496 - DNA, 595 bp, Homo sapiens
  misc_feature: GYAE6OF01EDN6H.35.19.B08.1.454.CMB.1.raw
  modified_base (445)..(445): a, c, t, g, unknown or other
  misc_feature (445)..(445): n is a, c, g, or t
  modified_base (580)..(580): a, c, t, g, unknown or other
  misc_feature (580)..(580): n is a, c, g, or t
  modified_base (588)..(588): a, c, t, g, unknown or other
  misc_feature (588)..(588): n is a, c, g, or t
  modified_base (593)..(595): a, c, t, g, unknown or other
  misc_feature (593)..(595): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctagacgacacggccgtattattactggtgtgcgagtatatgactacgtggggccaacgggaaccctggtccaccgttctcctcacgccctaccaaccgacgggcccctagtcccggttccttcccccgtggcccgtccctcggccttacccgaggacncccacccgtccggagacgaccaccgacggcccggtcccgtgggccttcggcctgggtaccgaacgggtaccttaccgttaccgaacgtctccgttagacgtaggacggtcgggcgtgggaccgtaaaggccgtanagtacggntagcnnn

SEQ ID NO: 74497 - DNA, 614 bp, Homo sapiens
  misc_feature: GYAE6OF01EK8YP.35.19.B08.1.454.CMB.1.raw
  modified_base (327)..(327): a, c, t, g, unknown or other
  misc_feature (327)..(327): n is a, c, g, or t
  modified_base (455)..(455): a, c, t, g, unknown or other
  misc_feature (455)..(455): n is a, c, g, or t
  modified_base (607)..(608): a, c, t, g, unknown or other
  misc_feature (607)..(608): n is a, c, g, or t
  modified_base (611)..(612): a, c, t, g, unknown or other
  misc_feature (611)..(612): n is a, c, g, or t
  modified_base (614)..(614): a, c, t, g, unknown or other
  misc_feature (614)..(614): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacaggcccctggacaagggtttgagtggcgtgggggcggatcacgccctaacaggtggtcgccacactctctgcacaagtaaatttcgaggggccggtcaccagtacgaccgagggaccacgtccagacaacacaacctatagtggagtgaatggactgagatcgtgacgacacggctattagttacnggtgtgcgatatatgactacgcgggaccagggaccctggtaccaccgtctcctcacgtccctccgaacgacggcccagttccggtacccttcccccgtcggcccgtcccgtcgccgtccgagggaccnccgacccgtcgacgacgtccgacgtacggcccggtaccgcgggtcctcggccgttacgggtaccgaacggttacctacccttaccgacgtacgttccgttacgtacgtacggacggtccggggtccgtggaacggtacggaccgagagtcanncgnngn

SEQ ID NO: 74498 - DNA, 684 bp, Homo sapiens
  misc_feature: GYAE6OF01COS2S.35.19.B08.1.454.CMB.1.raw
  modified_base (136)..(136): a, c, t, g, unknown or other
  misc_feature (136)..(136): n is a, c, g, or t
  modified_base (676)..(676): a, c, t, g, unknown or other
  misc_feature (676)..(676): n is a, c, g, or t
  modified_base (678)..(678): a, c, t, g, unknown or other
  misc_feature (678)..(678): n is a, c, g, or t
  modified_base (682)..(682): a, c, t, g, unknown or other
  misc_feature (682)..(682): n is a, c, g, or t
  modified_base (684)..(684): a, c, t, g, unknown or other
  misc_feature (684)..(684): n is a, c, g, or t
tcagtacagatcgtcacgaccggtgctcgatttagtgagtcagtaaggggctgaaatgaagaagcctggggccccagtgaaggtctcctgcaagacttctggatacaccttcaccgaatactttatacactgggtncgacaggcccctggacaagggtttgagtggctgggggcgatcagccctaacagtggtgccacactctctgcacaagaaatttcgagggccgggtcaccatgaccagggacacgtccagcaacacaacctatatggaaggtgaatagggactgaagatacgtagaccgaacgacggtaccgtaataatttacctggtgtacgacgaagtattaagttgaacgtacgtgggggacccgaacgggaacccctggtaccaaccatcctcctcgaacgcccctacccaaccgaacgggacccctacgttccggtaccccttcccccgtcggtcccgtccccgtcgtccctacccgaggaccgacctacccgtccgacggacgtccgaaccgacggtccggtaccccggtcgggacctcggtacccgttcgggtaaccgtaaacgggtacccttaccgttacccaaccggtacttaccgttacggttaaccgtggtacgggcccgggtacgtcgggtaccggaaacgggtccgaacaacggttagngnactngn

SEQ ID NO: 74499 - DNA, 719 bp, Homo sapiens
  misc_feature: GYAE6OF01CU41L.35.19.B08.1.454.CMB.1.raw
  modified_base (194)..(194): a, c, t, g, unknown or other
  misc_feature (194)..(194): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
  modified_base (710)..(710): a, c, t, g, unknown or other
  misc_feature (710)..(710): n is a, c, g, or t
  modified_base (713)..(713): a, c, t, g, unknown or other
  misc_feature (713)..(713): n is a, c, g, or t
  modified_base (717)..(718): a, c, t, g, unknown or other
  misc_feature (717)..(718): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctggacgtaagggtttgaggtggcgtgggggcggatcagccctaacngtggtcgccacactctctgcacagaaactttcgacgggccggtcaccagtcgaccagggacacgtcagcaacacaactatagnggagtagaatggactganatntgacgacgacggaccgttatattacgtcgtggtcgacgtagtattagttagaccgtacggtcggggacccgtaacggggtaaccccgtggtacccgtaaccggttccctaccctacgtaaccgtcccctaacccgaacccggaaaccgggtcccctaaggttccccgggttccctttccccccggtacggccccggtccccgtacggtccccgtacccggtacgggaccgtacccgtaaccccgtccggaacggaccgccgaaccgaccgggcccggtacccggttcgggacctccggtaccgtcgggtacgtaaaccgggtcccttaaccgttacccgaacgttagtttccggtaactgggaccgggttccgggacgttccgggacgaaccggggcctaacgaaggtcgtnctncgtnnc

SEQ ID NO: 74500 - DNA, 562 bp, Homo sapiens
  misc_feature: GYAE6OF01AY2A2.35.19.B08.1.454.CMB.1.raw
  modified_base (187)..(187): a, c, t, g, unknown or other
  misc_feature (187)..(187): n is a, c, g, or t
  modified_base (286)..(286): a, c, t, g, unknown or other
  misc_feature (286)..(286): n is a, c, g, or t
  modified_base (325)..(325): a, c, t, g, unknown or other
  misc_feature (325)..(325): n is a, c, g, or t
  modified_base (371)..(371): a, c, t, g, unknown or other
  misc_feature (371)..(371): n is a, c, g, or t
  modified_base (512)..(512): a, c, t, g, unknown or other
  misc_feature (512)..(512): n is a, c, g, or t
  modified_base (544)..(544): a, c, t, g, unknown or other
  misc_feature (544)..(544): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (558)..(559): a, c, t, g, unknown or other
  misc_feature (558)..(559): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaanagtggtgccacactctctgcacagaatttcgagggccggtcaccatcgaccgagggacacgtccagcaacacaacctatatggagtgaatggactgagntctagacacgacggccttatattacgtgtgtgcgatatntgactacgtgggccaaggggaccctggtcctaccgtctcctcgacnccctaccaccgaacgggccctacgtccggtcccttccccgtcgccctccctcgcctccgacggacgccaccgtcgacgcgccacgcgccggccgtggctcggcctggaccgacgtactacctcgacgtactcgtagtacgnggtacggccggtacgtcggacgaacggccganacgtacggnancgnngac

SEQ ID NO: 74501 - DNA, 653 bp, Homo sapiens
  misc_feature: GYAE6OF01BA631.35.19.B08.1.454.CMB.1.raw
  modified_base (457)..(457): a, c, t, g, unknown or other
  misc_feature (457)..(457): n is a, c, g, or t
  modified_base (642)..(642): a, c, t, g, unknown or other
  misc_feature (642)..(642): n is a, c, g, or t
  modified_base (648)..(648): a, c, t, g, unknown or other
  misc_feature (648)..(648): n is a, c, g, or t
  modified_base (651)..(651): a, c, t, g, unknown or other
  misc_feature (651)..(651): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctggacaagggtttgagtggcgtggggcggatcagccctaacagtggtgccacactctctgcacagtaaaatttcaagggccgggtaccaccatcgaaccgagggacacgtccagaccaaacacaaacctatagtaggaggtacgaatgggactgagatcgtagaacgacaccggaccgtattacgtactgtgtgacgagattagttgacgtaacgtcggggaccgaacgggaacccgttggtccaacccgtctccctcacgtaccctccaaccgaacgggccccagttacccggttccccttcccccgngggaccccgtcccgtcgaccgtcccgaaggtaccgcctaaccccgtacgacgacgcaaccgacggcccggccgtgggacctcggccgttacgggacaacgggtaccttaaccgttcccgaacgtataccgtacggtactccggagggtcgggccgtagggacccgaagggcccaagaacgtaggntacgancgncg

SEQ ID NO: 74502 - DNA, 603 bp, Homo sapiens
  misc_feature: GYAE6OF01ERYZE.35.19.B08.1.454.CMB.1.raw
  modified_base (266)..(266): a, c, t, g, unknown or other
  misc_feature (266)..(266): n is a, c, g, or t
  modified_base (284)..(284): a, c, t, g, unknown or other
  misc_feature (284)..(284): n is a, c, g, or t
  modified_base (594)..(594): a, c, t, g, unknown or other
  misc_feature (594)..(594): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcaggggccggtcaccatgaccagggacacgtcagcaacacaacctatanggaggtgaatggactganatctagacgacgacggtccgtaatattactgtgtgcgagatattgactacgtggggccaggggaacctgggtaccaccgtctcctcacgccctaccaccgaacggtccccagtccgttccttccccgtcggcccgtccccgtcgaccgtcccaaggacgcctacccgtcccggaagacgaccacgacggcccgcccgtcgggccgtcggcccgtggtaccgaacgggtaccttaccgttaccgacgtactcgtacgtaaccgtggaacggccggggtaccttgggaccgtaacggggccacgacgttagnacgncgncg

SEQ ID NO: 74503 - DNA, 698 bp, Homo sapiens
  misc_feature: GYAE6OF01BNOWO.35.19.B08.1.454.CMB.1.raw
  modified_base (190)..(190): a, c, t, g, unknown or other
  misc_feature (190)..(190): n is a, c, g, or t
  modified_base (691)..(691): a, c, t, g, unknown or other
  misc_feature (691)..(691): n is a, c, g, or t
  modified_base (694)..(694): a, c, t, g, unknown or other
  misc_feature (694)..(694): n is a, c, g, or t
  modified_base (697)..(697): a, c, t, g, unknown or other
  misc_feature (697)..(697): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacacggcccctggactaagggtttgagtggcgtggggcgatcagccctaangtggtgccacactctctgcacagtaaacttcgagggccggtcaccatcgaaccagggacaccgtccagacaacaacaacctatatggaggtgaatggactgagatctgacgacgacggccgtaatattactggtgtgcgagaattagttcgaacgttacggtcggggacccgtaacgggggaacccgttcgggtcctacccggttctacccgttcgaccgtaccctcccgaaacccgtaaccgggggccctacggttacccggtttcccgttccccccgtcgggtcccgtccccgtcggtcccgtacccggacgggaaccgcccgtaaccccgtaccggtaacggacggccgaaccgaccgggtccccgggtcccggtaccggggtccgttcggccgttacgggtacccgtaacgggtaaccttaccgttaccgacgtacttcgtcggtacgtcgggacggtcgggtcgtacgggacgtaacgggccgtacgaatcgtacntangtng

SEQ ID NO: 74504 - DNA, 615 bp, Homo sapiens
  misc_feature: GYAE6OF01CAWMX.35.19.B08.1.454.CMB.1.raw
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (608)..(608): a, c, t, g, unknown or other
  misc_feature (608)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(615): a, c, t, g, unknown or other
  misc_feature (614)..(615): n is a, c, g, or t
tcagtacagatcgtcacgaccggtgctcgatttagtgagtcagtaaggggctgaaatgaagaagcctggggcctcagtgaaggtctcctgcaagacttctggatacacctttcaccgaatactttatacactgggtgcgacacggcccctggacaagggtttgagtggctggggcgatcgagccctaangtggtnccacactctctgcacaagtaaatttcgagggccggtcaccatcgaccaggacacgtccagacaacacaactatagtggagtgaatggactgagatcgtgacgacgacggctatattctgtgngacganatagttcgactacgtcgggacaacggggtaccctgggtacctacccgtctccctacgaccggtccctaccaaccgaacgggtccccttagtcccggttccctcccccgtcgcccgtcccgtccgcctccgaacggcgaccacccgtcgacgacgccgacgaccggccggcccgtcggccgtacgccgttacggtaccgaaccggtacctaccttaccgtaccgtactccgttacgtacgtacgacgggccgggtcgtgggacggtacgggccgtacgacgtacgnancngnn

SEQ ID NO: 74505 - DNA, 738 bp, Homo sapiens
  misc_feature: GYAE6OF01EBR2K.35.19.B08.1.454.CMB.1.raw
  modified_base (196)..(196): a, c, t, g, unknown or other
  misc_feature (196)..(196): n is a, c, g, or t
  modified_base (732)..(732): a, c, t, g, unknown or other
  misc_feature (732)..(732): n is a, c, g, or t
  modified_base (736)..(736): a, c, t, g, unknown or other
  misc_feature (736)..(736): n is a, c, g, or t
  modified_base (738)..(738): a, c, t, g, unknown or other
  misc_feature (738)..(738): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacacgtgggtgcgacacggcccctggacgtaagggtttgaggtggcgtggggcggatcagaccctaacnggtggtcgaccacactctctgcacgaagtaaactttcggaacggggtcccgggtacaaccgatacgaaccgagggaccaccgtaccacgacaaacaacaaccttaagtacgtaggtaggtaagaagtacggtactaggatacgtcgtaggaaccgacgaccggtaccgttagttaacgtttacggttggtacggtggacggtaagtagttaagtttaacgaccgttaacgggtcgggggaacccgtaccgggggtaacccgttcgggttaccctacccggttcccttaccgtaccaccggtacccctacccgaacccggaaccgggcccctaggttccccggttaccccgttccccgtccggtacccgtcccgtcgtcgtaccgacggacgtcccgaccgccgacgacacgaccgacgcccggtcggcggtccgtcgtcggtacgtaccgaacgtccttaccgtcaacgtctcggttacgtggtacgaccgggtcggtaccggtacggacgaaccgggtcgacgtacgtagcgtancgtngn

SEQ ID NO: 74506 - DNA, 776 bp, Homo sapiens
  misc_feature: GYAE6OF01B9U0V.35.19.B08.1.454.CMB.1.raw
  modified_base (188)..(188): a, c, t, g, unknown or other
  misc_feature (188)..(188): n is a, c, g, or t
  modified_base (766)..(766): a, c, t, g, unknown or other
  misc_feature (766)..(766): n is a, c, g, or t
  modified_base (768)..(768): a, c, t, g, unknown or other
  misc_feature (768)..(768): n is a, c, g, or t
  modified_base (771)..(771): a, c, t, g, unknown or other
  misc_feature (771)..(771): n is a, c, g, or t
  modified_base (773)..(773): a, c, t, g, unknown or other
  misc_feature (773)..(773): n is a, c, g, or t
  modified_base (775)..(775): a, c, t, g, unknown or other
  misc_feature (775)..(775): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctggacaagggtttgagtggcgtggggcgatcagccctaanagtggtgccacactctctgcacagtaaatttcgagggccggtcaccatcgaccgagggaccacgtccagacaacacaactatagtggagtgaagtggactgagatcgtagacgacgacggtaccgttaattagttaacgtggttaggtcgacggtaagtattagtttacgaacgttacgggtacggggtacccgaaacgggggtaaccccttgggtacccaacccggttccttacccgtacgaaccggtccccttacccggaaaccccggtaaacggggcccccttaagttcccggggtttaccccctttccccccggtcgggaccccgtccccgtacggtccccgtacccgggaacgggaacctaccccgtaacccggtacccggaaggaaccggacccgaaaccggaccgggtccccgggtaaccccggttcgggcccgttaccgggtcccggttacgggtaaccgtaaacggggttaccccttaccgtttacccgaacgtacgtttccgtaacggtttaccgtcggggaacggtccggggtacggtcgggaacgtacgggccgactaaggtacgnancgngngng

SEQ ID NO: 74507 - DNA, 837 bp, Homo sapiens
  misc_feature: GYAE6OF01DCCC5.35.19.B08.1.454.CMB.1.raw
  modified_base (828)..(828): a, c, t, g, unknown or other
  misc_feature (828)..(828): n is a, c, g, or t
  modified_base (832)..(832): a, c, t, g, unknown or other
  misc_feature (832)..(832): n is a, c, g, or t
  modified_base (834)..(834): a, c, t, g, unknown or other
  misc_feature (834)..(834): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacacggcccctggactaagggtttgagtggcgtggggcgatcagccctaagagtggtcgaccacactctctggcaacgagtaaagtttcgaacggggtcccggtacaacgtacgtacggacccgagggaccaccgttaccgaacgaaccaaacctaaccaaaccttaagttaggtaggggtaaaggtacgaaagttcgggaaccgtgaagtactcgtacggaacgtaaccgacggtaaccgttaattacgtttacgtggtcgtacggacgtaagtactttaaggttacggaccggttacgggccggggtaacgaacccggtaccgttggacccttacccgtccctaccgtacgtaccgtccccgtaacccgaaacgggtaccggtcccctaggtttcccccgttcccccgttaccccgggtcggtccccgtcccgtaccgtacccgtaccggtaacggtaccgtaacccgtaacccggttaccgggaacgtaccgggtacccaaccgggtccgggtccccgggttccgggtaccgggtccgtttacccgggacggtttacggtaaccccggtaaaggttcccgttaaccgtaaccgtacggttaccgttacggttacggtaaccggacggggtaccggtcgggtaaccggttcgggaacggtaacggccgtaacgttaacggatacgtntacngngcg

SEQ ID NO: 74508 - DNA, 832 bp, Homo sapiens
  misc_feature: GYAE6OF01EHLFK.35.19.B08.1.454.CMB.1.raw
  modified_base (271)..(271): a, c, t, g, unknown or other
  misc_feature (271)..(271): n is a, c, g, or t
  modified_base (823)..(823): a, c, t, g, unknown or other
  misc_feature (823)..(823): n is a, c, g, or t
  modified_base (826)..(826): a, c, t, g, unknown or other
  misc_feature (826)..(826): n is a, c, g, or t
  modified_base (828)..(828): a, c, t, g, unknown or other
  misc_feature (828)..(828): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacacggcccctggacaagggtttgagtggcgtggggcggatcagccctaacagtggtgccacactctctgcacagtaattcgagggccggtcaccatcgaccgaggacaccgtcagacaacacaactatagnggaggtagaagtggactaggaagtatcgagaccgacgacggtccgtattacgttacgtgtgtacggacgtagtaattagttacgaacgttaacgggcggggaacccgtaacgggggtaccccgttggtaccctacccggttccgttacccgtcgaaccggtcccctaacccgaacccggtaaccggggcccctaacggtttccccgggtttacccctttccccccggtccgggtaccccgtccccgttaccggtaccccgttacccgggaaccgggtacccggtaccccgtaaccccggtaccccggaacgggaaccggtacccgaacccggtaccgggacccccgggtccccggggttccgggtcccgttacccgggtccccgggttaaccgggttaacccggtaaaccgggttaacccgtttaaccccgttacccgtaaccggttaccttaccggtttacgggttaccggtaccgggtaccgggtccgggggtcccgggtaaccgggtaaccgggtaacgggacccggaacggtaacgttaacggcgtancgngngacg

SEQ ID NO: 74509 - DNA, 829 bp, Homo sapiens
  misc_feature: GYAE6OF01B60WW.35.19.B08.1.454.CMB.1.raw
  modified_base (137)..(137): a, c, t, g, unknown or other
  misc_feature (137)..(137): n is a, c, g, or t
  modified_base (353)..(353): a, c, t, g, unknown or other
  misc_feature (353)..(353): n is a, c, g, or t
  modified_base (813)..(813): a, c, t, g, unknown or other
  misc_feature (813)..(813): n is a, c, g, or t
  modified_base (823)..(823): a, c, t, g, unknown or other
  misc_feature (823)..(823): n is a, c, g, or t
  modified_base (825)..(825): a, c, t, g, unknown or other
  misc_feature (825)..(825): n is a, c, g, or t
  modified_base (827)..(827): a, c, t, g, unknown or other
  misc_feature (827)..(827): n is a, c, g, or t
  modified_base (829)..(829): a, c, t, g, unknown or other
  misc_feature (829)..(829): n is a, c, g, or t
tcagtacagatcgtcacgaccggtgctcgatttagtgagtcagtaaggggctgaaatgaagaagtctggggcctcagtgaaggtctcctgcaagacttctggatacaccttcaccgaattactttatacactgggtncgacaggcccctggacaagggtttgagtggcgtgggggcggatcgacgtaccctaaacgaggtcggtcgaccctaacaccttctccttggccaacaagtaaaacgtttcggaacgggggcccggtacaccagtacggaacccggagggtaccaccgtaccaaggaccctaaacaactaaccttaatacgtagggacggtagaagtcggactagganacttacgagaacccgacgaccgggtacttaattaccgttaagtgttagcgacgtagttacttagtacgtacgttacggcggggacccacggggtaccctaccggttgggcccgttacccggttcctttcgtacccgtacccggtaccccccttaaccggaaacccgggttaaacccggggccccttaaacgggtttcccccggttcccccgtttccccccggaaccggtcccttaccccccgttacccttaaccggaaaccgtccgtaacccgtcccgggtaccggtacggggtaccctaccgggaccgggccccgggtacccggtcgggtcccgtaccggtccggttaacgggaacccgtaacggttaccctaccgttacccgactacggttccttacggtaacgcgggtacgggtaccgggtcggtcgggtaaccgacgggggtacaccgacggtacncggacttggngngngn

SEQ ID NO: 74510 - DNA, 593 bp, Homo sapiens
  misc_feature: GYAE6OF01AS5LU.35.19.B08.1.454.CMB.1.raw
  modified_base (136)..(136): a, c, t, g, unknown or other
  misc_feature (136)..(136): n is a, c, g, or t
  modified_base (581)..(581): a, c, t, g, unknown or other
  misc_feature (581)..(581): n is a, c, g, or t
  modified_base (588)..(593): a, c, t, g, unknown or other
  misc_feature (588)..(593): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtncgacaggcccctggacaagggtttgagtggctggggcggatcagccctaacagtggtgccacactctctgcacagaaatttcagggccggtcaccatgaccagggacacgtccagcaacacaacctatagtggaggtgaatggactgagatctggacacacggccgtatattactgtgtgcgagattatgactacgtgggaccacgggaaccctggtaccaccgtctcctcacgccctaccaccgaacgggcccacgtccggttcccttcccccgtcggcccgtccccgtacgcccgtaccgacgggacgtccctaacccgtccgaacgacgccaaccgtaccggcccgggtccccgtcggggcctcggccgttacgggtacaacgggtaccttaccttaccgacgtactccgttgacgtggacggcgggtcgtggacgaggccngatacgnnnnnn

SEQ ID NO: 74511 - DNA, 643 bp, Homo sapiens
  misc_feature: GYAE6OF01AXRWL.35.19.B08.1.454.CMB.1.raw
  modified_base (189)..(189): a, c, t, g, unknown or other
  misc_feature (189)..(189): n is a, c, g, or t
  modified_base (390)..(390): a, c, t, g, unknown or other
  misc_feature (390)..(390): n is a, c, g, or t
  modified_base (625)..(625): a, c, t, g, unknown or other
  misc_feature (625)..(625): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (641)..(641): a, c, t, g, unknown or other
  misc_feature (641)..(641): n is a, c, g, or t
  modified_base (643)..(643): a, c, t, g, unknown or other
  misc_feature (643)..(643): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggcgtgggggcggatcagccctaanagtggtgccacactctctgcacagaaatttcgacgggccgggtcaccatcgaccgaggacacgtcagcaacacaacctatatggagtgaatggactgagatctcgacgacgacggtcctatattactggtgtgcggagtattagttagacttacgcggggaccaggggtaacccctggtaccacccgtctcctcacgcccnccaccgaacgggtcccacgtccgttcccttcccccgtcggcccgtcccgtacgtccctaccgacggtacgccgtaacccgtacccgtacggaccgccgaaccggccggaccccgggcccgtggggacccttcgggtcccgtacgggtaccggaaaccggttaccgtaccctttacccgcgtaacgtcgttacggtccgtagacgggtccgggtcgtacggggtacgagggcccgntacgtaggacngncgngn

SEQ ID NO: 74512 - DNA, 725 bp, Homo sapiens
  misc_feature: GYAE6OF01B7Q6X.35.19.B08.1.454.CMB.1.raw
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (305)..(305): a, c, t, g, unknown or other
  misc_feature (305)..(305): n is a, c, g, or t
  modified_base (715)..(715): a, c, t, g, unknown or other
  misc_feature (715)..(715): n is a, c, g, or t
  modified_base (719)..(719): a, c, t, g, unknown or other
  misc_feature (719)..(719): n is a, c, g, or t
  modified_base (722)..(722): a, c, t, g, unknown or other
  misc_feature (722)..(722): n is a, c, g, or t
  modified_base (724)..(724): a, c, t, g, unknown or other
  misc_feature (724)..(724): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacacggcccctaggacaagggtttgagtggcgtggggcggatcgacgccctaacagtggtcgcccactactctctgcaacagtaatttcgacgggccggtcacatcgaccgaggacacgcagacaacacactatgnggagtnaagtcgatnaagntcncgacgacncggtactaacttgtacgtgtcgtaggacgagtaatttcgtcgtaacgtaacgggtcgggacccggaacgggttaccctcgggtaccctacgttcccgtcaccgtacgaccctacccgaacgtaaccgggccccttaacgtccccgggtttccccgttacccggtccggtcccgtccccggtcgtccccgtaccggacggaacccgacccgtaccgtacccggaacgtaccggcccgccggtaacccgggccccgggtacccggttcggggtacccgtccggtacccgggtaccgggtaacccggtaaacggggttaaccccttaccgttaaccgacccggttacttacgttaaccggtctacggggacggttccgggcgtaccgggtagaccgggtaccgagttaccgancgangtncng

SEQ ID NO: 74513 - DNA, 658 bp, Homo sapiens
  misc_feature: GYAE6OF01BPZXP.35.19.B08.1.454.CMB.1.raw
  modified_base (131)..(131): a, c, t, g, unknown or other
  misc_feature (131)..(131): n is a, c, g, or t
  modified_base (195)..(195): a, c, t, g, unknown or other
  misc_feature (195)..(195): n is a, c, g, or t
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
  modified_base (523)..(523): a, c, t, g, unknown or other
  misc_feature (523)..(523): n is a, c, g, or t
  modified_base (530)..(530): a, c, t, g, unknown or other
  misc_feature (530)..(530): n is a, c, g, or t
  modified_base (654)..(656): a, c, t, g, unknown or other
  misc_feature (654)..(656): n is a, c, g, or t
  modified_base (658)..(658): a, c, t, g, unknown or other
  misc_feature (658)..(658): n is a, c, g, or t
tcagtacagatcgtcacgaccggtgctcgatttagtgagtcagtaaggggctgaaatgaagaagcctggggcctcagtgaaggtctcctgcaagtacttctggataccaccttcaaccgtaattactttanacacgtgggtgcgacacggccctggactaagggtttgaggtggcgtggggcgatcacgcctaanggtcggtnccaactctctcctgaccaagtaagtaaactttcggacggggcccggtacaccgagtggaaccgagggtaccacggacagaccaaacactaaacctntagtagggagtagaagtggactgagtcngtagacgacgaacgtcgtaattacttacgtgtgtggagaagttagtaacgttgacgtacggtacgggaccggtaacggggtacctcgggtaaccgtccgtacctctcgaaccggtcctacccgaacggaacgtccctacggttcccgtcccgtcccgtcggaccctcggtccgtccacggagaccgtacccgaacncggaacncggacaccgtcgccggtcgtcggaccgttcgcgtaacggccgtaacgtccgtaacctcggaactcgtaacggttcgaacggttcggcgggtccggagacgggacgtaacggcgacgaatcgacnnngn

SEQ ID NO: 74514 - DNA, 769 bp, Homo sapiens
  misc_feature: GYAE6OF01CRO5S.35.19.B08.1.454.CMB.1.raw
  modified_base (190)..(190): a, c, t, g, unknown or other
  misc_feature (190)..(190): n is a, c, g, or t
  modified_base (758)..(758): a, c, t, g, unknown or other
  misc_feature (758)..(758): n is a, c, g, or t
  modified_base (764)..(764): a, c, t, g, unknown or other
  misc_feature (764)..(764): n is a, c, g, or t
  modified_base (767)..(767): a, c, t, g, unknown or other
  misc_feature (767)..(767): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacacggcccctggactaagggtttgagtggcgtggggcgatcagccctaangtggtcgccacactctctgacacaagtaatttcgagggtccggtcaccagtcgaccgagggacacgtcagacaacacaactatagtggagtgaagtggacttagagatcgtcggaaccgacgtacgggtaccgttaattacgtttaaccgtgtaggttcggacgtaagtaacgtttagttacgtaacgtaccgggtacggggacccgtaacgggggtaccccttagggtaccctaacccgttccttaccgtccgacgtccccttacccgaaaccgggtaacgggacccccttaggttccccgggttaccctttcccccggtcggtacccgtccccgtcgtacccaccggtacggtaaccgcccgtaacccgtccggaagtaaccgaccgacgtaccggtcccggtacccgtcgggtcctccggtaccgttcgggtaaccgtaaaccgggttccttaacccggttaacctaccggtacttaccggttaacggtaccgttagggaccgggtacgggtaccggtttaccggggacggtaaaccgggccggtaaccggttagaccggtaggngtccgngcncg

SEQ ID NO: 74515 - DNA, 731 bp, Homo sapiens
  misc_feature: GYAE6OF01EUNO6.35.19.B08.1.454.CMB.1.raw
  modified_base (725)..(725): a, c, t, g, unknown or other
  misc_feature (725)..(725): n is a, c, g, or t
  modified_base (727)..(727): a, c, t, g, unknown or other
  misc_feature (727)..(727): n is a, c, g, or t
tcagtacagatcgtcacgaccggtgctcgattttagtgagtcagtaaggggctgaaatgaagaagcctggggcctcagtgaaggtctcctgcaagacttctggatacaccttcaccgaattactttatacactgggtgcgacgacggcccctggactaagggtttgagtggcgtgggggcggatcagccctaacagtggtgccacactctctcgcacaagtaaatttcgacggggccgggtcaccagtcgaccgagggacacgtaccagacaacacaacctatagtaggaggtagaagtggaactgagatcgtggacgacgacggtccgttaattattacgtgtgtgacgtagtattattgaacttacggtcgggaccgaaccgggtaccctggtaccctacccgaccctccgtcaccgtccctacccgaacccgaaacgggcccctacgtcccggtacccctttcccccgtacggacccctaccccccttaccaacccgtaacggtacacccgtaacccggttcgggtaccggggacccgaacgtaacccgggtccccggggtaccccttgggggtacccgtaccggtacccgtacgggttaaacgtaaaccggtaacccttaccgtttaacccgaccggttaacttcgttacggttaccgaggtacgggtaccgggtacgtacgggaaccgtaagggacccgtacgtaagtacgcgactgacngnagtg

SEQ ID NO: 74516 - DNA, 651 bp, Homo sapiens
  misc_feature: GYAE6OF01BXY2F.35.19.B08.1.454.CMB.1.raw
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
  modified_base (641)..(641): a, c, t, g, unknown or other
  misc_feature (641)..(641): n is a, c, g, or t
  modified_base (644)..(644): a, c, t, g, unknown or other
  misc_feature (644)..(644): n is a, c, g, or t
  modified_base (648)..(648): a, c, t, g, unknown or other
  misc_feature (648)..(648): n is a, c, g, or t
  modified_base (650)..(650): a, c, t, g, unknown or other
  misc_feature (650)..(650): n is a, c, g, or t
tcagtacagatcgtcacgaccggtgctcgatttagtgagtcagtaaggggctgaaatgaagaagtctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacataacctatatggagtgaatggatgagatcngacgcgacgccgtatagttactgtgngcgagtatagttgacgtacgtcgggccgacggggaaccctggtcctaccgtctccacacggtccctcccgaaccgtacgggccctacgttcccggtaccctttcccccgtgggaccccgtccccgtcgtcccttaccgacggacgccctaacccgtccggaacgacgtcccgaaccgtaccgggtcccgggtcccgttacggggtcctcgggcccgttacggggtacccgaaacggggtacctttaacccgttcccgaacgtacgtccgttcggttaacgtggacggtcgggcgttacggacggtaacggaccgtaccgaagttacgngangtgngng

SEQ ID NO: 74517 - DNA, 791 bp, Homo sapiens
  misc_feature: GYAE6OF01BMJ07.35.19.B08.1.454.CMB.1.raw
  modified_base (783)..(784): a, c, t, g, unknown or other
  misc_feature (783)..(784): n is a, c, g, or t
  modified_base (787)..(787): a, c, t, g, unknown or other
  misc_feature (787)..(787): n is a, c, g, or t
  modified_base (791)..(791): a, c, t, g, unknown or other
  misc_feature (791)..(791): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggcgtggggcggatcagccctaacagtggtgccacactctctgcacagaaatttcgacgggccggtcaccatgaccgaggacacgtccagcaacacaacctatatggaggtgaatggactgagatctaggacgacacggccgtaattacttacgtgtgtcgacgtaagtagttattagacgtaccggtggggacccgaaggggtaacccgtggtacctaccggttccttcctacgacgtcccctacccgaacccggaacgggtcccctaacggttccccggttccctttccccccggtacgggtccccgtcccccgtttcggaccccgttacccggaacgggaccgtccccgtaaccccggttaacccggagggtaacccgacccgtaacccggtaccgggtaccccggggtccccgggtttaccgggggccccgtttaccgggtcccggttaacggggttaaccccgtaaaaccgggtttaaccccgtttacccgttttaacccccggaacgggtttaacccgttcccggttaaacggttacccgggttagggaacccgggggttccggggtaccgttccggggaaaccgtacggggacccgtacgtaacgtaccggnngcngtgn

SEQ ID NO: 74518 - DNA, 668 bp, Homo sapiens
  misc_feature: GYAE6OF01CRROA.35.19.B08.1.454.CMB.1.raw
  modified_base (130)..(130): a, c, t, g, unknown or other
  misc_feature (130)..(130): n is a, c, g, or t
  modified_base (170)..(170): a, c, t, g, unknown or other
  misc_feature (170)..(170): n is a, c, g, or t
  modified_base (209)..(209): a, c, t, g, unknown or other
  misc_feature (209)..(209): n is a, c, g, or t
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (629)..(629): a, c, t, g, unknown or other
  misc_feature (629)..(629): n is a, c, g, or t
  modified_base (638)..(638): a, c, t, g, unknown or other
  misc_feature (638)..(638): n is a, c, g, or t
  modified_base (662)..(662): a, c, t, g, unknown or other
  misc_feature (662)..(662): n is a, c, g, or t
  modified_base (665)..(666): a, c, t, g, unknown or other
  misc_feature (665)..(666): n is a, c, g, or t
  modified_base (668)..(668): a, c, t, g, unknown or other
  misc_feature (668)..(668): n is a, c, g, or t
tcagtacagatcgtcacgaccggtgctcgatttagtgagtcagtaaggggctgaaatgaagaagccgtggggcctcagtgaaggtctcctgcaagacttctggactacaccttcaacctaattactttanacacgtgggtgcgacacggcccctggaacgtaagggtttnaggtggcgtgggggcgatcgacgccctaagggtggtacnccacgtctctcngacanaagtaacttcggacgggtccgtacacgagtccgaacggacggacctaccgacaacgaccaaacacctaaagtagtaacggtagggaggtaagtaacgtggtaactggactaacgttcgacggacgtaccgcgggtttaactattagttcggtgcggtagataagttagttactagaccggtcggtacgggacgtaaaccggtctcggacctacgtccttccacgaccaccctaaccggaaccgaccgcccgttgttccccgaccccgttccgtcccggtccgtccgtaccgtcccgtacggacggaccacgtacccgcgacgacgcgaccgacggtccggccggtcggctccggacgtacgacgtaacgtaccttacgtactactacgtcgtacgacgtcggnggccggtanacggacggtgacccgaatgagcancgnngn

SEQ ID NO: 74519 - DNA, 656 bp, Homo sapiens
  misc_feature: GYAE6OF01A61YZ.35.19.B08.1.454.CMB.1.raw
  modified_base (187)..(187): a, c, t, g, unknown or other
  misc_feature (187)..(187): n is a, c, g, or t
  modified_base (198)..(198): a, c, t, g, unknown or other
  misc_feature (198)..(198): n is a, c, g, or t
  modified_base (553)..(553): a, c, t, g, unknown or other
  misc_feature (553)..(553): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (653)..(653): a, c, t, g, unknown or other
  misc_feature (653)..(653): n is a, c, g, or t
  modified_base (655)..(656): a, c, t, g, unknown or other
  misc_feature (655)..(656): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacaggcccctggacaagggtttgagtggctggggcgatcagccctaangtggtgccacnctctctgcacagtaaactttcgagggccggtacaccatacgaaccgagggacacgtccagaccaacactaacctatagtgggaagtcgaagtggactaggagattcgtaggacgaccacgggtccttaattactacgtgtgtcgacgaatattattggacttacggtggggaccctaacgggggtaacccctggtacccgtcccgtacctcctacggaccgtccctacccgaaaccggaccgggcccctaacggttcccggttcccctttccccgacggtcccgtccccgtcgcccgtaccgacggaccgaccgacccgtaccggagacgaccgaccggaccgcccgggtcccgngggtaccgtcggtcccgtacggtacgaacggtacccttacgttccacgtctcgtcgtcgcgacggtccggacgtgggactacgggcacgagtacgnancngnn

SEQ ID NO: 74520 - DNA, 526 bp, Homo sapiens
  misc_feature: GYAE6OF01BKZMZ.35.19.B08.1.454.CMB.1.raw
  modified_base (136)..(136): a, c, t, g, unknown or other
  misc_feature (136)..(136): n is a, c, g, or t
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
  modified_base (404)..(404): a, c, t, g, unknown or other
  misc_feature (404)..(404): n is a, c, g, or t
  modified_base (521)..(521): a, c, t, g, unknown or other
  misc_feature (521)..(521): n is a, c, g, or t
  modified_base (523)..(526): a, c, t, g, unknown or other
  misc_feature (523)..(526): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtncgacaggcccctggacaagggtttgagtggctggggcggatcagccctaacagtggtgccacactctctgcacagaaatttcgagggccggtcaccatgaccagggacacgtccagcaacacaacctatagtggaggtgaatggactgagatctagacgacacggtcctaatattactgtgtagcgagattagtgactacggngggccaagggacctggcaccgtctccncacgcctaccacgacggccctagtccggtcctccccgngccgtccctcgcctcgacggacgccaccgtcgagacgcacgcgccgcgtggctgctcggacaaggtactactccgacgtatcgtatcgtgaggcgggctaggacgaggcgacagtgnannnn

SEQ ID NO: 74521 - DNA, 706 bp, Homo sapiens
  misc_feature: GYAE6OF01B3HGX.35.19.B08.1.454.CMB.1.raw
  modified_base (126)..(126): a, c, t, g, unknown or other
  misc_feature (126)..(126): n is a, c, g, or t
  modified_base (190)..(190): a, c, t, g, unknown or other
  misc_feature (190)..(190): n is a, c, g, or t
  modified_base (270)..(270): a, c, t, g, unknown or other
  misc_feature (270)..(270): n is a, c, g, or t
  modified_base (701)..(701): a, c, t, g, unknown or other
  misc_feature (701)..(701): n is a, c, g, or t
  modified_base (703)..(704): a, c, t, g, unknown or other
  misc_feature (703)..(704): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttanacactgggtgcgacaggcccctggacaagggtttgagtggcgtggggcgatcacgaccctaagnggtggtcgccactactctctgcacagtaacttcgacgggccggtcacatcgacgaggacacgtcagacaacactaactanagtggagtagaagtcggactgaatactcgtacgaaccgacgaccggtaccttaattacgttacgtggtagtcggacgtatattacgttacggaccgttacgggtcggggaccgtaacggggtacccgtggtaccctacccggttctacccgtacgaccgtccctaaccgaaccggtaaccgggtccctacggtttccccggtcccttccccggtcggcccctcccgtgcccgttaccggaaggtacccgccctaacccggtaccggagtaccgacccgaacggtaccgggccccggtaccggtcgggcccgttaccgggtacccgttagggtaacccgtaaccggtacccttacccgttaccgaagttaccttccggtacgtagtccgggaacggtcgggtaccacgggacgacggcccagtacgtagcancnnga

SEQ ID NO: 74522 - DNA, 820 bp, Homo sapiens
  misc_feature: GYAE6OF01E31CV.35.19.B08.1.454.CMB.1.raw
  modified_base (127)..(127): a, c, t, g, unknown or other
  misc_feature (127)..(127): n is a, c, g, or t
  modified_base (809)..(809): a, c, t, g, unknown or other
  misc_feature (809)..(809): n is a, c, g, or t
  modified_base (813)..(813): a, c, t, g, unknown or other
  misc_feature (813)..(813): n is a, c, g, or t
  modified_base (817)..(817): a, c, t, g, unknown or other
  misc_feature (817)..(817): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttanacacgtgggtgcgacacggcccctagggactaagggtttgaggtcggcgtgggggcggatccgacgaccctaacgaggtcgggtcgaccctaacgtaccttccgtctaggaccaacgtaagtaaactttcggacggggcccggtacaccctagtcggaaccgtagggacctaccggtccaaggtaccaaaactactaaaccttataggttagggaaggtagaaagttcggaactaggaagtaacttccggacgaaccgtaaccggacgggtacccttaagttacgtttaaccgtggtacggtacggcggtaaggttattaacggtttacgaaccggttacggtaccggggaccggtaaacccgggggttaacccctggggtaacccctaccccggtccttacccgaacgtcccgtaacccctaccccggtaaaccgggtaacccggggtccccccttaggtttcccccgggtttaccccctccccggtcccggtaccccgttacccggtccgtacccggtacccggacgaccggtacccgaccgtacccggacgcgaccaccggtaccggccggtccgtacgggtccggtcgtcgttacgggaccgtaacggtacctaccgtccacgtacctcgtcgtaccgtcggacggtcggacgtaggacggcggaccagtacggtacngganctgngac

SEQ ID NO: 74523 - DNA, 742 bp, Homo sapiens
  misc_feature: GYAE6OF01EZQJT.35.19.B08.1.454.CMB.1.raw
  modified_base (129)..(129): a, c, t, g, unknown or other
  misc_feature (129)..(129): n is a, c, g, or t
  modified_base (199)..(199): a, c, t, g, unknown or other
  misc_feature (199)..(199): n is a, c, g, or t
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
  modified_base (361)..(361): a, c, t, g, unknown or other
  misc_feature (361)..(361): n is a, c, g, or t
  modified_base (742)..(742): a, c, t, g, unknown or other
  misc_feature (742)..(742): n is a, c, g, or t
tcagtacagatcgtcacgaccggtgctcgatttagtgagtcagtaaggggctgaaatgaagaagcctggggcctcagtgaaggtctcctgcaagacttctggataccaccttcaccgtaattactttanacactgggtgccgacacggcccctggactaagggtttgaggtggcgtgggggcgatcacgtccctaacgnggtggacgccactacgtctctgcaacgaagtaaactttcggacgggccggtacacctagtcgaccgacgggaccacgtccacgactaaacaaccgtaacttanagtacggaggttagaagtggactgaagtatcgngacgacgacggtactatacgttacgnggtcgtgagaagtattagtgacgtaccgggtgggaccctaacggggccttggtaccgacccttcgtacctacgaccgtaccctacccgaaacgaccgggtacctacgttcccggttccccttccccggtaggccccgtaccctcggtccctaccgaggtacctcgaacccgcggtacgaccgacccgtacgaccgggtcccggtacccgtcgggtccgtcgtaccgggtttaccgaaccgtaaacgggttacccttaaccgttacccgtaacgtaacgtttcccggttacgttaaccgtcggggtaaaccgggtccgggttacggtaccgggaacggttaaaccggaccggtaattaacgggtcacgaaccgttcagtcgn

SEQ ID NO: 74524 - DNA, 580 bp, Homo sapiens
  misc_feature: GYAE6OF01AWI3U.35.19.B08.1.454.CMB.1.raw
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (288)..(288): a, c, t, g, unknown or other
  misc_feature (288)..(288): n is a, c, g, or t
  modified_base (299)..(299): a, c, t, g, unknown or other
  misc_feature (299)..(299): n is a, c, g, or t
  modified_base (375)..(375): a, c, t, g, unknown or other
  misc_feature (375)..(375): n is a, c, g, or t
  modified_base (460)..(460): a, c, t, g, unknown or other
  misc_feature (460)..(460): n is a, c, g, or t
  modified_base (486)..(486): a, c, t, g, unknown or other
  misc_feature (486)..(486): n is a, c, g, or t
  modified_base (489)..(489): a, c, t, g, unknown or other
  misc_feature (489)..(489): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (567)..(567): a, c, t, g, unknown or other
  misc_feature (567)..(567): n is a, c, g, or t
  modified_base (575)..(575): a, c, t, g, unknown or other
  misc_feature (575)..(575): n is a, c, g, or t
  modified_base (577)..(580): a, c, t, g, unknown or other
  misc_feature (577)..(580): n is a, c, g, or t
tcagtacagatcgtcacgaccggtgctcgatttagtgagtcagtaagggctggaaatgaagaagcctggggcctcagtgaaggtctcctgcaagacttctggatacaccttcaccaattactttatacactgggtgcgacacggcccctgggacaagggtttgagtcggctggggcgatcagccctaangtggngccacnctctctcgcacaagtaaatttcgagggccggcaccagtcgaccgagggacacgttccagaccaacactaaaccttagagtggaaggtnaaacgtggacngaagtatcgcgaacgactaccgggtaccttattaacttacgtggtacgtgacggaagtataccttgacttaacggngggcctaagggaaccctgggtccacccgttctccgaaccgccctacaccgtaacggcccctagtccctcccgtccccgtcggccncccgtcgccaaccggaggctccgacncgnacgcacgcgtcncgcgcngccgtaagcaacgtccttacgcaccgtatcgtatcgcgcggcggtactggacgacgccgnttaagcancnnnn

SEQ ID NO: 74525 - DNA, 965 bp, Homo sapiens
  misc_feature: GYAE6OF01EIOAN.35.19.B08.1.454.CMB.1.raw
  modified_base (125)..(125): a, c, t, g, unknown or other
  misc_feature (125)..(125): n is a, c, g, or t
  modified_base (958)..(959): a, c, t, g, unknown or other
  misc_feature (958)..(959): n is a, c, g, or t
  modified_base (962)..(962): a, c, t, g, unknown or other
  misc_feature (962)..(962): n is a, c, g, or t
tcagtacagatcgtcacgaccggtgctcgatttagtgagtcagtaagggctgaaatgaagaagcctggggcctcagtgaaggtctcctgcaagacttctggatacaccttcaccgaatactttanacactgggtgcgacaggcccctggacgaagggtttgaggtggcgtagggggcgtaagcgacgcccgttaaacgaggttcgggtcgacccaactaccgtcctactcggcaaacgtaacgtaaaactttcgaacgggggtccgggttaccaaccggtactacggaaacccaacggggaacctaccggtaccccgaagaaccgtaaaccaaccgtaaccgtttaagtacggttacggaaccggggttagaacgttaggggaacttaggtaacgaacgttaccgtaggtaaaccccggtaaccgaaccgggggttaaccccgttaaagttttaacggtttaaacccgttagggttaggtttcgggtaaccggggtaacgtaaaacgttttaggtaacggttaacccgttaaacgggggtttccgggtaaccccgggaaagggtaaaaccccccggtttcggggttaaccctaacccccggggttcccgtttaaccccgaacccggtaccccggtaccccccgttaaaacccggggaaaccccgggggttaaccccgaaccgtttccccggggtttaaacccccttaccccccccgggtttacggggtccccgggtaccccccgttcccgtacccggtaccccggtaacgggtaccgtacccgtaaccccgtaccggtaaggacccgaaccggacgacggtacccggtccggtcgggcgtacggcccgtacggaacgaccggtacgttaccgttacccgacgtaacctcggttcgtaacgttccgaggaccggtccggtcggtaccgacgggtccgtaccgacgtaggtacacgtacnncgngcg

SEQ ID NO: 74526 - DNA, 687 bp, Homo sapiens
  misc_feature: GYAE6OF01EFLPO.35.19.B08.1.454.CMB.1.raw
  modified_base (409)..(409): a, c, t, g, unknown or other
  misc_feature (409)..(409): n is a, c, g, or t
  modified_base (680)..(680): a, c, t, g, unknown or other
  misc_feature (680)..(680): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgccgacacggcccctggacaagggtttgagtggcgtggggcggatcagccctaacagtggtgccacactcgtctgcacgataaactttcgagggccggtcaaccgatgaccgagggacacgtccagcaaccacacctatatggaggtagaatggactagagactcgtggacgacgaccggccgttaattacgttactggtggtgacgagtattaattcggaacttacggtcggggacctaacgggtaaccctggtccgacccgttccgtaccncgtaccgcccttaccaacccgggaacgggcccctaacggttcccggttcccctttacccccgcgggtccccgtcccgtcggtcccgtaccgaacgggccgtacccaaccccgttccggaacgacgtaccgaccgtacggccccggtccggtcgggtccgtcgtcccgtagggtaccgaacgggtacctttacccgtccaaccgtcttcgttacgtaccgtcggtacgggccgggtacgtagggaccggacgggaccgtacgtaagcgtagntcatgcg

SEQ ID NO: 74527 - DNA, 813 bp, Homo sapiens
  misc_feature: GYAE6OF01BKJ6N.35.19.B08.1.454.CMB.1.raw
  modified_base (132)..(132): a, c, t, g, unknown or other
  misc_feature (132)..(132): n is a, c, g, or t
  modified_base (259)..(259): a, c, t, g, unknown or other
  misc_feature (259)..(259): n is a, c, g, or t
tcagtacagatcgtcacgaccggtgctcgatttagtgagtcagtaaggggctgaaatgaagaagccgtgggcctcagtgaaggtctcctgcaagacttctggaactaccaccttcaaccgaattacttttanaccacgtgggtagcgacgacgccctggactaagggttgaggtggcgtggggcgtatacgagtaccctaagtggtcggtgcccaactctctcgcgacacaagtaaacttcggacgggtccgtacacgngtacgaaccgaacgggtccaccggtacgacgaaccgtaaaccgacctaaaccgttataacgggtagggtaggttaactaaggttaaccggatagggaacgttcctacggtaccgggaaaccggaccccggtacggggtacctttaattaaccgtttcggtaggtcgttaggaccgtaaagtcgtacgtttacgcgttaaccggggacgggacccgtaacgggttacccgagtcccgtaccgtcctacgccccgtacacctacccggaccggtaccggacctgttaccccggtccctacccgcgacccgtccgtcgccgtaccggacgccgaccgttacccgacggactcggccgaacccggtccggtcccgtaccgggtcggttccgtacccggttcggaaccggtaaccggtaccgttaaccgtttaccccgtaacggcccgttacgttaccgggtaaccgtaccgggtaaccgggtcggttaccggggtccgaacgggggttaacccggtaccggaacggttagaaacccggttgaccgtaagtgcctagcg

SEQ ID NO: 74528 - DNA, 745 bp, Homo sapiens
  misc_feature: GYAE6OF01DF1WU.35.19.B08.1.454.CMB.1.raw
  modified_base (127)..(127): a, c, t, g, unknown or other
  misc_feature (127)..(127): n is a, c, g, or t
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (257)..(257): a, c, t, g, unknown or other
  misc_feature (257)..(257): n is a, c, g, or t
  modified_base (730)..(730): a, c, t, g, unknown or other
  misc_feature (730)..(730): n is a, c, g, or t
  modified_base (742)..(742): a, c, t, g, unknown or other
  misc_feature (742)..(742): n is a, c, g, or t
  modified_base (745)..(745): a, c, t, g, unknown or other
  misc_feature (745)..(745): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttanacacgtgggtgcgacacggcccctggacaagggtttgaggtggcgtgggggcgatacacggcccctaanaggtggtgacccactactcctcgtanccaacaagtaacgtttccggacgggaccgtccacncgtacgaccgtacgggacctacgaccagacaaccaacgtaactagtaggtagggtaggtataagtacggtacgtaggagtacttcgacggaacccgtacggtaccggtacgttaattacgtttggtaggtcggtaggtacgattagttaacgtacggtaccgtacgggtcgggaaccgtaaccggtaaccgtcgtacccgttccgtacctccctacaccgtccccaaaccgaccggtaaccggtcctacggttccccgttccccttacccgggccgtaccccgtcccgtacgtaccgtacccgacggtccacccggtaccgtaccgaccggtaccgaaccctcggacccggccgggtaccggtcggtccgtacggtccgtacgggaaccgtaaccgttacctacctaccggtactaccgttcggtaccgtagggtccggacgggtcggacgtccgggacgtaacggcgtaacncgtacgcagctnggn

SEQ ID NO: 74529 - DNA, 774 bp, Homo sapiens
  misc_feature: GYAE6OF01BPGNS.35.19.B08.1.454.CMB.1.raw
  modified_base (363)..(363): a, c, t, g, unknown or other
  misc_feature (363)..(363): n is a, c, g, or t
  modified_base (765)..(765): a, c, t, g, unknown or other
  misc_feature (765)..(765): n is a, c, g, or t
  modified_base (769)..(769): a, c, t, g, unknown or other
  misc_feature (769)..(769): n is a, c, g, or t
  modified_base (772)..(772): a, c, t, g, unknown or other
  misc_feature (772)..(772): n is a, c, g, or t
  modified_base (774)..(774): a, c, t, g, unknown or other
  misc_feature (774)..(774): n is a, c, g, or t
tcagtacagatcgtcacgaccggtgctcgatttagtgagtcagtaaggggctgaaatgaagaagcctggggcctcagtgaaggtctccctgcaagacttctggatacaccttcacccgaatactttatacactgggtgcgacaggccccctgggactaagggtttgagtggctggggcggatcagcccctaacagtggtgccacactctctgacacaagtaaatttcgacgggtcccgggtcaccgatcggaccgagggaccacggtccagtaccaaccaccaaacctatagtgggaacggtgaactgggacttaggacgtaagttcgtaggaaccacgaccgggtcttaattagtttaacgnggttacgtggtacggtaagtaatgttacggaccttaccggtcgggggacccgaaccggggtaaccccgttggtacccacccggttccgttcccgtaccgacctacccctacccgaaaccggtacccggccctacgttcccggtaccccgttcccccgcggtacccgtccccgttcgaccgtacccggacgggaccgtccccgtacccgtacgggaccgtaggacccgaaccgccggggtacccggtccccggtcgggtcccgttaccgggtccgtaccggttaccgtaacccgggtacctttaccccgttacctaacggtaccgttcgtaccggtttacggtaccggggtacggaccgggtccggttacggaacccggtgggtcccgaagtaaacgtcggtnagcncgngn

SEQ ID NO: 74530 - DNA, 595 bp, Homo sapiens
  misc_feature: GYAE6OF01CLOGN.35.19.B08.1.454.CMB.1.raw
  modified_base (412)..(412): a, c, t, g, unknown or other
  misc_feature (412)..(412): n is a, c, g, or t
  modified_base (591)..(591): a, c, t, g, unknown or other
  misc_feature (591)..(591): n is a, c, g, or t
tcagtacagatcgtcacgaccggtgctcgatttagtgagtcagtaagggctgaaatgaagaagcctgggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgaggccgggtcaccatgaccagggacacgtccagcaacacaacctatatggaggtgaatggactgagatcgtgacgacacggccgtatattactgtgtgcgagatattgactcgtggggaccagggaaccctggtccaccgtcctccgtcacgccctaccaccgaacgggccccagttccgggtcctttcccccgnggccgtccctcgcctcccgaggacgccaccgtccgacgacgcaaccgcggccggtcccgtgggccgtggcccgtacggtacgaacgggtacttaaccgttacccgaacgtacttccgtagttacgacggtacgggccgggtcgtggggaccgaagggtccgaccgtagtacggctcagntgcg

SEQ ID NO: 74531 - DNA, 1060 bp, Homo sapiens
  misc_feature: GYAE6OF01BPETM.35.19.B08.1.454.CMB.1.raw
  modified_base (1044)..(1044): a, c, t, g, unknown or other
  misc_feature (1044)..(1044): n is a, c, g, or t
  modified_base (1054)..(1054): a, c, t, g, unknown or other
  misc_feature (1054)..(1054): n is a, c, g, or t
tcagtacagatcgtcacgaccggtgctcgatttagtgagtcagtaaggggctgaaatgaagaagcctgggcctcagtgaaggtctcctgcaagacttctggatacaccttcaccgaattactttatacactgggtgcgacacggccctggactaagggtttgaggtggcgtgggggacgatcacgaccctaaacaggttggtcgacccaactaccttcctcttacgacaacgtaaggtaaaacttttccggaacgggggtacccgggttaccaacccgtagtaccggaacccggaaggggacctaccgtaccaacgaccaaaccctaaccaaaccgttaagtaggtacggggtaaacggttagaaacggtcggaaaccgttaggaacgtaccttacggtaccggaacggtaacccggtacccggttaaccgtttatttacgtttacggtaggtcgtacggtacgtaggtaactttaggtcgtacgtacgggtaccgggaccgaaccggggttaccgttggtaccctaccccggttctaccccgtacggtaccccgtaacccgtacccccgaaacccgggaaaccgggtttccccctaaccgggtttttcccccccggtttccccccggttttccccccgggtacccggggtcccccggtttaccccccgtacccgggggttaacccctaccccggggtaaacgggtaaccccgtaccccggttaaaccccccggttaaccggaaccccggggtacccggtaaaccccgggtaacccgggaccccggggtacccccgggttcccccgggtaacgggggttccccggtaacccgggtttaaccccgggttaacgggggtaaacccgttaacccccgggttaaccctttaaccccgggtttaccccggtaaaccggtttacgttacccgggttttaaacgggtaacccggttaaccgggggttacccggggttaccgggttacccgggggtaccggaaaacccggggtaaacccgggtaccggtaaacccggtaggttaacgacggnggtactcggngtacgg

SEQ ID NO: 74532 - DNA, 635 bp, Homo sapiens
  misc_feature: GYAE6OF01D15W8.35.19.B08.1.454.CMB.1.raw
  modified_base (585)..(585): a, c, t, g, unknown or other
  misc_feature (585)..(585): n is a, c, g, or t
  modified_base (595)..(595): a, c, t, g, unknown or other
  misc_feature (595)..(595): n is a, c, g, or t
  modified_base (622)..(622): a, c, t, g, unknown or other
  misc_feature (622)..(622): n is a, c, g, or t
  modified_base (629)..(629): a, c, t, g, unknown or other
  misc_feature (629)..(629): n is a, c, g, or t
  modified_base (631)..(632): a, c, t, g, unknown or other
  misc_feature (631)..(632): n is a, c, g, or t
  modified_base (634)..(635): a, c, t, g, unknown or other
  misc_feature (634)..(635): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacaggcccctggacaagggtttgagtggcgtggggcggatcacgccctaacaggtgtcgccacactctctgacacgaagtaattcgaggggccggtcaccatcgaccgagggacaccgacagacaaccacaactatagtaggagtagaataggactgagtacttcgaggaccgacgacggtaccttattacttacgtggtgtagcggattattacgtacgtacgtacgggtcggggacccgtaacggggtacccgttcggtaccgtacccgttcctcctcgtaccgtccctaccgaaccgggtaaccggtcccctaacgtttcccggttccccgttcccccggtaggccccgtacccgtcgcccgtacgacgggtaccaccccgtaacgccggagaccgccaacgcggccggtccgtggctcgcgtggacacgtctacgtcacgtntgtacgtcgngcggtcggcgtcggacggacggccganaggtacnanngnn

SEQ ID NO: 74533 - DNA, 807 bp, Homo sapiens
  misc_feature: GYAE6OF01A6DQP.35.19.B08.1.454.CMB.1.raw
  modified_base (127)..(127): a, c, t, g, unknown or other
  misc_feature (127)..(127): n is a, c, g, or t
  modified_base (194)..(194): a, c, t, g, unknown or other
  misc_feature (194)..(194): n is a, c, g, or t
  modified_base (217)..(217): a, c, t, g, unknown or other
  misc_feature (217)..(217): n is a, c, g, or t
  modified_base (797)..(797): a, c, t, g, unknown or other
  misc_feature (797)..(797): n is a, c, g, or t
  modified_base (800)..(800): a, c, t, g, unknown or other
  misc_feature (800)..(800): n is a, c, g, or t
tcagtacagatcgtcacgaccggtgctcgatttagtgagtcagtaaggggctgaaatgaagaaggctggggcctcagtgaaggtctcctgcaagacttctggatacaccttcaccgaattactttanacactgggtgcgacaggcccctggacgtaagggtttgagtggcgtggggcggatacacgccctaaanaggtggtcgaccaacactctcgngacaacaagtaaaactttcgacggggtccgggtacaaccaagtacgaaccgaacgggacctaaccggtacaagtaaccaaactaaccgaaaccttaagtatacgggaaggtacgaaagttacgggaccttaggaagacttactaggaacgtaaccgaaccggtcgtaatttaactttacgtcggtaggttacgaacgtaagtacttagtttacggacgtaacggtacggggacctaacggggtaacccctggggtaaccctaccgttacccgtctacccgaacggtacccctaaacccgtaaacccggaaccggggtacccctaacggttccccggtttccccgttacccccggtcggtccccgacccggtaccgtcctaccggtaacggacccaccgtaacccgtaccggaacgacgaccggaaccgaccgggaccccgggtacccgggtaccggggtaccctcgggtacccgttacgggttaaacgaaccggttacccttaaccgttacccgaacgttacctcggtacgtacggtagacgggcggtcggacggtacggaacggtccaacgagtacganacngcctgcg

SEQ ID NO: 74534 - DNA, 828 bp, Homo sapiens
  misc_feature: GYAE6OF01C7JBY.35.19.B08.1.454.CMB.1.raw
  modified_base (200)..(200): a, c, t, g, unknown or other
  misc_feature (200)..(200): n is a, c, g, or t
  modified_base (208)..(208): a, c, t, g, unknown or other
  misc_feature (208)..(208): n is a, c, g, or t
  modified_base (825)..(825): a, c, t, g, unknown or other
  misc_feature (825)..(825): n is a, c, g, or t
tcagtacagatcgtcacgaccggtgctcgatttagtgagtcagtaaggggctgaaatgaagaagcctggggcctcagtgaaggtctctgcaagacttctggatacaccttcaccgaattactttatacacgtgggtgcgacacggcccctaggacgtaagggttttgaggtggcgtagggggcggatcgacgaccctaanggtggtcnccacactctctgcacgagtaaatttcgacggggtccgggtcaccatcggaccgagggaccacgtaccagacaacaccaactagtagtaggaggtacgaagtcggactaggaactatcgtaggaaccgaaccggtaccggggttccttaaattacgtttacgtggttggtacggaacggtagtaaccgtttagttcggaaccgttacggggtccggggaacccgaaccggggtaacccggttcgggtaaccctacccggttccctaccgtacgacccgtacccctaacccggaaccccgggaaaccggtccccgttaaccggtttcccggttccccctttccccgggtacggtccccggtccccgttcgtacccgtaccggaacgggtaccgacccgtaacccgtaccgggaacgaccggaccgaaccggtacggcccggttacccggtcgggtaccgtcggtacccgttacgggtaccggtaaaccggttacccgttacccgttacgaaccggttactttaccggttacggtaccgggtacggtacgggggttcccggacggttacgggaacccgggtaacggtccggaacgtaaacggttcgggattaccgggatngcg

SEQ ID NO: 74535 - DNA, 782 bp, Homo sapiens
  misc_feature: GYAE6OF01E0ZM7.35.19.B08.1.454.CMB.1.raw
  modified_base (769)..(769): a, c, t, g, unknown or other
  misc_feature (769)..(769): n is a, c, g, or t
  modified_base (774)..(774): a, c, t, g, unknown or other
  misc_feature (774)..(774): n is a, c, g, or t
  modified_base (779)..(779): a, c, t, g, unknown or other
  misc_feature (779)..(779): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacacggcccctggactaaggggtttgagtggcgtggggcgatcacgaccctaacaggtggtcgaccacactctctacgacaacaagtaaaactttcggacggggtcccgggtacaaccgacgtacggaaccgacgggaccaccgtaccagaccaaaccaacctaaaccttaatacgtaggacggtagaatgggacagaagtatcgtacgaaccgacacgggtacctattacttactggtggacgacgaagtatagttacgtaacgtacgggtcggggacccgaacgggtaacccgtcgggtaccctacccgttccctacctacccgaaccggtacccctacccgaaaaccccggtaaaccgggtccccctaacggtttccccggtttaccccccttcccccgggtagggcccccttccccggtcgtaccccgttaccgggaacgggacctaacccgtacccgtaaccgggaagaccgaccgtacgggaccggccccgggtaccgcgggtaccgtcccggtccgtaacgggtaccgtaagtacccgttacctaccgtaacgtaccttcgtacggttacgtaccggagggtccccgggtacgtagggaccggaaccggcgtaacaaggtacncaagntcggnacg

SEQ ID NO: 74536 - DNA, 668 bp, Homo sapiens
  misc_feature: GYAE6OF01CSJA0.35.19.B08.1.454.CMB.1.raw
  modified_base (346)..(346): a, c, t, g, unknown or other
  misc_feature (346)..(346): n is a, c, g, or t
  modified_base (537)..(537): a, c, t, g, unknown or other
  misc_feature (537)..(537): n is a, c, g, or t
  modified_base (659)..(659): a, c, t, g, unknown or other
  misc_feature (659)..(659): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(666): a, c, t, g, unknown or other
  misc_feature (666)..(666): n is a, c, g, or t
  modified_base (668)..(668): a, c, t, g, unknown or other
  misc_feature (668)..(668): n is a, c, g, or t
tcagtacagatcgtcacgaccggtgctcgatttagtgagtcagtaaggggctgaaatgaaagaagcctggggcctcagtgaaggtctcctgcaagacttctggatacaccttcaccgaattactttatacacgtgggtgcgacacggcccctggactaagggtttgagtggcgtgggggcggatcagaccctaagaggtggtgccacactctctgcaacagaaaatttcgaggggccggtacaccagtacgaccaagggacacgtccaagacaaacacaaactataagtggaggtgaaatggactgagtatcgtagacgacacggacctaattatactgtgtgcanatatgactgcgggccgaaggaacccgttggacctaccgtctcctacacgtccacccgaaccgaacgggtcccaacgttccggtccctttcccccgcgggtcccgtcccctcggtaccccttacggaacgggaaccgtcccgaacccgtacggaacgacgtacccgacggacggtcccggccctggggcccncggtaccgtcggtaccgaacggtaccttaaccttccgaacgttactcgtacggttaccgtaccggggtagccccggggtacgtagggaacccggaacggggtccgaccgtaagttaacgggnagngngngn

SEQ ID NO: 74537 - DNA, 654 bp, Homo sapiens
  misc_feature: GYAE6OF01C89WS.35.19.B08.1.454.CMB.1.raw
  modified_base (127)..(127): a, c, t, g, unknown or other
  misc_feature (127)..(127): n is a, c, g, or t
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
  modified_base (614)..(614): a, c, t, g, unknown or other
  misc_feature (614)..(614): n is a, c, g, or t
  modified_base (625)..(625): a, c, t, g, unknown or other
  misc_feature (625)..(625): n is a, c, g, or t
  modified_base (647)..(647): a, c, t, g, unknown or other
  misc_feature (647)..(647): n is a, c, g, or t
  modified_base (649)..(654): a, c, t, g, unknown or other
  misc_feature (649)..(654): n is a, c, g, or t
tcagtacagatcgtcacgaccggtgctcgatttagtgagtcagtaagggctgaaatgaagaagcctggggcctcagtgaaggtctcctgcaagacttctggataccaccttcaccgaattactttanacactgggtgcgacacggccctggactaagggtttgagtggcgtgggcgatcacgccctaangtgtnccanctctctgcacataacttcgacggtccggcacgatcgacgaggacaccgtcagacaacaccaactatagnggtagtagaagtggactagacgtactcgacgacgaccgacggtaccttaagtactttacgtggtcgtcggagtagtatttacgtaggaccgttacgggtccgggacggtaaaccggtacccgttcggtaacctaccggttcctacccgtacgtacccgtcccctaaccccgggaacccggtaaccggtccccgttacggttcccccgggttcccccgttaccccgggtacccggtccccgtccccgttccgtaccgtacccggacggccgtaccgtacccgtacgacgccgaccgaccgccggtccggacgtcggctcgtcgtacgacgtaacgtctacctcacgtntcgtagtcggngcgcggacgtgacgcgcagacngnnnnnn

SEQ ID NO: 74538 - DNA, 668 bp, Homo sapiens
  misc_feature: GYAE6OF01CKURP.35.19.B08.1.454.CMB.1.raw
  modified_base (488)..(488): a, c, t, g, unknown or other
  misc_feature (488)..(488): n is a, c, g, or t
  modified_base (660)..(660): a, c, t, g, unknown or other
  misc_feature (660)..(660): n is a, c, g, or t
  modified_base (663)..(663): a, c, t, g, unknown or other
  misc_feature (663)..(663): n is a, c, g, or t
  modified_base (667)..(667): a, c, t, g, unknown or other
  misc_feature (667)..(667): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacacggcccctggacgaagggtttgagtggcgtggggcggatcagccctaacgagtggtgccacactctctgcacagtaaatttcgacgggccggtacaccagtcgaccgaggacacgtccagacaacacaactatagtaggagtagaagtggactaggagatacgtacgacgacgacggtacctattacgttacgtgtgtcgacgtagtattagttcgacgtacggcgggaccgaacgggacccttcggtacctacccgttctcctcgaccgccctacccgaccgaacgggccctacggttcccgttcccttccccgcggcccgtccctagcccgtaccggaggaccnccgtaaccgccggaacgacgacccacgaccgggcccggtcccgtagggtcctaccggtccgtacggtaaccgaaaccgttcctttaccgtacccgtaacgtcgttaccgttaggtaccgagggacgggtccgggtcggacggaacggaaccgggcccgtaagaacgtggacngangcgng

SEQ ID NO: 74539 - DNA, 870 bp, Homo sapiens
  misc_feature: GYAE6OF01A5BSE.35.19.B08.1.454.CMB.1.raw
  modified_base (130)..(130): a, c, t, g, unknown or other
  misc_feature (130)..(130): n is a, c, g, or t
  modified_base (859)..(859): a, c, t, g, unknown or other
  misc_feature (859)..(859): n is a, c, g, or t
  modified_base (863)..(863): a, c, t, g, unknown or other
  misc_feature (863)..(863): n is a, c, g, or t
tcagtacagatcgtcacgaccggtgctcgattttagtgagtcagtaagggggctggaaatgaagaagcctggggcctcagtgaaggtctcctgcaagacttctggatacaccttcaccgaattactttanacactgggtgcgacacggccctggactaagggtttgagtggcgtgggggcgaatcgacgtccctaaacgaggtcggtacgtcccaactaccgttccttaccgttcggacctaaaccgtaaaggttaaaaactttttccgggaaacggggggtccccggggttaccaaccctaagttacggaaacccggaacggggggtaaccctaaccgggttacccaaacgggaacccaaaaaccgtaaacccggtaaaaccctttaaggtaacggttaacgggggtaagggttaacggaaaacgttcggggaaccttagggaaacgtacttaccggtacggaaccggtaaccgaccgggtccgttaaattaacgtttcgtacggttggtacggacggtaacgtaatttacgttacggaaccgttacgggttccggggaacccgtaacggggtaacccgtgggttacccaccgttccgtacctcgaacggtccctaccgaaccgacggtcctacgtcccggttccctaccccggtcggcccgtcccgtcgccgtaccgacggtacgcctaccgtcgacgtacgaccgtacgaccggtccggccgtacgggacctacggtccgttacgggaaccgtaacgggttacccttaccgttaccgtacgtacgttaccggtacgtacgtacgggaccgggtcgggtacgtacgggaccgtacggtaccggtactacggtagacngacntcggtac

SEQ ID NO: 74540 - DNA, 768 bp, Homo sapiens
  misc_feature: GYAE6OF01EXIKZ.35.19.B08.1.454.CMB.1.raw
  modified_base (301)..(301): a, c, t, g, unknown or other
  misc_feature (301)..(301): n is a, c, g, or t
  modified_base (754)..(754): a, c, t, g, unknown or other
  misc_feature (754)..(754): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacacgtgggtgcgacacggccctggacgaagggtttgagtggcgtgggggcgatcacgaccctaacgaggtggtcgaccacacttctcgtcgacacaagtaaaactttcgacgggtccggtacaccagtcgaccgaggaccacgtacagacaacacaacctatagtggtaggtanaagtggacgtagaagtacgtcgtaacgaaccgacgacggtacgttaattaacagtttacgtggtacgtaacgtacgtaagtacgtaactttaacggaccggtaacgtacgggggtaccctaaggggtaacccctcggtacctacccgtactacccggtcctaaccggaaccctacccgggaccctaacggggtcccctaacgttccccggtaccgttcccccgacggtccgaccccgttaggacccgttcccgaacggtacctccgtaacccgccggtaacgaccgaccggtaccggacgtccgggtaaccccgttggggtacccttcgggtaccctaacgggtaccctaacgggttaaccccttaacgttacccggtaacgtaacgttccgaacggttaccggacggggtacgaccggggttactaacggggcccaagggtactaccgtagnggtacctagctgac

SEQ ID NO: 74541 - DNA, 788 bp, Homo sapiens
  misc_feature: GYAE6OF01B7VA2.35.19.B08.1.454.CMB.1.raw
  modified_base (191)..(191): a, c, t, g, unknown or other
  misc_feature (191)..(191): n is a, c, g, or t
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (781)..(781): a, c, t, g, unknown or other
  misc_feature (781)..(781): n is a, c, g, or t
  modified_base (784)..(784): a, c, t, g, unknown or other
  misc_feature (784)..(784): n is a, c, g, or t
  modified_base (787)..(787): a, c, t, g, unknown or other
  misc_feature (787)..(787): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggactaagggtttgagtggcgtgggggcggatcagccctaacngtggtnccacactctctgcacagtaaatttcgacggggtccggtcaccatcgaccgagggaccacgtccagaccaacacaacctatagnggaggtagaagtggactgagatcngacgacacggcctatattacgtgtgtgacgagtattagttacgacttacggcggggaccgaacgggtaacccgttggtacccaacccggttcctacccgtaccgtaccgtacccccttaccccgaaacccggtaaccggggtaccccctaacggttccccggttttccccctttaccccccgggttccgggacccccggttaccccgtccggtaccccgtacccggaagggtacccgtacccgtaaccccgtaccggaacggaccggacccgaaccgtaacccgggccccgggtacccccgggtcggggtaccccgttcgggtccccggtttacgggtaacccggtaaacccgggtttaaccctttaccccgtttaaccccgaacggttaaccgttccgttacggttaaccggttacgggaccgggtccggggtaccgttacggggaccggtaacgggccggtaacaaggttgacgncgntgng

SEQ ID NO: 74542 - DNA, 719 bp, Homo sapiens
  misc_feature: GYAE6OF01EBZRR.35.19.B08.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (712)..(713): a, c, t, g, unknown or other
  misc_feature (712)..(713): n is a, c, g, or t
  modified_base (718)..(718): a, c, t, g, unknown or other
  misc_feature (718)..(718): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacacgtgggtgccgacacggcccctaggactaaggggtttgagtggcgtggggcggatcacgccctaacnggtggtcgccacactctctgcacagtaaactttcggacggggtccggtcaccagtcgaccgagggaccacgtccaagaccaacaacaacctatagnggtagtagaagtcggactgaagtatctaggaaccgacgaccggtaccttattacttacgtggtgtgcggaattagttattcgacgttacggcggggacccgaacggggtaaccctgggtccctacccgttcctccgtacacccggtcccctaaccgaacccggaaccgggtcccctacggttccccggttccccctttccccggcggtcccctccccgtcgcccggtacccgagggaccctaccgtaacccggtccggaacgtcgacccgaaccggtacccgggcccggttacccggtgggacccgttcgtcccgggtaacgtaaccggaacgttacccttaccgttacccgacgttacgtcggttacgtacgtcgggacggtcggtacggtaccgggacggaccggcgacgtagtcgnngacgnc

SEQ ID NO: 74543 - DNA, 1012 bp, Homo sapiens
  misc_feature: GYAE6OF01EDWPJ.35.19.B08.1.454.CMB.1.raw
  modified_base (204)..(204): a, c, t, g, unknown or other
  misc_feature (204)..(204): n is a, c, g, or t
  modified_base (1009)..(1009): a, c, t, g, unknown or other
  misc_feature (1009)..(1009): n is a, c, g, or t
tcagtacagatcgtcacgaccggtgctcgattttagtgagtcagtaaggggctgaaatgaagaagcctgggcctcagtgaaggtctcctgcaagacttctggatacaccttcaccgaattactttatacacgtgggtgcgacacggccccgtggacgaagggtttgaggtggcgtggggcggtatcacgccctaagagtggtcnccgacactctctcgcacgaagtaaatttcgacggggccggtaccaacctatacggaccgaacgggaccgaaccgtccgacgaccaaaccaacgtaaaccttagtaacgtaggggtaacggtgaagtcggtaacggtagaaaggtacttaccgtacggtaaccgaaccggtaccgggtaccgttaatttaacgtttacggttacggttgggtacggtacggtaaacggtaacgtttacggtttacgaaccggtttaccggggtacgggtaccccggaaccggggttaaccccggttcgggttacccgtaccccgttacccgttccccgtacgacccgtaccccgttacccgaaaccccggaacccgggtaccccgttaaccggtttccccggtttaccccgtttccccccggggttaacccggcccggtttaccccccgtacgtccccgtaaccggtaacccggggtaacccgaccccggttaaccccggaaccccggtacggggtaaccccggtaaccctaaccccgggaaccgggttcccccggggtaccccgggttaccgggacccggtttacccggggtaccccggttttaaccgggaaacggttaaaccccgggtttaaccccgtttaacccggtaaccccggttaaccgtttaaacccggtttaccgggttttacccgttaaacgggttccggggggtaaaaccgggttccccgggggttcccggggttaaaccggggaacgggttaaaacccggggtaccgttaaacgaaccgggttacggacgaaccttgggaaccgngcg

SEQ ID NO: 74544 - DNA, 516 bp, Homo sapiens
  misc_feature: GYAE6OF02IOKHW.35.19.B08.1.454.CMB.1.raw
  modified_base (511)..(516): a, c, t, g, unknown or other
  misc_feature (511)..(516): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaaccctggtcaccgtctcctcagcctccaccaaggcccatccggtcttcccctggccgccctgcctccaggagccacctccgagacgcacagccggccctgggctgccctggtcaaggacctacttccacgatctgtactgagccgggctcggcaaggccgacagtagnnnnnn

SEQ ID NO: 74545 - DNA, 512 bp, Homo sapiens
  misc_feature: GYAE6OF02GDHCR.35.19.B08.1.454.CMB.1.raw
  modified_base (229)..(229): a, c, t, g, unknown or other
  misc_feature (229)..(229): n is a, c, g, or t
  modified_base (507)..(512): a, c, t, g, unknown or other
  misc_feature (507)..(512): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtnaccatgaccagggacacgtccagcaacacaacctatatggaggtgaatggactgagatctgacgacacggccgtatattactgtgtgcgagatattgactactggggccagggaaccctggtcaccgtctcctcagcctccaccaagggcccatccggtcttccccctggccgccctgcctccaggacgcacctccgacgagcacagccggccctgggcctgcctggtcaaggactacttccacgatctgtactgagcgggctggcaaggcgcatagnnnnnn

SEQ ID NO: 74546 - DNA, 510 bp, Homo sapiens
  misc_feature: GYAE6OF02HYCDF.35.19.B08.1.454.CMB.1.raw
  modified_base (505)..(510): a, c, t, g, unknown or other
  misc_feature (505)..(510): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggagtgaatggactgagatctgacgacacggccgtatattactgtgtgcgagatattgactactggggccagggaaccctggtcaccgtctcctcagcctcaccaagggcccatccggtccttccccctggccgccctgctccgaggacgcacctccgagacgcacacgcggccctgggcctgcctggcaaggactacttccacgatctgtactgagcgggctggcaaggcgcatagnnnnnn

SEQ ID NO: 74547 - DNA, 509 bp, Homo sapiens
  misc_feature: GYAE6OF02HHRL3.35.19.B08.1.454.CMB.1.raw
  modified_base (504)..(509): a, c, t, g, unknown or other
  misc_feature (504)..(509): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaaccctggtcaccgtctcctcagcctccaccaagggcccatcggtcttcccctggccgccctgcctccaggcgcacctccgagacgcacagccggccctgggcctgcctggtcaagctacttccacgactctgtactgagcgggctggcaaggcgcagtagnnnnnn

SEQ ID NO: 74548 - DNA, 519 bp, Homo sapiens
  misc_feature: GYAE6OF02HVKAI.35.19.B08.1.454.CMB.1.raw
  modified_base (510)..(510): a, c, t, g, unknown or other
  misc_feature (510)..(510): n is a, c, g, or t
  modified_base (514)..(519): a, c, t, g, unknown or other
  misc_feature (514)..(519): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaaccctggtcaccgtctcctcagcctccaccaagggcccatccggtccttcccccgtggccgccctcgctccaggacgcaccgtcccgagacgccacgacgccggcccgtgggcctgcctggtcaaggactacttccacgatctgtactgagcgggctggcaaggcgnatgnnnnnn

SEQ ID NO: 74549 - DNA, 513 bp, Homo sapiens
  misc_feature: GYAE6OF02IVAXN.35.19.B08.1.454.CMB.1.raw
  modified_base (503)..(503): a, c, t, g, unknown or other
  misc_feature (503)..(503): n is a, c, g, or t
  modified_base (508)..(513): a, c, t, g, unknown or other
  misc_feature (508)..(513): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccaggggaaccctggtcaccgtctcctcagcctccaccaagggcccatccggtcttcccctgccgccctgcctccaggacgcacctccgagacgcacacgcggcccgtgggctgcctggtcaaggactacttccacgactctgtactgagcgggctggcaaggcganatagnnnnnn

SEQ ID NO: 74550 - DNA, 510 bp, Homo sapiens
  misc_feature: GYAE6OF02GQ7Q0.35.19.B08.1.454.CMB.1.raw
  modified_base (504)..(505): a, c, t, g, unknown or other
  misc_feature (504)..(505): n is a, c, g, or t
  modified_base (507)..(510): a, c, t, g, unknown or other
  misc_feature (507)..(510): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggattagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactactggggccagggaaccctggtcaccgtctcctcagcctccaccaagggcccatcggtcttccccctggcgccctgcctccaggacgcacctccgagacgcacagcggccctgggctgccctgggtcaaggactacttccacgatctgtactgagcgggctggcaaggcgcatagnngnnnn

SEQ ID NO: 74551 - DNA, 516 bp, Homo sapiens
  misc_feature: GYAE6OF02HCE5I.35.19.B08.1.454.CMB.1.raw
  modified_base (395)..(395): a, c, t, g, unknown or other
  misc_feature (395)..(395): n is a, c, g, or t
  modified_base (511)..(516): a, c, t, g, unknown or other
  misc_feature (511)..(516): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaaccctggtcaccgtctcctcagcctcaccagggcccatccggtcttccccgnggccgccctgcctcccaggacgcacctccgagagccacacgccggcccgtgggcctgccgtggtcaaggacctacttccacgatctgtactgagcgggctggcaaggcgcatacgnnnnnn

SEQ ID NO: 74552 - DNA, 605 bp, Homo sapiens
  misc_feature: GYAE6OF02FT19S.35.19.B08.1.454.CMB.1.raw
  modified_base (602)..(602): a, c, t, g, unknown or other
  misc_feature (602)..(602): n is a, c, g, or t
tcagtacagatcgtcacgaccggtgctcgatttagtgagtcagtaagggcgtgaaaatgaagaagtctggggccctcagtgaaggtctcctcgcaagacttctggatacaccttcaccgaatactttatacactcgggtgcgacaggcccctggacaagggttttgagtggctggggcggatcagcctaacagtggtgccacgactctctgcacagaaatttcagggccgggtcaccagtgaccagggacacgtccagtcaacacaacctatataggaggtgaatggactggagatctgacgacacggccgtatacttactgtgtcgcgagatacttgactacgtgggccaggggaaccctgggtccaccggtctcctcacgcctccaaccgaacgggcccagtccgggtccttcccccgtcggccgccctgcctccgaggacgcacccgtccgagacgtcacacgccggccctgggcctcgccgtgggtccgtaacgggtacttaccgtttcccgaacgtacgtccgtacggttaccgtacggacggaccggggtcgtacgggaccgtaaacggggtccgaccgaacgttacggctgctcntcg

SEQ ID NO: 74553 - DNA, 559 bp, Homo sapiens
  misc_feature: GYAE6OF02H4WMY.35.19.B08.1.454.CMB.1.raw
  modified_base (311)..(311): a, c, t, g, unknown or other
  misc_feature (311)..(311): n is a, c, g, or t
  modified_base (553)..(554): a, c, t, g, unknown or other
  misc_feature (553)..(554): n is a, c, g, or t
  modified_base (556)..(559): a, c, t, g, unknown or other
  misc_feature (556)..(559): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattacngtgtgcgagatatgactactggggccagggaaccctggtcaccgtctcctcacgcctccaccaacgggcccatcggtccttccccgtggccgccctgcctccgaggcgccacccgtcgacgacgcacgagccggccctggggcctcggcccgtgggtccaaacgggtacctaccttcccgaacgtactccgttgtaacctggacggtccggggcttcgggacgaacgggtcgcgagtacggnngnnnn

SEQ ID NO: 74554 - DNA, 493 bp, Homo sapiens
  misc_feature: GYAE6OF02IP6DV.35.19.B08.1.454.CMB.1.raw
  modified_base (402)..(402): a, c, t, g, unknown or other
  misc_feature (402)..(402): n is a, c, g, or t
  modified_base (458)..(458): a, c, t, g, unknown or other
  misc_feature (458)..(458): n is a, c, g, or t
  modified_base (484)..(484): a, c, t, g, unknown or other
  misc_feature (484)..(484): n is a, c, g, or t
  modified_base (488)..(493): a, c, t, g, unknown or other
  misc_feature (488)..(493): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaacctggtcaccgtctctcagcctcaccaaggcccatcgtctcccctgcgcctgctcagncacctccgagagcacgacgcgccctgggcctgcctggtcaaggctacttccaacgntctgtactgagcgggctggcgagcgnatgnnnnnn

SEQ ID NO: 74555 - DNA, 530 bp, Homo sapiens
  misc_feature: GYAE6OF02GSP6O.35.19.B08.1.454.CMB.1.raw
  modified_base (525)..(530): a, c, t, g, unknown or other
  misc_feature (525)..(530): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaaccctggtcaccgtctcctcacgcctccaccgaacgggcccatccggtcttcccccgtggccgccctgcctccaggacgcaccctccgagacgcacgacgccggccctgggcctcggccctgggtccaaagggcctacttccacgtatctgtactgacgcgggctggcaagggcgcataggnnnnnn

SEQ ID NO: 74556 - DNA, 522 bp, Homo sapiens
  misc_feature: GYAE6OF02F8RTV.35.19.B08.1.454.CMB.1.raw
  modified_base (517)..(522): a, c, t, g, unknown or other
  misc_feature (517)..(522): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaaccctggtcaccgtctcctcacgcctccaccaacgggcccatccggtccttccccctggccgccctgcctcccaggacgccaccctccgagagccacacgccggccctgggcctgcctggtcaaggctaccttccacgatctgtactgagcgggctggcaaggcgacagtacgnnnnnn

SEQ ID NO: 74557 - DNA, 552 bp, Homo sapiens
  misc_feature: GYAE6OF02H380A.35.19.B08.1.454.CMB.1.raw
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggatcagccctaacagtggtgccacactctctgcacagaaatttcagggccgggtcaccatgacagggacacgtccagcaacacaacctatatggaggtgaatggactgagatctgacgacacggccttatattactgtgcgaaagttcgaacagtggctggcacgaggtcggatatgactactggggccagggaaccctggtccaccgcctcctcacgcctccaccaacgggcccatccggtcttccccctcggccaccctcctcccaacgacgccacctctcggggcacgagccggcccgtcgggcctcgccgtcggtcaacggacctacgttccacgactctcgtacgtgagcgggcgtcggcgaaggcgctaag

SEQ ID NO: 74558 - DNA, 547 bp, Homo sapiens
  misc_feature: GYAE6OF02HLUOL.35.19.B08.1.454.CMB.1.raw
  modified_base (542)..(547): a, c, t, g, unknown or other
  misc_feature (542)..(547): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaaccctggtcaccgtctcctcacgcctccaccaagggccccagtccggtccttcccccgtggccgcccctgcctcccaggacgccacctccgagacgccacacgccggccctgggcctggcccgtgggtaccaacgggaccttaccttccaacggtatccgtgtactgacggcgggtctgggacaagggccgcacgtagnnnnnn

SEQ ID NO: 74559 - DNA, 540 bp, Homo sapiens
  misc_feature: GYAE6OF02IH0S5.35.19.B08.1.454.CMB.1.raw
  modified_base (535)..(540): a, c, t, g, unknown or other
  misc_feature (535)..(540): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtcaccgtctcctcacgcctccaccaacgggcccatccggtccttcccctggccgccctgcctccaggacgccacctccgagacgccacgacgccggcccgtgggcctcggcccgtgggtccaaagggacctacttcccacgactcgtgtactgacggcgggctggcgaagggccgacgagtagnnnnnn

SEQ ID NO: 74560 - DNA, 514 bp, Homo sapiens
  misc_feature: GYAE6OF02HMT1X.35.19.B08.1.454.CMB.1.raw
  modified_base (503)..(503): a, c, t, g, unknown or other
  misc_feature (503)..(503): n is a, c, g, or t
  modified_base (509)..(514): a, c, t, g, unknown or other
  misc_feature (509)..(514): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccaggggaaccctggtcaccgtctcctcagcctccaccaagggcccatccggtcttccccctggccgccctgcctccaggcgccacctccgagacgcacacgccggccctgggcctgcctggtcaaggctacttccacgatctgtactgacgcgggctggcaaggcncatagnnnnnn

SEQ ID NO: 74561 - DNA, 627 bp, Homo sapiens
  misc_feature: GYAE6OF02HTJXA.35.19.B08.1.454.CMB.1.raw
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (626)..(627): a, c, t, g, unknown or other
  misc_feature (626)..(627): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgagggccgggtcaccatgaccagggaccacgtccagcaaacacaacctatatggaggtgaagtggactgagatctgacgacacggccgtatattactgtgtgcgagatattgactacgtcggggccacgggaaccctggtccaccgttctcctcacgccctaccaacccgaacgggccccaacttccgggtcccctttcccccgtgggcccgcccctcgtcctcccgagggacgcctaccctccgacgacgccgaacgaccggcccgggtcccgtcgggggccttcggcccgttacgggtaccgaaacgggtaccttaacccttcccgaacgtacttccttagttaccgtggaacgggtccggggcgttacgggaccgaaacgggtccgaccgtagtacgnacgncgnn

SEQ ID NO: 74562 - DNA, 572 bp, Homo sapiens
  misc_feature: GYAE6OF02HNFC7.35.19.B08.1.454.CMB.1.raw
  modified_base (312)..(312): a, c, t, g, unknown or other
  misc_feature (312)..(312): n is a, c, g, or t
  modified_base (568)..(572): a, c, t, g, unknown or other
  misc_feature (568)..(572): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggatcagccctaacagtggtgccacactctctgcacaggaatttcagggccgggtcaccatgaccagggacacgtccagcaacacaacctatatggaggtgaatggactgagatctgacgacacggccgtatattacngtgtgcgagatattgactacgtggggccagggaaccctggtccaccggtctcctcacgccctccaccgaacgggcccagtccgggtcccttcccccgtggcccgccctcgcctcccgaggacgccacccgtccgagacgccacgacggccggcccgtgggcctcggcccgttgggtaccgaagggaccttaccgttcccaacggtactccgttgtacctggacggccgggctcgggacaagggccgacgatagcgnnnnn

SEQ ID NO: 74563 - DNA, 545 bp, Homo sapiens
  misc_feature: GYAE6OF02IHWJ1.35.19.B08.1.454.CMB.1.raw
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
  modified_base (537)..(537): a, c, t, g, unknown or other
  misc_feature (537)..(537): n is a, c, g, or t
  modified_base (542)..(543): a, c, t, g, unknown or other
  misc_feature (542)..(543): n is a, c, g, or t
tcagtacagatcgtcacgaccggtgctcgatttagtgagtcagtaaggggcgtgaaatgaagaagcctcggggcctcagtgaaggtctcctgcaagacttctggatacaaccttcaccgaatactttatacactgggtgcgacaggcccctgggacaagggtttgagtggcgtggggcggatcagccctaacagtggtgccacactctctgcacagaaatttcagggccgggtcaccatgaccagggacacgtccagcaacacaacctataatggaggtgaatggactgagatctgacgacacggaccgtatattacngtgtncgagatattgaactagtggggccagggaccctggtcacgtctcctcagcctcacaaggcccatcgtcttcccctggcnccctgctccaggcncaccgtccgagacgcacgagccggcctgggctcggccctgggtaccaagggactaccgttccaccggtatccgtgtaccgtgacggtcgggcgtcggacgaacgggtccgcgtactacggcncgacnngc

SEQ ID NO: 74564 - DNA, 501 bp, Homo sapiens
  misc_feature: GYAE6OF02H6MPS.35.19.B08.1.454.CMB.1.raw
  modified_base (403)..(403): a, c, t, g, unknown or other
  misc_feature (403)..(403): n is a, c, g, or t
  modified_base (433)..(433): a, c, t, g, unknown or other
  misc_feature (433)..(433): n is a, c, g, or t
  modified_base (445)..(445): a, c, t, g, unknown or other
  misc_feature (445)..(445): n is a, c, g, or t
  modified_base (491)..(491): a, c, t, g, unknown or other
  misc_feature (491)..(491): n is a, c, g, or t
  modified_base (496)..(501): a, c, t, g, unknown or other
  misc_feature (496)..(501): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactactggggccagggaaccctgggtcaccgtctcctcacgcctccaccaagggcccagtccggtcttcccctggccnccctgctccagcgcacctccgagacgcacngcggccctggcngcctggcagctacttccacgatctgtactgagcggctggcaaggcngatgnnnnnn

SEQ ID NO: 74565 - DNA, 564 bp, Homo sapiens
  misc_feature: GYAE6OF02JJRPY.35.19.B08.1.454.CMB.1.raw
  modified_base (556)..(556): a, c, t, g, unknown or other
  misc_feature (556)..(556): n is a, c, g, or t
  modified_base (561)..(562): a, c, t, g, unknown or other
  misc_feature (561)..(562): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtccaccgtctcctcagcctccacaagggcccagtccggtcttcccctggccgccctgcctccgaggacgccacctccgacgacgcacacggccggcccgtcgggcctcgcccgtcggtaccaacgggaccttacgttcccaaccgactctcgtacctggacggtccggggccgtcgggaccgaacgggccgacgaacgttacggnagcgnntg

SEQ ID NO: 74566 - DNA, 502 bp, Homo sapiens
  misc_feature: GYAE6OF02ICUEY.35.19.B08.1.454.CMB.1.raw
  modified_base (311)..(311): a, c, t, g, unknown or other
  misc_feature (311)..(311): n is a, c, g, or t
  modified_base (497)..(502): a, c, t, g, unknown or other
  misc_feature (497)..(502): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattacngtgtgcgagatattgactactggggccagggaaccctggtcaccgtctcctcagcctccaccaagggcccatcggtcttcccctggcgccctgctccaggcgcacctccgagagcacagcggcctgggctgcctggtcaaggctacttccacgatctgtactgagcgggctggcaaggcgcatagnnnnnn

SEQ ID NO: 74567 - DNA, 668 bp, Homo sapiens
  misc_feature: GYAE6OF02FKD7O.35.19.B08.1.454.CMB.1.raw
  modified_base (279)..(279): a, c, t, g, unknown or other
  misc_feature (279)..(279): n is a, c, g, or t
  modified_base (303)..(303): a, c, t, g, unknown or other
  misc_feature (303)..(303): n is a, c, g, or t
tcagtacagatcgtcacgaccggtgctcgatttagtgagtcagtaaaggggacgtgaaatgaagaagcctggggcctcagtgaaaggtctcctgcaagacttctggatacaccttcgaccgaatactttatacactgggtgcgacaggcccctggacgaagggtttgagtggctggggcggatctagccctaacgcgtcggtcgccgaccacctcgtctgcacagaaatttcagggccggtcaccatgaccagggaccacgtccagcaacacaacctanatggagtgtaagtggactggaganctagactacacggccgtatacttaacttgtagttcgacggagtagtagttgactaacgtggggcctaagggaaccctggtcctaaccggtcgtacctcgacgcctcaacctaagggccctagttaccggtacttccccgtaggccgccctgctacgaggtacgtctaccgttcgtagagtcacgtacggccggaccgttcggggcctacggcccgttacgggttaccgtaaacgggttaccgtaaccggtttacccgaacgtaacgttccgtacggttaaccgttaggaaacggtccggggtcgtacgggtaccgaacgggtccccgtaacgtaacgttacggttcgacgttacgagttcctacg

SEQ ID NO: 74568 - DNA, 528 bp, Homo sapiens
  misc_feature: GYAE6OF02I7HAI.35.19.B08.1.454.CMB.1.raw
  modified_base (523)..(528): a, c, t, g, unknown or other
  misc_feature (523)..(528): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtcccagcaacacaacctatatggaggtgaatggactgagatctgacgacacggccgtatattactgtgtgcgagatattgactacgtggggccagggaaccctggtcaccgtctcctcacgcctccaccaacggggccccagtccggtccttcccccgtggcccgtccctgcctccaggacgccacctccgagacgcacacgccggccctgggcctgcctggtcaaggtctacttccacgatctgtactgagcgggctggacaaggcgacataggnnnnnn

SEQ ID NO: 74569 - DNA, 510 bp, Homo sapiens
  misc_feature: GYAE6OF02GUBAJ.35.19.B08.1.454.CMB.1.raw
  modified_base (505)..(510): a, c, t, g, unknown or other
  misc_feature (505)..(510): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccaggggacacgtccagcaacacaacctatatggaggtgaatggactgagatctgacgacacggccgtatattactgtgtgcgagatattgactactggggccagggaaccctggtcaccgtctcctcagcctccaccaagggcccatccggtcttccccgtggccgccctgcctccaggacgcacctccgagacgcacagccgccctgggctgcctggtcaaggctacttccacgatctgtactgagcgggctggcaaggcgcatagnnnnnn

SEQ ID NO: 74570 - DNA, 530 bp, Homo sapiens
  misc_feature: GYAE6OF02FEQKI.35.19.B08.1.454.CMB.1.raw
  modified_base (224)..(224): a, c, t, g, unknown or other
  misc_feature (224)..(224): n is a, c, g, or t
  modified_base (525)..(530): a, c, t, g, unknown or other
  misc_feature (525)..(530): n is a, c, g, or t
tcagtacagatcgtcacgaccggtgctcgatttagtgagtcagtaagggctgaaatgaagaagcctggcctcagtgaaggtctcctgcaagacttctggatacaccttcaccgaatactttatacactgggtgcgacaggccctggacaaggttgagtggctgggcggatcagccctaacagtgtgccacactctctgcacagaaatttcaggccgggtcaccntgaccaggcacgtccagccacacaacctatatgaggtgaatggactgagatctgacacacggccgtatattactgtgtgcgagatattgactacgtgggccagggaaccctggtccacgtctcctcacgcctccacccgaaggggccccagtccgtccttcccccctggccgccctgcctcccgaggacgccaccctccgagacgcaccgacgccgcccgtgggcctcgcctggtaccaaacggtacctaaccttcccactactctgtacgtgagcggggctgggccaagggcgacatagnnnnnn

SEQ ID NO: 74571 - DNA, 573 bp, Homo sapiens
  misc_feature: GYAE6OF02H5QAH.35.19.B08.1.454.CMB.1.raw
  modified_base (403)..(403): a, c, t, g, unknown or other
  misc_feature (403)..(403): n is a, c, g, or t
  modified_base (566)..(567): a, c, t, g, unknown or other
  misc_feature (566)..(567): n is a, c, g, or t
  modified_base (571)..(573): a, c, t, g, unknown or other
  misc_feature (571)..(573): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagattattgactacgtggggccaggggaccctggtccaccgtctcctcacgcctccacgaacgggcccagtccgtccttccccgnggcccgccctgcctccgaggcgccacccgtccgagacgcacgacgccggcccgtgggcctcggcccgtgggtaccgaacgggtaccttaccgttcccgaacgtacttccgtcgttacctgggacggccggggtcgtcgggacaaacgggccgacgaagtcggnngcgnnn

SEQ ID NO: 74572 - DNA, 571 bp, Homo sapiens
  misc_feature: GYAE6OF02IRQP8.35.19.B08.1.454.CMB.1.raw
  modified_base (428)..(428): a, c, t, g, unknown or other
  misc_feature (428)..(428): n is a, c, g, or t
  modified_base (563)..(563): a, c, t, g, unknown or other
  misc_feature (563)..(563): n is a, c, g, or t
  modified_base (566)..(567): a, c, t, g, unknown or other
  misc_feature (566)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactacgtggggaccaggggaaccctggtaccaccgtctcctcacgcctccaccgaacggcccagtccggtccttccccgtggcccgccctgcctccgaggacnccaccgtccgagacgcacgacggccggccctgggcctcggcccgttggtaccgaacggtccttaccgttccgacgtactccgtacgtacctggacggtccgggtctcgggaccgtaacgggccgacacgtacggncgnngngn

SEQ ID NO: 74573 - DNA, 576 bp, Homo sapiens
  misc_feature: GYAE6OF02HLVIL.35.19.B08.1.454.CMB.1.raw
  modified_base (571)..(571): a, c, t, g, unknown or other
  misc_feature (571)..(571): n is a, c, g, or t
  modified_base (573)..(575): a, c, t, g, unknown or other
  misc_feature (573)..(575): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtcaccgtctcctcacgccctccaccgaacgggcccacgtccggtccttccccgtcggcccgtccctgcctcccgacggacgccacccgtccggagacgccacgacggccggcccgtcgggcctcggcccttgggtaccaaacgggtaccttaccgttccgaacggtacttcgtacgtactggacgccggggtctgggacgaagggccgactagtacggcngnnnc

SEQ ID NO: 74574 - DNA, 603 bp, Homo sapiens
  misc_feature: GYAE6OF02JE872.35.19.B08.1.454.CMB.1.raw
  modified_base (596)..(596): a, c, t, g, unknown or other
  misc_feature (596)..(596): n is a, c, g, or t
  modified_base (600)..(601): a, c, t, g, unknown or other
  misc_feature (600)..(601): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctagacgacacggccgtatacttactgtgtgcgagatattgactacgtggggccagggaaccctggtccaccgtctcctcacgtccctcccaaccgaaacgggccccagttccgggtcccttcccccgtggtcccgccccttcgccctccgacggtacgccctacccgtcccggacgacgccgaaccgcggcccggcccgtggggcctcggcccgttcggtacgaacggtaccgttaccgttcccacgtatccgttacgtacctcggacgggccgggtcgtacgggacgaacggggcaccgaatcggcngcgnncg

SEQ ID NO: 74575 - DNA, 533 bp, Homo sapiens
  misc_feature: GYAE6OF02IBEXR.35.19.B08.1.454.CMB.1.raw
  modified_base (294)..(294): a, c, t, g, unknown or other
  misc_feature (294)..(294): n is a, c, g, or t
  modified_base (511)..(511): a, c, t, g, unknown or other
  misc_feature (511)..(511): n is a, c, g, or t
  modified_base (522)..(522): a, c, t, g, unknown or other
  misc_feature (522)..(522): n is a, c, g, or t
  modified_base (528)..(533): a, c, t, g, unknown or other
  misc_feature (528)..(533): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccaggacacgtccagcaacacaacctatatggaggtgaatggactgagatctgacganacggccgtatattactgtgtgcgagatatgactactggggccagggaaccctggtcaccgtctcctcagtctccaaccaaggggccccagtcggttcccttcccccgtggccgcccctgcctcccaggacgccacccgtccgacgacgccaccacgccggccctgggcctggcctgggtcaacggccttaccgttccacgatctgtactgagcgggntcggcacggcncgatgnnnnnn

SEQ ID NO: 74576 - DNA, 560 bp, Homo sapiens
  misc_feature: GYAE6OF02GLVCC.35.19.B08.1.454.CMB.1.raw
  modified_base (448)..(448): a, c, t, g, unknown or other
  misc_feature (448)..(448): n is a, c, g, or t
  modified_base (554)..(555): a, c, t, g, unknown or other
  misc_feature (554)..(555): n is a, c, g, or t
  modified_base (557)..(560): a, c, t, g, unknown or other
  misc_feature (557)..(560): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtcaccgtctcctcagcctccaccaagggcccagtccggtccttcccccgtggccgcccctcgcctcccgaggacgccacccgtccgagacgcaaccnggcccggcccgtggggcctcggccgttcgggtacaacgggccttaccgttcccaacggtatccttcgtacgtgacggtccgggctagggccaagggccgcaagtgnngnnnn

SEQ ID NO: 74577 - DNA, 605 bp, Homo sapiens
  misc_feature: GYAE6OF02IYNF0.35.19.B08.1.454.CMB.1.raw
  modified_base (271)..(271): a, c, t, g, unknown or other
  misc_feature (271)..(271): n is a, c, g, or t
  modified_base (598)..(598): a, c, t, g, unknown or other
  misc_feature (598)..(598): n is a, c, g, or t
  modified_base (602)..(602): a, c, t, g, unknown or other
  misc_feature (602)..(602): n is a, c, g, or t
  modified_base (604)..(605): a, c, t, g, unknown or other
  misc_feature (604)..(605): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaactatatggagtnaatggactgagatctgaacgacacgggcctatattactgtgtcgcgagtatattgaacttcgtcggggaccaagggaaccctggtacctaccggtctccgtcacgcctaccaccgaacggcccctagttccggtcccttccccgtcggtcccgtcccgtcgcccgtccgacggaccgtccgacccgtccgaacgacgccgaccgacggcccgcccgtgggcctcggcccgttacgggaccaaacggtaccttacccgttaccgaacgtacgtccgtagtaccgtggccggccgggtcgtacggcgtaacgggccgacgtaagtcgcncagngnn

SEQ ID NO: 74578 - DNA, 568 bp, Homo sapiens
  misc_feature: GYAE6OF02HLZ6A.35.19.B08.1.454.CMB.1.raw
  modified_base (562)..(563): a, c, t, g, unknown or other
  misc_feature (562)..(563): n is a, c, g, or t
  modified_base (565)..(568): a, c, t, g, unknown or other
  misc_feature (565)..(568): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctgggtacaccgtctcctcacgcctccaccgacgggcccagtccggtccttccccgtggccgccctgcctccgaggacgccacctccgacgcgccacgacgccggccgtgggcctcggcccgttgggtaccaacgggtaccttaccgttcccgaacgtactccgttagtacctggacggccggggtctacgggacgaacgggccgacgtagtagnngnnnn

SEQ ID NO: 74579 - DNA, 573 bp, Homo sapiens
  misc_feature: GYAE6OF02GIISB.35.19.B08.1.454.CMB.1.raw
  modified_base (567)..(567): a, c, t, g, unknown or other
  misc_feature (567)..(567): n is a, c, g, or t
  modified_base (571)..(573): a, c, t, g, unknown or other
  misc_feature (571)..(573): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtccaccgtctcctcacgccctccaccgaacgggcccagtccggtccttccccgtggcccgccctgcctccgaggcgccacctccgagacgcacgacgccggcccgtgggcctcgccgtcgggtaccgaacgggtaccttaccgttcccgaacgtactccgttgtaccgtcggacggccgggcgtacgggaccgaacgggccgacgtagtacggtcngcgnnn

SEQ ID NO: 74580 - DNA, 598 bp, Homo sapiens
  misc_feature: GYAE6OF02IXOPC.35.19.B08.1.454.CMB.1.raw
  modified_base (582)..(582): a, c, t, g, unknown or other
  misc_feature (582)..(582): n is a, c, g, or t
  modified_base (593)..(593): a, c, t, g, unknown or other
  misc_feature (593)..(593): n is a, c, g, or t
  modified_base (595)..(598): a, c, t, g, unknown or other
  misc_feature (595)..(598): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggcgtggggcggatcagccctaacagtggtgccacactctctgcacagaaatttcagggccggtcaccatcgaccagggacacgtccagcaacacaacctatatggagtgaatggactgagatctagacgacacggcctatacttactgtgtgacgagtatattgactacgtcggggaccacggggaaccctggtaccaccgtctaccgtcacgcctaccaccgaacggcccacgtccggtcccttccccgtggcccgtccctgccctaccgacggacgcctacccgtccggagacgccgaaccacggcccggtcccgtgggaccttcgccgttacggaccgaaacggacccttaaccgttcccaacgtacttcctacggtacctgggacggccgggtcgtacggccgaacggtccgngtaactcggcngnnnn

SEQ ID NO: 74581 - DNA, 550 bp, Homo sapiens
  misc_feature: GYAE6OF02G2AAM.35.19.B08.1.454.CMB.1.raw
  modified_base (405)..(405): a, c, t, g, unknown or other
  misc_feature (405)..(405): n is a, c, g, or t
  modified_base (544)..(544): a, c, t, g, unknown or other
  misc_feature (544)..(544): n is a, c, g, or t
  modified_base (546)..(547): a, c, t, g, unknown or other
  misc_feature (546)..(547): n is a, c, g, or t
  modified_base (549)..(550): a, c, t, g, unknown or other
  misc_feature (549)..(550): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactacgtggggccaagggaccctggtccaccgtctcctcacgccctccaaccacgggcccagtcccggtccttcccccgnggcccgtccctcgcctccgaggacgccaccgtccgagacgcacgacgccgccgtgggcctgccgtggtccgaaggtacctacgtccacgactcgtacgtactggacggcgggtctcggacgaacgggccgacgagtagncnngnn

SEQ ID NO: 74582 - DNA, 604 bp, Homo sapiens
  misc_feature: GYAE6OF02IZ12P.35.19.B08.1.454.CMB.1.raw
  modified_base (312)..(312): a, c, t, g, unknown or other
  misc_feature (312)..(312): n is a, c, g, or t
  modified_base (597)..(597): a, c, t, g, unknown or other
  misc_feature (597)..(597): n is a, c, g, or t
  modified_base (601)..(601): a, c, t, g, unknown or other
  misc_feature (601)..(601): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaaatggaactgagatctgacgacacggccgtatattacngtgtgcgagatattgactacgtggtgccagggaaccctgtcaccgtctcctcacgcctccaacgacgggccctaatcggtcctccccgtcggtcgccctcgacctccgacggtacgccgacctcggtacggggcaccgacggccggcccgtcgggccgtgacccgtcggtaccgaacgggtacctaccgtttacccgaccgtagtccgttacgtaccgttacggacggtaccggggccgttacgggaccggaacgggtacccggaccgtaacgtaacgggcgcgngcgngcg

SEQ ID NO: 74583 - DNA, 682 bp, Homo sapiens
  misc_feature: GYAE6OF02I9JMM.35.19.B08.1.454.CMB.1.raw
  modified_base (669)..(669): a, c, t, g, unknown or other
  misc_feature (669)..(669): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
tcagtacagatcgtcacgaccggtgctcgatttagtgagtcagtaagggcgtggaaatgaagaagcctggggcctcagtgaaggtctcctgccaagacttctggatacaccttcaccgaatactttatacactgggtgcgacaggcccctggacaagggtttgagtggctggggcgatcagccctaacagtggtgcctacacgtctctgccacagaaactttcgagggccgggtcaccatgaccgagggacacgtccagcaacacaacctatatggagtgaatggactgagatcgtagacgacacggccgtatacttacgtggtagtggacgacgtattagttcgaacgttacggtcggggacctaacggggtaaacccttggggttaccctaaccgggttccttacccgttacgaaccggtcccttacccgaaccgtaaacggggccccttaaagttcccgggttacccttcccccgtacggtaccctaccccgtacccttacccgtaacgaccgtaccgtaacccgttcggtacggggacctacggacggtccggcccggtacgggcgtccgtccgtcggttaccgaacggtacccgtaccgttaccgtacgtactcgtacgtaacctaggtacgcgggtcgtcggacgtacgcgtacgagtacgcnctacgcgncnacg

SEQ ID NO: 74584 - DNA, 507 bp, Homo sapiens
  misc_feature: GYAE6OF02F9SBW.35.19.B08.1.454.CMB.1.raw
  modified_base (498)..(498): a, c, t, g, unknown or other
  misc_feature (498)..(498): n is a, c, g, or t
  modified_base (502)..(507): a, c, t, g, unknown or other
  misc_feature (502)..(507): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccaggggaaccctggtcaccgtctcctcagcctccaccaagggcccatccggtcttccccctggcgccctgctccaggcgcacctccgagagcacagccggccctgggctgcctggtcaaggactacttccacgatctgtactgagcgggctggcaaggcgnatgnnnnnn

SEQ ID NO: 74585 - DNA, 527 bp, Homo sapiens
  misc_feature: GYAE6OF02GLL3L.35.19.B08.1.454.CMB.1.raw
  modified_base (504)..(504): a, c, t, g, unknown or other
  misc_feature (504)..(504): n is a, c, g, or t
  modified_base (522)..(527): a, c, t, g, unknown or other
  misc_feature (522)..(527): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaaatgggactgagatctgacgacacggccgtatattactgtgtgcgagatattgactacgtgggccagggaaccctggtcaccgtctcctcagcctccaccaagggcccatccggtcttcccccgtggccgccctcgctccaggacgccacctccgagacgcacacggccggccctcgggcctcggccctggtccaagggacctacttccacgatctgtactgagcgggntcggcaacggcgcatagnnnnnn

SEQ ID NO: 74586 - DNA, 575 bp, Homo sapiens
  misc_feature: GYAE6OF02GE25E.35.19.B08.1.454.CMB.1.raw
  modified_base (432)..(432): a, c, t, g, unknown or other
  misc_feature (432)..(432): n is a, c, g, or t
  modified_base (567)..(567): a, c, t, g, unknown or other
  misc_feature (567)..(567): n is a, c, g, or t
  modified_base (571)..(572): a, c, t, g, unknown or other
  misc_feature (571)..(572): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaaatggactgagatctgacgacacggccgtaatattactgtgtgcgagatattgactgtgggccaggaaccctgtcaccgtctcctcacgcctccaaccgacgggtcccaggtccgtccttcccgtcgtcgggccctacccgtgccttccgagggacnccaacccgtccggagcgacacgacggccggccctagggctcgccttgggaccaacggtcctaccgttccagtacttcgttagtaccgtggacggccgggtactcgggtaaaccacggggctaccgtaagtccggnacgnngac

SEQ ID NO: 74587 - DNA, 513 bp, Homo sapiens
  misc_feature: GYAE6OF02HEVCL.35.19.B08.1.454.CMB.1.raw
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (502)..(502): a, c, t, g, unknown or other
  misc_feature (502)..(502): n is a, c, g, or t
  modified_base (508)..(513): a, c, t, g, unknown or other
  misc_feature (508)..(513): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtcacgtctcctcagcctcaccaagggcccatcggtcttccccnggccnccctgctccaggcgccacctccgagacgcacacgccggccctgggcctgcctggtcaaggctacttccacgatctcgtactgaggcgggctggcgaaggcganagtagnnnnnn

SEQ ID NO: 74588 - DNA, 514 bp, Homo sapiens
  misc_feature: GYAE6OF02F0YBQ.35.19.B08.1.454.CMB.1.raw
  modified_base (432)..(432): a, c, t, g, unknown or other
  misc_feature (432)..(432): n is a, c, g, or t
  modified_base (509)..(514): a, c, t, g, unknown or other
  misc_feature (509)..(514): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtcaccgtctcctcagcctcaccaaggcccatccggtcttcccctggccgccctgcctccaggacgcacctccgagagcacncgcgccgtggctgccgtggtcaaggactacttccacgtactctgtactgacggcgggctcggcgacggcgcagtagnnnnnn

SEQ ID NO: 74589 - DNA, 575 bp, Homo sapiens
  misc_feature: GYAE6OF02I5OJZ.35.19.B08.1.454.CMB.1.raw
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (568)..(568): a, c, t, g, unknown or other
  misc_feature (568)..(568): n is a, c, g, or t
  modified_base (571)..(571): a, c, t, g, unknown or other
  misc_feature (571)..(571): n is a, c, g, or t
  modified_base (574)..(575): a, c, t, g, unknown or other
  misc_feature (574)..(575): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggagtgaagtggactgagatctgacgacacggtcctatattactgtgtgcgagtatagttgactacgtcggggccaaggggtaaccctggtaccaccgtctcctcacgtccctaccaccgacgggcccagtccggtccttccccgnggccgtccctcgcctcgaggacncaccgtccgagcncacncgccggccctgggcctcggcccgtggtaccgaacggtacctaccttccgacgtacttccgtcgtacctcggacggtcccgggacgtcgggacgtaacgggcctacgtacgtacggncgngcnn

SEQ ID NO: 74590 - DNA, 582 bp, Homo sapiens
  misc_feature: GYAE6OF02HEUTF.35.19.B08.1.454.CMB.1.raw
  modified_base (438)..(438): a, c, t, g, unknown or other
  misc_feature (438)..(438): n is a, c, g, or t
  modified_base (576)..(577): a, c, t, g, unknown or other
  misc_feature (576)..(577): n is a, c, g, or t
  modified_base (580)..(582): a, c, t, g, unknown or other
  misc_feature (580)..(582): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtccaccgtctcctcacgccctccaaccgaacgggcccaacgtccggttccttcccccgtggcccgtcccctgccctccgacgggacnccacccgtccgacgacgccaccgacggccggcccgtgggcctcggcccgttgggtaccgaacggtaccttaccttacccgacgtacttccgtacgtacgtggacggccgggctgggaccaagggccgacgagtacggnnagnnn

SEQ ID NO: 74591 - DNA, 550 bp, Homo sapiens
  misc_feature: GYAE6OF02FTESE.35.19.B08.1.454.CMB.1.raw
  modified_base (423)..(423): a, c, t, g, unknown or other
  misc_feature (423)..(423): n is a, c, g, or t
  modified_base (441)..(441): a, c, t, g, unknown or other
  misc_feature (441)..(441): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtgggccagggaccctggtcaccgtctcctcagcctccacaacgggccccagtccggtccttcccccgtggcccgccctgcctccgaggacnccacctccgagacgcacncgccggcctgggctcgcctggtcaacggtcctacgttccgacgtctcgtgtactgacgtccggggtctcgggaccgaagggccgacgaacgttaggactgactgagtcg

SEQ ID NO: 74592 - DNA, 539 bp, Homo sapiens
  misc_feature: GYAE6OF02JG1LN.35.19.B08.1.454.CMB.1.raw
  modified_base (406)..(406): a, c, t, g, unknown or other
  misc_feature (406)..(406): n is a, c, g, or t
  modified_base (538)..(539): a, c, t, g, unknown or other
  misc_feature (538)..(539): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactacgtggggaccaggggaaccctggtacaccgtctcctcagccctccgaaccacgggcccagtccggtaccttccccgnggtccgccctgcctccgaggacgccaccgtccgagacgcacgcgccgcctcggctgcctgacgaacgacctactccacgtactcgtgtactgacggcgggctcggacgaacggcgacgtagtcgactgctgnn

SEQ ID NO: 74593 - DNA, 611 bp, Homo sapiens
  misc_feature: GYAE6OF02GRCPV.35.19.B08.1.454.CMB.1.raw
  modified_base (599)..(599): a, c, t, g, unknown or other
  misc_feature (599)..(599): n is a, c, g, or t
  modified_base (609)..(609): a, c, t, g, unknown or other
  misc_feature (609)..(609): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggcagggaaccctggtccaccgtctcctcacgccctaccgaccgaacgggccctagtccggtcccttcccccgtggcccgtcccgtgtccctccgaggcgccacccgtcccgagacgccacgacggccggcccgtgggcctcggccgttcggtaccgaacggtaccttaccgttacccgaacggtacttacgttacggttaccgtacgggacggtccgggggtccgtacgggaccgaaacgggccgtaaccgtaacgtacggtnacgacgtcgngc

SEQ ID NO: 74594 - DNA, 574 bp, Homo sapiens
  misc_feature: GYAE6OF02JAGNO.35.19.B08.1.454.CMB.1.raw
  modified_base (334)..(334): a, c, t, g, unknown or other
  misc_feature (334)..(334): n is a, c, g, or t
  modified_base (565)..(565): a, c, t, g, unknown or other
  misc_feature (565)..(565): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggaccacgtccagcaacacaacctatatggaggtgaatgggactgagatctggaacgacgaccggccgttaatattactggtagtgcgagattnttgactagtcggggccaggggtaacccctggtacaccggtcctcctcacgcctaccaccgaacgggccccagtccggttcccttccccgtcggccgtccctcgcctccgacgcgccaccgtccgagcgcacgacggccgccgtggcctcgccgtggaccgaagaccttacctccgacgacttcgtagtacgtgacggcgggtcgtacgggacgaacgggtcgacgagtcgnagcagtgcg

SEQ ID NO: 74595 - DNA, 666 bp, Homo sapiens
  misc_feature: GYAE6OF02H5QGW.35.19.B08.1.454.CMB.1.raw
  modified_base (228)..(228): a, c, t, g, unknown or other
  misc_feature (228)..(228): n is a, c, g, or t
  modified_base (312)..(312): a, c, t, g, unknown or other
  misc_feature (312)..(312): n is a, c, g, or t
  modified_base (664)..(664): a, c, t, g, unknown or other
  misc_feature (664)..(664): n is a, c, g, or t
tcagtacagatcgtcacgaccggtgctcgatttagtgagtcagtaaggggctggaaatgaagaagcctggggcctcagtgaaggtctcctgcaagacttctggatacaccttcaccgaatactttatacactgggtgcgacaggcccctggacaaggtttgagtggctggggcggatcagccctaacagtggtgccacacgtcctctgcacagaaatttcaggcggtnaccatgacagggacacgtcagcaacacaaccgtataatggaaggtgaagtgggactgagatctgacgacacggcgtatattacncgtgtgcgagatatgactactgggcaggaccctggtcacggtactcctcacgcctaccaccgaacgggcccaagtccgggtccctttacccccgtgggacccgtccccgtacggccctacccgaagggacgccgaacccgttcccgggaaggtacgccaaccgtacggcccgggtaccccgttcggggccgttccgggacccggttacggggtaccgtaaacggggtacccttaacccggtttacccgtaaaccggacttaccgtaccggttaaccgtcgggtaaccgggtcccgggggtccgttacgggaccgtaaacgggtcccgaccgtacgtacggctacgcgtactncg

SEQ ID NO: 74596 - DNA, 542 bp, Homo sapiens
  misc_feature: GYAE6OF02GPTSN.35.19.B08.1.454.CMB.1.raw
  modified_base (494)..(494): a, c, t, g, unknown or other
  misc_feature (494)..(494): n is a, c, g, or t
  modified_base (539)..(542): a, c, t, g, unknown or other
  misc_feature (539)..(542): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgagggccgggtcaccatgaccagggacacgtccagcaacacaacctatatggaggtgaatggactggagatctgacgacacggccgtatattactgtgtgcgagatattgactacgtgggccagggacctggtaccaccgtctcctcacgcctaccaccacgggcccagtccggtccttccccgtcggccgccctgcctccgacggacgccaccgtccgagacgcaccgacgccggcccgtgggcctcgccgtgtacgacgtacctactccacgtntctgtacgtgacggcggtcgtggacgaacgggcgacgagtgagcnnnn

SEQ ID NO: 74597 - DNA, 921 bp, Homo sapiens
  misc_feature: GYAE6OF02HYY64.35.19.B08.1.454.CMB.1.raw
  modified_base (913)..(913): a, c, t, g, unknown or other
  misc_feature (913)..(913): n is a, c, g, or t
  modified_base (920)..(920): a, c, t, g, unknown or other
  misc_feature (920)..(920): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggtactacgacgtaccctaacgtaggtggtcgaccaactaccttcttcgtcgaccaacgaaagttaactttacgggaccgggggtccggtacaaccgtagtacggaaccggaacgggaccgtaccgtacgacgaaccaaaccaacctaaaccttaagttaaggtagggtaaggtagtaaggtacggtacgtaaggaagtacgttcgtacggaaccgaacggtacccgggttaccttaagtttaacgtttacgtggttcggtacggaacggtaacgttaagtttacgttaacgtaaccgttaccggggtaccggggtaccggaaaccgggtacccggttcgggtacccgtacccgttcccttaccgtaccgaccgtcccctaacccgaaacccgggtaacccgggtaccccttaaccggtttccccggtttacccccgtttacccccggtccgggtcccccgtccccgttaccggtccccgttaccgggaccggtaccgtaacccccgtaccccggtaccggtaacggaaccgacccggtaaccgtacccggggacccccggtccccggggtccgggtacccgtccgggtacccgggttacgggtaaccggtaacccggtaacccgtttaccctacccggtaaccgttacttaccggttacgttaccggtagggtccgggtaccggggtcggtacccgggaaacggtaaccggggaccgtaaccgtacggtacgctacgngtacgcng

SEQ ID NO: 74598 - DNA, 516 bp, Homo sapiens
  misc_feature: GYAE6OF02JE91K.35.19.B08.1.454.CMB.1.raw
  modified_base (397)..(397): a, c, t, g, unknown or other
  misc_feature (397)..(397): n is a, c, g, or t
  modified_base (402)..(402): a, c, t, g, unknown or other
  misc_feature (402)..(402): n is a, c, g, or t
  modified_base (417)..(417): a, c, t, g, unknown or other
  misc_feature (417)..(417): n is a, c, g, or t
  modified_base (480)..(480): a, c, t, g, unknown or other
  misc_feature (480)..(480): n is a, c, g, or t
  modified_base (510)..(511): a, c, t, g, unknown or other
  misc_feature (510)..(511): n is a, c, g, or t
  modified_base (514)..(516): a, c, t, g, unknown or other
  misc_feature (514)..(516): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggagtgaatggactgagatctgacgacacggccgtatattactgtgtgcgagatattgactacgtggggccagggaaccctggtcaccgtctcctcagcctccaccaagggcccatccggtccttccccnggccnccctgcctccaggcncaccctccgagagcacagccggcctgggctcgcctgtcaggactacttccacgactctgtacngagcgggtctcggcgaacggcgacgatggnncgnnn

SEQ ID NO: 74599 - DNA, 500 bp, Homo sapiens
  misc_feature: GYAE6OF02G2JUK.35.19.B08.1.454.CMB.1.raw
  modified_base (489)..(489): a, c, t, g, unknown or other
  misc_feature (489)..(489): n is a, c, g, or t
  modified_base (495)..(500): a, c, t, g, unknown or other
  misc_feature (495)..(500): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactactggggccagggaaccctggtcaccgtctctcagcctcaccaaggcccatcgtcttcccctgcgccctgctccaggagcacctccgagacgcacagcggccctgggctgcctggtcaaggactacttccacgatctgtactgagcgggctggcaaggcncatagnnnnnn

SEQ ID NO: 74600 - DNA, 526 bp, Homo sapiens
  misc_feature: GYAE6OF02GIA9K.35.19.B08.1.454.CMB.1.raw
  modified_base (521)..(526): a, c, t, g, unknown or other
  misc_feature (521)..(526): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactactggggccaggggaaccctggtcaccgtctcctcagcctccaccaagggcccagtccggtcttccccctggccgccctgcctccaggacgcaccctccgagacgcacgacgccggcccgtgggctcgcctggtccaaggcctacgttcccacgtactctcgtactgagcgggctggcgaaggcgacgatagnnnnnn

SEQ ID NO: 74601 - DNA, 700 bp, Homo sapiens
  misc_feature: GYAE6OF02H0MFC.35.19.B08.1.454.CMB.1.raw
  modified_base (328)..(328): a, c, t, g, unknown or other
  misc_feature (328)..(328): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgagggccggtcaccatgaccagggacacgtcagcaacacaactatagtggagtgatggactgagatctgacgacacggtccttatattactgtgacgtaaagttacgaanaggtggcgtggcacggaggtcggatagtgactacggtcggggaccaaggggtaacccctgggtacccaccggtccccttccgtacgaccgccctacccgaaccgaacgggacccctacggttcccggttcccttcccccgtggtacccctacccgtccctaaccgaaccgtacggaccctaacccgttcgggtaccgggggacctaaccggaccgggtacccgggtccccggttcggggcccgttccgggcccggttacgggtaaccgaaacggttacccgttaccttacccgaacggttaaccttccggttacggttaaccgtacgggacggtccggggtcgtacgggtaccgacggccggtacgtaacgg

SEQ ID NO: 74602 - DNA, 579 bp, Homo sapiens
  misc_feature: GYAE6OF02J2VUY.35.19.B08.1.454.CMB.1.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (531)..(531): a, c, t, g, unknown or other
  misc_feature (531)..(531): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (579)..(579): a, c, t, g, unknown or other
  misc_feature (579)..(579): n is a, c, g, or t
tcagtacagatcgtcacgaccggtgctcgatttagtgagtcagtaagggcgtgaaatgaagaagcctgggcctcagtgaaggtctcctgcaagacttctggatacaccttcaccgaatactttatacactggtgcgacaggcccctggacaagggtttgagtggtctggggcggatcgagccctaacagtggtgccacgactctctgcacagaaatttcgagggccggttacaccgatcgaccagggacacgtccagcaacacacctatanggagtgaatggactgagatcnggacacgacggccgtatatactgtagtcgcgagtatattcgactacgtcggggcacgggaccctgggtccaccgtctcctgacgcctcgaccaacgggcccagtccggtcttcccccgacggccgccctcgcctccgacggacgacccacctccgacgactccacgacgtcccggccgtcggccgtacgcctacggaccgacggacttacccgttaccaccgtactcctaggttaccgngacggtccgggcttcggacgtaccggcgaccgagtacggnacgnctgn

SEQ ID NO: 74603 - DNA, 608 bp, Homo sapiens
  misc_feature: GYAE6OF02GNNXO.35.19.B08.1.454.CMB.1.raw
  modified_base (596)..(596): a, c, t, g, unknown or other
  misc_feature (596)..(596): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatagttgactacgtggggccaggggaaccctgggtcaccgtctccgtcacgcctccaaccgaacgggccctagtccggtccttcccccgtggcccgcccctgcccgtccgaggacgccgacccgtcccgagacgccacgacgccggccctggggcctcggccctgggtaccgaacgggtaccttaccgttacccaacggtacttccgtacgttaccgtcggaacggtccggggtccgttacgggaccggtaaacgggcccgtacgtacgttacggngacagtcncgng

SEQ ID NO: 74604 - DNA, 580 bp, Homo sapiens
  misc_feature: GYAE6OF02IR26G.35.19.B08.1.454.CMB.1.raw
  modified_base (310)..(310): a, c, t, g, unknown or other
  misc_feature (310)..(310): n is a, c, g, or t
  modified_base (398)..(398): a, c, t, g, unknown or other
  misc_feature (398)..(398): n is a, c, g, or t
  modified_base (420)..(420): a, c, t, g, unknown or other
  misc_feature (420)..(420): n is a, c, g, or t
  modified_base (570)..(570): a, c, t, g, unknown or other
  misc_feature (570)..(570): n is a, c, g, or t
  modified_base (575)..(575): a, c, t, g, unknown or other
  misc_feature (575)..(575): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggagtgaatggactgagatctgacgacacggccgtatattacgngtgtgcgagatattgactacgtggggaccagggaacctggtcaccgtctctcacgcctccaacacggcccagtccggtccttccccgnggccgccctgcctccgaggacncctaccgtccgagacgcacgacgccggcctagggcctacgcccgttacggtaccgaacggtacccttaccgttcccgaacggttactccgttagtaaccgtcgggacggtccgggtcgtacgggacgaacgggtccgacgtacgacggtnagacngtgcg

SEQ ID NO: 74605 - DNA, 596 bp, Homo sapiens
  misc_feature: GYAE6OF02JTAUV.35.19.B08.1.454.CMB.1.raw
  modified_base (186)..(186): a, c, t, g, unknown or other
  misc_feature (186)..(186): n is a, c, g, or t
  modified_base (593)..(595): a, c, t, g, unknown or other
  misc_feature (593)..(595): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcgatcagccctaanagtggtgccacactctctgcacagaaatttcagggccggtcaccgtgaccagggacacgtccagcaaacacaacctatatggaggtgaatggactgaagatctggacgacacggaccgtatattacgtgtgtgcgagatattgaactacgtggggaccagggaaccctcggtacaccgttctcctcacgtcctccaccgtacgggcccacgtccggtctttacccccgtggcccgcccgtcgccgttcccgacggacgaccgtacccgtccggacgtacgccacgacgccggcccgtgggcctcgtccgtcggtaccaacggtactaccgtttaccgaccgtatccgttcgttactggacgtcgggcgtaacgggccgtaacgggccgacgaagttcggacactgcnnnc

SEQ ID NO: 74606 - DNA, 570 bp, Homo sapiens
  misc_feature: GYAE6OF02F6IUW.35.19.B08.1.454.CMB.1.raw
  modified_base (562)..(562): a, c, t, g, unknown or other
  misc_feature (562)..(562): n is a, c, g, or t
  modified_base (566)..(566): a, c, t, g, unknown or other
  misc_feature (566)..(566): n is a, c, g, or t
  modified_base (568)..(570): a, c, t, g, unknown or other
  misc_feature (568)..(570): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtgggcagggacctggtcaccgtctcctcacgcctccaccgaacgggcccagtccggtcccttccccgtcggccgccctcgcctccgaggcgccacccgtccgacgacgccacgacggccgggcccgtcgggcctcggccgttcggtacgaacgggtaccttaccgttcccaacgtactcgtacgtacgtggtacggccgggacgtcgggacgaacggcgaccgagtacgngtcngnnn

SEQ ID NO: 74607 - DNA, 600 bp, Homo sapiens
  misc_feature: GYAE6OF02JK1T7.35.19.B08.1.454.CMB.1.raw
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (315)..(315): a, c, t, g, unknown or other
  misc_feature (315)..(315): n is a, c, g, or t
  modified_base (595)..(595): a, c, t, g, unknown or other
  misc_feature (595)..(595): n is a, c, g, or t
  modified_base (599)..(600): a, c, t, g, unknown or other
  misc_feature (599)..(600): n is a, c, g, or t
tcagtacagatcgtcacgaccggtgctcgatttagtgagtcagtaagggcgtgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacaccaactatatggaggtnaagtgactgacgatngacgacacggccgtatacttactgtgngacgagtatatttaggaccttaacggtcggggtaccgaacgggtaacccgtggtacccgtaccggtctccgtccaagccctaccaacccgaacgggccccaaggtttcccggtccctttccccccgtggtcccgtcccctcgccctcccgaacggacgtccaccgtaccgacgacgcgaccgacggccggcccgtcggccgtcgccgttcggtaccaacggtacctaccttccgacgatcgtcacgtgacggcggccgtgacgacggacgcacgtaggcngcann

SEQ ID NO: 74608 - DNA, 548 bp, Homo sapiens
  misc_feature: GYAE6OF02I8B1Q.35.19.B08.1.454.CMB.1.raw
  modified_base (534)..(534): a, c, t, g, unknown or other
  misc_feature (534)..(534): n is a, c, g, or t
  modified_base (542)..(545): a, c, t, g, unknown or other
  misc_feature (542)..(545): n is a, c, g, or t
  modified_base (547)..(548): a, c, t, g, unknown or other
  misc_feature (547)..(548): n is a, c, g, or t
tcagtacagatcgtcacgaccggtgctcgatttagtgagtcagtaagggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtcaccgtctcctcacgcctccaccgaacgggcccagtccggtccttcccccgtggccgccctgcctccgaggacgccacctccgagacgcaacgacgccggcccgtcgggcctcgccgtcggtacaacggtctacttccgaacgacttctacgtactgaggcgggtcgtaggcctaagggccgngagtacgnnnngnn

SEQ ID NO: 74609 - DNA, 668 bp, Homo sapiens
  misc_feature: GYAE6OF02J2VQP.35.19.B08.1.454.CMB.1.raw
  modified_base (135)..(135): a, c, t, g, unknown or other
  misc_feature (135)..(135): n is a, c, g, or t
  modified_base (552)..(552): a, c, t, g, unknown or other
  misc_feature (552)..(552): n is a, c, g, or t
  modified_base (633)..(633): a, c, t, g, unknown or other
  misc_feature (633)..(633): n is a, c, g, or t
  modified_base (658)..(658): a, c, t, g, unknown or other
  misc_feature (658)..(658): n is a, c, g, or t
  modified_base (662)..(663): a, c, t, g, unknown or other
  misc_feature (662)..(663): n is a, c, g, or t
  modified_base (666)..(667): a, c, t, g, unknown or other
  misc_feature (666)..(667): n is a, c, g, or t
tcagtacagatcgtcacgaccggtgctcgatttagtgagtcagtaagggctgaaatgaagaagcctggggcctcagtgaaggtctcctgcaagacttctggatacaccttcaccgaatactttatacactgggtncgacaggcccctggactaagggtttgagtggcgtggggcggatcagccctaacgagtggtcgccacactcgtctgcacagtaaatttcgacgggcggtcaccatcgacacgggacacgtccagcaacacaacctatagtggagtgaatcggactgagtatctacggactacgacggacctaatacttacgtggttagtcggacggtagtaagttacgttaggaccgttaacggtcgggggacccgtaacgggggtaaccccttcggggttaccaaccccgttcgttaccctcgaccggtaccctaccgaacccggtaccgggtacccctacggtttcccggtcccctttcccccgggcggccccggtccccttaggcccgtaccctacgggacctcccgtacccgccgtaaggaccnccgaaccgtcggtcccggccgttggggccttacggtccgtcgtaccgaacggtcttaccgtaccgacgtctacgtgtaccngtagtcgggctcgcgacgcgcgtanacgnnacnna

SEQ ID NO: 74610 - DNA, 710 bp, Homo sapiens
  misc_feature: GYAE6OF02I1VF7.35.19.B08.1.454.CMB.1.raw
  modified_base (697)..(697): a, c, t, g, unknown or other
  misc_feature (697)..(697): n is a, c, g, or t
  modified_base (703)..(703): a, c, t, g, unknown or other
  misc_feature (703)..(703): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcgatcagccctaacagtggtgccacactctctgcaacaagaaatttcgaacgggccggtcaaccatcgaacccgtaggggaccacggtccaagccaaacgaccaaaccgttaatacgtaggacggtagaaatgggaactggaacgatcgtagaacgtacgaccggtacgtaatattaacgtggtcgtgacgtacgattacgttgacttaacggtcgggacctacggggaacccttgggactaccgtcctaccgtcaacggcccctaccgaaccgtaacgggcccttaagtcccgggttacccttaccccgtccggtacccgtcccgtacggtcccgttaccgaacggtaccgtaccgtaaccctacccggacgaacgtaccgaccgtaacggcccggacccggtcggtccgtacggccgtacggtaccgtaacgtacctaccttaccgtaacgtaccgttacgtacgtaacgtacggtacggtacgggtcggtacggtacgaacggtaccgtacgacgttaacgnaccgtnactgacg

SEQ ID NO: 74611 - DNA, 607 bp, Homo sapiens
  misc_feature: GYAE6OF02GWU0V.35.19.B08.1.454.CMB.1.raw
  modified_base (604)..(605): a, c, t, g, unknown or other
  misc_feature (604)..(605): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggagtgaatggactgagatctgacacgacggcctatattactgtgtgcgagatatgactacgtcggggccacgggaccctgggtccaccgtctcctcgacgccctaccaaccgaacgggcccagttccggtcccttcccccgtggcccgtcccgtgccctaccgaggcgccgacccgtccgagacgccacgacgcccgcccgtgggcctcggccgttacggacgtaacggtaccttaccgttcccgaacgtacgttacgtaccgttaacgtggaccgggtaccgggtcggtacgggaccggaaccgggtcccgtacgtaacgttacggctagcgtanncg

SEQ ID NO: 74612 - DNA, 654 bp, Homo sapiens
  misc_feature: GYAE6OF02IFILU.35.19.B08.1.454.CMB.1.raw
  modified_base (645)..(645): a, c, t, g, unknown or other
  misc_feature (645)..(645): n is a, c, g, or t
  modified_base (649)..(649): a, c, t, g, unknown or other
  misc_feature (649)..(649): n is a, c, g, or t
  modified_base (652)..(653): a, c, t, g, unknown or other
  misc_feature (652)..(653): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgacagggacacgtccagcaacacaactatatggagtgaatggactgagatcgtgacgacacggtcctataattactgtatggacgtaagattagttcgaacgtacgtaggggcccgtaaaggggaaccccttggtaccgtaacccggttctccctacgaacgtcccctaccgaacccaaacggggcccctaacgtccgggtttcccctttacccccgtcggtcccgtccccgtcgtcccgtcccgacggaccgtccgacccgtccgacgacgaccgaacacggacggacccgtcgggcctcggcccgttaggtacccgaaacggtaacctaccttaccgaaccgtacgtaccgttacgtaccgtaggacggtccgggaccgtaggccggaacgggcccgtagacgtaacggngtcngcnnc

SEQ ID NO: 74613 - DNA, 550 bp, Homo sapiens
  misc_feature: GYAE6OF02HCFRK.35.19.B08.1.454.CMB.1.raw
  modified_base (542)..(542): a, c, t, g, unknown or other
  misc_feature (542)..(542): n is a, c, g, or t
  modified_base (545)..(546): a, c, t, g, unknown or other
  misc_feature (545)..(546): n is a, c, g, or t
  modified_base (548)..(549): a, c, t, g, unknown or other
  misc_feature (548)..(549): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccggtcaccatgaccagggacacgtccagcaacacaacctatatggaggtgaatggactgagatctgacgacacggccgtatattactgtgtgcgagatattgactacgtggggccagggaaccctggtcaccgtctcctcacgcctcaccgaacgggcccagtccggtcttcccccgtggccgccctgcctccgacggacgcacctcccgagacgaccacacgcggccctggggcctcgccgtcggtacaacgggacctaccgttccgaacgtactacgtgtactcggacgcgggcctggacgaaggccgacacgtagnacnncnnc

SEQ ID NO: 74614 - DNA, 599 bp, Homo sapiens
  misc_feature: GYAE6OF02HD8I0.35.19.B08.1.454.CMB.1.raw
  modified_base (588)..(588): a, c, t, g, unknown or other
  misc_feature (588)..(588): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgagggccgggtcaccatgaccaggggacacgtccagcaacacaacctatatggaggtgaatggactgagatctgacgacacggccgtatattactgtgtgcgagatatgactacgtggggaccacggggaaccctggtccaccgtctcctcacgcctccaccgaacgggcccagtccgtccttccccgtggccgccctgcctccgaggcgccacccgtcgagacgcacgcggcccggcccgtgggccgtcgccgttacgggtaccgaaacggtaccttaaccgttcccgacggtaacttccgtacgttaccgtcggtagggtccggggtaccgttcgggacgaacgggtcccggtacgaacggttacggngagcgtagngn

SEQ ID NO: 74615 - DNA, 604 bp, Homo sapiens
  misc_feature: GYAE6OF02JFS2B.35.19.B08.1.454.CMB.1.raw
  modified_base (595)..(595): a, c, t, g, unknown or other
  misc_feature (595)..(595): n is a, c, g, or t
  modified_base (598)..(599): a, c, t, g, unknown or other
  misc_feature (598)..(599): n is a, c, g, or t
  modified_base (601)..(602): a, c, t, g, unknown or other
  misc_feature (601)..(602): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactggtgtgcgagtatattgactacgtggggccagggaccctggcaccgtctcctcacgcctaccaccgaacgggcccctagtccggtccttcccccgtcggcccgtccctcgcctcccgagggacgccacccgtccgacgacgccacgacggccggccccgtcgggccttcggcccgttcgggtaccgaaacggtacccttaccgttacccgacgtaacgttccgttacgttaccgtacggacggccggggtaccgtcgggacggtaacgggccgtacgagtacgngtnntnncg

SEQ ID NO: 74616 - DNA, 606 bp, Homo sapiens
  misc_feature: GYAE6OF02I84NZ.35.19.B08.1.454.CMB.1.raw
  modified_base (286)..(286): a, c, t, g, unknown or other
  misc_feature (286)..(286): n is a, c, g, or t
  modified_base (555)..(555): a, c, t, g, unknown or other
  misc_feature (555)..(555): n is a, c, g, or t
  modified_base (597)..(597): a, c, t, g, unknown or other
  misc_feature (597)..(597): n is a, c, g, or t
  modified_base (600)..(600): a, c, t, g, unknown or other
  misc_feature (600)..(600): n is a, c, g, or t
  modified_base (602)..(603): a, c, t, g, unknown or other
  misc_feature (602)..(603): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagtaaatttcagggccggtcaccatgaccagggacacgtccagcaacacaacctatatggaggtgaatggactgagntctgacgacacggcctatattactgtgtgacgagtattatgactacggtgggccacgggaaccctggtccaccgtctccgtacagccctaccaccgaacgggcccctagttcccggtccttccccgtcggcccgtccccgtcgccgtaccgaggaccgaccgtacccgtccgacgacgaccaccgacggcccggcccgtcgggccgtcggtccgttacggtaccgtaaacgggtaccttaccgtaccgtacgtacttcgtacggttacngggacggccggggcgtcggaccgaacgggccgactagtcggncgngnnacg

SEQ ID NO: 74617 - DNA, 600 bp, Homo sapiens
  misc_feature: GYAE6OF02FUUWV.35.19.B08.1.454.CMB.1.raw
  modified_base (401)..(401): a, c, t, g, unknown or other
  misc_feature (401)..(401): n is a, c, g, or t
  modified_base (599)..(599): a, c, t, g, unknown or other
  misc_feature (599)..(599): n is a, c, g, or t
tcagtacagatcgtcacgaccggtgctcgatttagtgagtcagtaaggggctgaaatgaagaagcctgggtcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtgggccagggaaccctggtcaccgtctcctcacgcctccaccaagggccccagtccggtccttccccgnggccgccctgcctccgaggacgccacccgtccgacgcgcacgacgccggaccctcggggacctcggcccgttagggtccgaaacggtaccgttacctttacccgacggtaacttccgtagttaccgttcggacggccggggtccttaggggacccgtaaggggcccggaacgttacgtaacggtacgacgcgagtcgng

SEQ ID NO: 74618 - DNA, 582 bp, Homo sapiens
  misc_feature: GYAE6OF02H1MAD.35.19.B08.1.454.CMB.1.raw
  modified_base (319)..(319): a, c, t, g, unknown or other
  misc_feature (319)..(319): n is a, c, g, or t
  modified_base (575)..(575): a, c, t, g, unknown or other
  misc_feature (575)..(575): n is a, c, g, or t
  modified_base (578)..(578): a, c, t, g, unknown or other
  misc_feature (578)..(578): n is a, c, g, or t
  modified_base (580)..(581): a, c, t, g, unknown or other
  misc_feature (580)..(581): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggatcagccctaacagtggtgccacactctctgcacagaaatttcagggccgggtcaccatgaccaggacacgtcagcaacacaacctatatggaggtgaatggactgagatctgacgacacggccgtatattactgtgtgcganatattgactagtggggaccagggaaccctggtcaccgtctcctcagccctcaccgaacgggccccaagtccggtcccttcccccgtggcccgcccgtcgcctcccgagggcgcccacccgtccgaagacgccacgacggccggcccgtgggccttcgcccgttggtaccgaacgggaccttaccgttacccgaacgtactcgttacgtaccgtggaccggtccggggtcgtcgggactaacgggccgacacgtggncgntnnc

SEQ ID NO: 74619 - DNA, 598 bp, Homo sapiens
  misc_feature: GYAE6OF02G2HF9.35.19.B08.1.454.CMB.1.raw
  modified_base (589)..(589): a, c, t, g, unknown or other
  misc_feature (589)..(589): n is a, c, g, or t
  modified_base (596)..(596): a, c, t, g, unknown or other
  misc_feature (596)..(596): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggaccagggaaccctggtccaccgtctcctcacgccctccaccaacgggcccacgtccggtcctttcccccgtcgggccgcccctgccctccgaacggcgccacccgtcccggaagagcacgacgccggcccgtgggcctcggcccgttcgggtaccgaacgggtaccttaccgttacccgaacgtacttccgtagtacctggaacggtccggggtcgttcgggaccgaacgggaccgccggtaagtacggtcgancgtacancg

SEQ ID NO: 74620 - DNA, 620 bp, Homo sapiens
  misc_feature: GYAE6OF02FOR1Y.35.19.B08.1.454.CMB.1.raw
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
  modified_base (619)..(620): a, c, t, g, unknown or other
  misc_feature (619)..(620): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgagggccgggtcaccatcgaccagggacacgtccagcaacacaacctatatggagtgaatggactgagatctgacgacacggccgtatattactgtgtgacgagatattgactacgtcggggaccacgggtaaccctgggtccaccgtcctcctacacgtccctaccgaaccgaacgggccccagttcccggtcccttcccccgtcggtcccgccctcgcctaccgacggcgacccgacccgtccgacggacgccgaacgacgggcccggtcccggtcgggccgtcggtcccgttagggtaccgaaacgggtaccttaccgttacccgaacgtacttccgtcgttacgtcggtacggccggggtcgttcgggaccgaacgggccgacgtagtcgcncgncnn

SEQ ID NO: 74621 - DNA, 592 bp, Homo sapiens
  misc_feature: GYAE6OF02G7360.35.19.B08.1.454.CMB.1.raw
  modified_base (583)..(583): a, c, t, g, unknown or other
  misc_feature (583)..(583): n is a, c, g, or t
  modified_base (587)..(587): a, c, t, g, unknown or other
  misc_feature (587)..(587): n is a, c, g, or t
  modified_base (590)..(592): a, c, t, g, unknown or other
  misc_feature (590)..(592): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggatcagccctaacagtggtgccacactctctgcacagaaatttcgagggccgggtcaccatgaccagggacacgtccagcaacacaacctatatggaggtgaatggactgagatctgacgacacggccgtatattactgtgtgcgagtatattgactacggtgggccacgggaaccctggccaccgtctcctcacgtcctccaccgaacgggcccagtccgtccttccccgcggcctccctcgcctcccgacggtacgccgtaccgtaccgacgtacgaccgaacgacggcccgggacccgtcgggccgttcgtcccggttaggtaccgaacggtaccttaccgttccgaacgtactcgtacgtacgtcggacggtcggtcgtacggacgtaacgggcacgagtacgngtancgnnn

SEQ ID NO: 74622 - DNA, 616 bp, Homo sapiens
  misc_feature: GYAE6OF02HLZR6.35.19.B08.1.454.CMB.1.raw
  modified_base (315)..(315): a, c, t, g, unknown or other
  misc_feature (315)..(315): n is a, c, g, or t
  modified_base (611)..(611): a, c, t, g, unknown or other
  misc_feature (611)..(611): n is a, c, g, or t
  modified_base (613)..(616): a, c, t, g, unknown or other
  misc_feature (613)..(616): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaaatttcgagggccgggtcaccatgaccgagggacacgtccagcaacacaacctatatggaggtgaatggactgagatctgaccgacacggccgtatattacnggtgtgcgagtatagttgactacgtcggggaccacggggaaccctggtaccaccggttcctcctcacgccctaccaaccgaacgggcccctagttccggttcccttcccccgtacgggtccccgcccgttcggccctccgtacggacgccctacccgtaccgagacgaccgaccacgggcccggcccgtcgggtcccttggcccgttacgggtaccgaaacgggtccttaccgttaccgacgtactccgttcgtacgtggacggacgggtcgtcgggacgacggccgcacgtagcngnnnn

SEQ ID NO: 74623 - DNA, 579 bp, Homo sapiens
  misc_feature: GYAE6OF02FX8TQ.35.19.B08.1.454.CMB.1.raw
  modified_base (571)..(571): a, c, t, g, unknown or other
  misc_feature (571)..(571): n is a, c, g, or t
  modified_base (576)..(577): a, c, t, g, unknown or other
  misc_feature (576)..(577): n is a, c, g, or t
  modified_base (579)..(579): a, c, t, g, unknown or other
  misc_feature (579)..(579): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacgggccgtatattactgtgtgcgagatattgactacgtgggccagggaaccctggtccaccgtctcctcagtccctccacgaacgggcccagtcccggtccttcccccgtggcccgccctcgcctccgaggacgccacccgtccgacgacgcacgcgccggcccgtgggcctcgccgtcgggtaccgaacgggtacctaccttcccgacgtacttccgtgttaccgtggacggtccggggtcgtcgggaccgtaacgggccgtaccgagttacgnacganngn

SEQ ID NO: 74624 - DNA, 565 bp, Homo sapiens
  misc_feature: GYAE6OF02G2PZW.35.19.B08.1.454.CMB.1.raw
  modified_base (277)..(277): a, c, t, g, unknown or other
  misc_feature (277)..(277): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (517)..(517): a, c, t, g, unknown or other
  misc_feature (517)..(517): n is a, c, g, or t
  modified_base (558)..(558): a, c, t, g, unknown or other
  misc_feature (558)..(558): n is a, c, g, or t
  modified_base (564)..(564): a, c, t, g, unknown or other
  misc_feature (564)..(564): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctgggggcggatcagccctaacagtggtgccacactctctgcacagtaaatttcgagggccggtcaccatcgaccagggacacgtccagcaacacaacctatatggaggtnaagtggactgagatctagacgtacgacggtcgtattattactgtgtcggcgagtatattagactacgtggggccagggtaaccgtgtaccncgtctcctcncncctccaccgacggcccatccggtccttccccgtggcctcccgtgacctccgaggtcgaccctaccgtcgagacgcacgagcccgtcgacggcctcgaccgtggacgaacgtcctacgtaccacgtctacctgttacngggcggtccgggctaacgggcaaccgggcgagtacgtggcntgactng

SEQ ID NO: 74625 - DNA, 773 bp, Homo sapiens
  misc_feature: GYAE6OF02JA7IR.35.19.B08.1.454.CMB.1.raw
  modified_base (183)..(183): a, c, t, g, unknown or other
  misc_feature (183)..(183): n is a, c, g, or t
  modified_base (768)..(768): a, c, t, g, unknown or other
  misc_feature (768)..(768): n is a, c, g, or t
tcagtacagatcgtcacgaccggtgctcgatttagtgagtcagtaagggctgaaatgaagaagcctggggcctcagtgaaggtctcctgcaagacttctggatacaccttcaccgaatactttatacactgggtgcgacaggccctggacaaggtttgagtggctggggcgatcagccctaanagtggtgccacactctctgcacagaaactttcgagggccggtcaccatcgaccgagggaccacgtccagacaacactaaccgtataacgtggtaggtagaaattcgggaaccttggacgtactacgtgacgacgaccggccgttaattactaacctgtacgtgacgtagtagttacttacggacttaacggtcggggaccgacggggtaaacccttgggtaccctaccggtccgtccgtttacgaacggtcccttaaccgaaccggtaacgggttaccccgaacgtttacccgggtccccgttttacccccgacggggtcccgtaaccccggttggtaccccgttacccggtagggaaaccgtccctaaacccgggtcccggtaaacggtccgaccggtaaccgaaccgggtcccgggtcccggttccgggccgttacggacccggtttacggaccggttaaaccgggtacccttaaccggttacccgacggttacgtaccgtggttaaccgttcgggaacggtcccgggtcgtaacgggttacccgaacggtcggtaccgtaaacggtgtccgaccgtgtaccngtacg

SEQ ID NO: 74626 - DNA, 986 bp, Homo sapiens
  misc_feature: GYAE6OF02H1200.35.19.B08.1.454.CMB.1.raw
  modified_base (134)..(134): a, c, t, g, unknown or other
  misc_feature (134)..(134): n is a, c, g, or t
tcagtacagatcgtcacgaccggtgctcgatttagtgagtcagtaagggctgaaatgaagaagcctgggcctcagtgaaggtctcctgcaagacttctggatacaccttcaccgaatactttatacactgggtncgacacggcccctggaccgtaagggtttgagttggcgtgggggacggtatcgacggtaccctaacgaggtggtacgcctacgactctccgtagacaacgaacgaaatttcggaacggggccggtccaacctatggaaccgaaggggtaccaaccgtccgaacggacaaaacccgtaacgtaaacccttaagaacgtaggggtaaaggttagaaaaccgttgggaaaccttaggaacgtattaccgtagggaaacccgaacggtaacccgggtaccgttaaactttaacgttaaaccgttaggtcggtttaccggacggtaaacgttaagtttaacgttacggtaaaccttaacgggtaccgggggaaccggttaaacgggggaaaacccctttcgggggtaaccctaacccccggttcggttaccccgtacggtaaaacccgtcccccttaaccggaaaccccgaaccgggggtacccccttacggtacccggtttcccccgtttaccccccggtacggtcccccgttaccccggttccgtacccgtaccccggtaaaggtacccgggaccttaaccccggaccggttaaacgaccggaaccccggttaaaccggaccgggttacccccggtccgggtaccggggtcccgtttacccgggtacccggtttaccggggttaaaccctaaacggggtaaccccgtttaaacccgtttaccccggtaaccggttacgttaaacccgttcggtttaacccgacggggtttaacccggcggggttacccgttaacggggaccgtaaaccgggtacccggtaaccgtttaccggtaaggccacggtacctggactcgg

SEQ ID NO: 74627 - DNA, 667 bp, Homo sapiens
  misc_feature: GYAE6OF02JXVAJ.35.19.B08.1.454.CMB.1.raw
  modified_base (226)..(226): a, c, t, g, unknown or other
  misc_feature (226)..(226): n is a, c, g, or t
  modified_base (398)..(398): a, c, t, g, unknown or other
  misc_feature (398)..(398): n is a, c, g, or t
  modified_base (538)..(538): a, c, t, g, unknown or other
  misc_feature (538)..(538): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (665)..(666): a, c, t, g, unknown or other
  misc_feature (665)..(666): n is a, c, g, or t
tcagtacagatcgtcacgaccggtgctcgattttagtgagtcagtaagggctgaaatgtaaggttaagggcctggggacctcaggtggaacggtcctccgtgtcaaggacttctgggatacctaccgttcaaccgggaagttacgttttatacactgggtgtcggactacggccccgtggaccgaaggggtttgaggttgggcgtgggcggatcgagcccttaagngtggtgccacacgtcgtctggcacgagtaaagttttcgaagggccggttactacccgagtacgaccgagggtaccacggtccgacgcaacgacaaccgtatagaggaggtagaagtggactggagtactgagacgacgccggtcgtatagttacgtggtgcgagagaagttnttgacgtaggtcgggcctaacgggacctggtcctaccggtcttcctcgaccgccctaccgaccgtaacgccctacgttcccgttcccgtcccggtcgcccgtcccgctaccgcgacggcaccgacgtccgagacgcgacncggcccgcgcggtctcgtcgtaccgggtacgaaccggtacttaccgttaccgacgtaacgtccgttagtccgtcggaaggtccgggttcgacggacggtaacggccgtaacgtggaggtcngngngnng

SEQ ID NO: 74628 - DNA, 794 bp, Homo sapiens
  misc_feature: GYAE6OF02H452G.35.19.B08.1.454.CMB.1.raw
  modified_base (777)..(777): a, c, t, g, unknown or other
  misc_feature (777)..(777): n is a, c, g, or t
  modified_base (784)..(784): a, c, t, g, unknown or other
  misc_feature (784)..(784): n is a, c, g, or t
  modified_base (793)..(793): a, c, t, g, unknown or other
  misc_feature (793)..(793): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctggactaagggtttgagtggctggggcggatcagccctaacgagtggtgccacactctctgcacagtaatttcgagggccggtcaaccgagtcgaccgaggggacaccgtccagacaacacaacctatagtggaggtagaagtggactgaagtatcgtaggaaccgacgaccggtaccgttaattaacttacgaggtttgaggtcggaagttaattacgttacgtaaccgttacggtacgggggaccgtaacggggtaaaccccgttggggttacccaacccggtttccttacccgtacgtaaccggtccccttacccggaaaacccggtaaccggggtccccttaacggtttcccgggtttcccccgtttacccccggtcggggtaccccgtcccccgtttacgggtccccgtacccggtaacgggtaaccgtaccccgtaaccccggtacggtaaccggacggacccgtaacggacgggtaccccggtccgggtccgggtacgtccgggtacccggttacggtaaccgaaaccgggttacccttaccggttacccgaccggttacgttccgttaacgtaccgtacgggtacggtccgggtcgtacgggaccgaacgggtcgtaacgnggtacgngtcgatcgnc

SEQ ID NO: 74629 - DNA, 759 bp, Homo sapiens
  misc_feature: GYAE6OF02HDWMP.35.19.B08.1.454.CMB.1.raw
  modified_base (126)..(126): a, c, t, g, unknown or other
  misc_feature (126)..(126): n is a, c, g, or t
  modified_base (751)..(751): a, c, t, g, unknown or other
  misc_feature (751)..(751): n is a, c, g, or t
  modified_base (756)..(756): a, c, t, g, unknown or other
  misc_feature (756)..(756): n is a, c, g, or t
  modified_base (759)..(759): a, c, t, g, unknown or other
  misc_feature (759)..(759): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttanacacgtgggtgcgacaggcccctggacagggtttgagtggcgtggggcgatcagccctaacagtggtcgccacactctctgcacagtaacttcgagggcggtcaccatcgacgagggacacgtcagacaacacaacctatagtgggagtgaagtggactgagatcgtgaacgacgaccggtccgtattagttacgtggtgtagcgaagtattagttcgacgttacggcggggaccgtaacggggtaaccccgttgggttacccgacccgtttcctacccgtaccgtaaccgtccccgtacccgaaacccggtaaccggggacccccttaacggttcccccgggttttcccccgtttccccccggtaccgggtcccccgtccccgttaccggtccccggttacccggaacgggtaccgtacccgtaacccgtacccggaacggaccggtaccgaaccggtaccggccccgggtacccggttccgggtaccgtaccggtcccggttaccgggtaaccggtaaacggttacccgttaccgttaacccgtaacgttccgttacgttacgtacgtacgggtaccgggtccggggtaacggtcggaacgggtacggccgacgtacgtagcngtcgnacn

SEQ ID NO: 74630 - DNA, 652 bp, Homo sapiens
  misc_feature: GYAE6OF02H7IOV.35.19.B08.1.454.CMB.1.raw
  modified_base (73)..(73): a, c, t, g, unknown or other
  misc_feature (73)..(73): n is a, c, g, or t
  modified_base (158)..(158): a, c, t, g, unknown or other
  misc_feature (158)..(158): n is a, c, g, or t
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
  modified_base (261)..(261): a, c, t, g, unknown or other
  misc_feature (261)..(261): n is a, c, g, or t
  modified_base (543)..(543): a, c, t, g, unknown or other
  misc_feature (543)..(543): n is a, c, g, or t
  modified_base (639)..(639): a, c, t, g, unknown or other
  misc_feature (639)..(639): n is a, c, g, or t
  modified_base (644)..(644): a, c, t, g, unknown or other
  misc_feature (644)..(644): n is a, c, g, or t
  modified_base (650)..(650): a, c, t, g, unknown or other
  misc_feature (650)..(650): n is a, c, g, or t
tcagtacagatcgtcacgaccggtgctcgatttagtgagtcagtaagggctgaaatgaagaagcctgggcctnagtgaaggtctcctgcaagacttctggatacaccttcaccgaatactttatacactggtgcgacaggcccctggacaagggtttnagtggctggggcgatcagccctaangtggtgccanactctctgcacagaagtttcgagggtccggtccactatcgaccagggcncgtaccngcaacacacgtnatggagtgaatggactgagtatctagaccgtacgacggtcgtacttacgttacgtacgttggtcggactacggatttaagttcgtaacgtaccggtacggggacgtaaaccgggtacccttgggtaccacccggttccgccctagacccggtacctcccgaaaccggaacgggtcccctaagttcccggttaacccttccccgtaggccccgtccgtacgaccttcggacgtacgtcctaaccgtcgtagacctacgacgccggaccggtcgtcggtaccgnggtacccgtacggtacgtaaccgctaccgttacgccgtacgtactacgttcaggttcgacggtacggtcgaacgtaccggaggtacctaggtaccngacgnacggtncg

SEQ ID NO: 74631 - DNA, 714 bp, Homo sapiens
  misc_feature: GYAE6OF02GACIB.35.19.B08.1.454.CMB.1.raw
  modified_base (287)..(287): a, c, t, g, unknown or other
  misc_feature (287)..(287): n is a, c, g, or t
  modified_base (341)..(341): a, c, t, g, unknown or other
  misc_feature (341)..(341): n is a, c, g, or t
  modified_base (711)..(711): a, c, t, g, unknown or other
  misc_feature (711)..(711): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggactaagggtttgagtggctggggcggatcagccctaacagtggtgccacacttctctgcaacagaaactttcgagggcccggtcaccatcgaccgagggacacgtccagccaaacaccaacctatagtgggaggtanaagtcggactggagtatcctaggaaccgtacgacgggtccgtaattacttacgngttcgtagcgtagtattagtttcgaacgtttacggcggggacctaacgggggtacccttagggggttccaaccccggtttctaaccctccggactccccgtacccaaccgggaacccgggtacccctggttaccccgggttccctttacccccggtcggtccccgtcccgtcgtacccgtcgggtaccgacggtccgtacccgtaccggtacggtaaccgaccgacgacgggacccggtccgggtacggtccgtacggtccgtacgggtaccgaacggttacgtaccgttacaccggtactcgttacgtacgttacggacggtcgggtacggacggtacggtaccggacgtacgacgacggtcagcgacngtc

SEQ ID NO: 74632 - DNA, 760 bp, Homo sapiens
  misc_feature: GYAE6OF02J1YBD.35.19.B08.1.454.CMB.1.raw
  modified_base (207)..(207): a, c, t, g, unknown or other
  misc_feature (207)..(207): n is a, c, g, or t
  modified_base (273)..(273): a, c, t, g, unknown or other
  misc_feature (273)..(273): n is a, c, g, or t
  modified_base (747)..(747): a, c, t, g, unknown or other
  misc_feature (747)..(747): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggcgtggggtcggatcagccctaacaggtggtgccacacgtcnctgcacagtaaatttcgagggccggtacacctagtgaccagggcacgtccagcaacacaaccatanggagtgatggactgagatcgtagaccaacgcggtcgtatactttacgtaggtcgtagacggtaacgtagttaacgttaggaccgttacggggtcgggggaccccgttaaaccggggaaaccccggtttcgggtaacccgtaaccccggtttccgttacccgtacggtaccccgtcccgtaaccccgtaaaccgggtaaaccccggtcccgtaaccggttttccccgggttaccccctttccccggtccccggttcccgtccccgttccgaaccccgtacccgggtaccgggtacccggacctaccccgtaccggaaccggacccaacgaccggaaccggtcccgtccgggtccggccgttaccgttccggtaccgtacggtaaccgtacccgtaaccgttccgaacgtacgtcgtacgtccgtacggtacgtccgggtcgtccgggtaagaccggaccgtacgtaaggtccgtncgtcgtacgcgcg

SEQ ID NO: 74633 - DNA, 616 bp, Homo sapiens
  misc_feature: GYAE6OF02F5SB0.35.19.B08.1.454.CMB.1.raw
  modified_base (260)..(260): a, c, t, g, unknown or other
  misc_feature (260)..(260): n is a, c, g, or t
  modified_base (377)..(377): a, c, t, g, unknown or other
  misc_feature (377)..(377): n is a, c, g, or t
  modified_base (604)..(604): a, c, t, g, unknown or other
  misc_feature (604)..(604): n is a, c, g, or t
  modified_base (612)..(612): a, c, t, g, unknown or other
  misc_feature (612)..(612): n is a, c, g, or t
tcagtacagatcgtcacgaccggtgctcgatttagtgagtcagtaagggggctgaaatgaagaagcctggggcctcagtgaaggtctcctgcaagacttctggatacaccttcaccgaatactttatacactgggtgcgacaggcccctggacaagggtttgagtggctgggggcggatcagccctaaacagtggtgccaacactctctgcacagaaatttcagggccggtcaccatagaccagggacacgtccagcaanaccaactatatggagtgaatgactgagatctgacgacacggtccgtatattacgtgtgtgacgagattatagactacgtggggaccaacgggaaccctggtacctaaccgtcttccncgacgtccctacccaccgaaacgggcccctagtcccggtcctccccgtggccgtccctgcctaccgaggacgtcctaacccgtcggaacgtacggacctacgacggtcccggcccgtagggcctacggtacccgtgggtaccaaacgggtacttaaccgtaccgaacgtactcgtacgttacctgggacggtacgggtcgtagggaccaacggcgtacgagtacgtnaccgtagntgac

SEQ ID NO: 74634 - DNA, 590 bp, Homo sapiens
  misc_feature: GYAE6OF02G86FX.35.19.B08.1.454.CMB.1.raw
  modified_base (208)..(208): a, c, t, g, unknown or other
  misc_feature (208)..(208): n is a, c, g, or t
  modified_base (306)..(306): a, c, t, g, unknown or other
  misc_feature (306)..(306): n is a, c, g, or t
  modified_base (383)..(383): a, c, t, g, unknown or other
  misc_feature (383)..(383): n is a, c, g, or t
  modified_base (461)..(461): a, c, t, g, unknown or other
  misc_feature (461)..(461): n is a, c, g, or t
  modified_base (477)..(477): a, c, t, g, unknown or other
  misc_feature (477)..(477): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
tcagtacagatcgtcacgaccggtgctcgatttagtgagtcagtaagggggcgtgaaatgaagaagcctggggcctcagtgaaggtctcctgcaagacttctggatacaccttcaccgaatactttatacactgggtgcgacaggcccctggacaagggtttgagtggcgtggggcggatcagccctaacaggtggtgccacgactcncgtgcacagaaatttcgagggccgggtcaccatcgaccgagggaccacgtccgagaccaacacaacctatacgtgggacgtagaagtcggactggagntcaggacacgacggtccgtaatacgttactggtgtgacgagtatatgactacggtcgggaccagggaaccctggccnccgtctcctacgcgtcctccaaccgtacggcccagtccgtcccttccccggtggacccgtccctcgtcctcgacgacnccgtcctccggaggcncgacggacgcccggccgtggcngtccggngtaccgaaggtcctacgtacccgagtcgtcgtagtcgagtcgggccggtcgtggaccggaggcctaggcgtagcnacncgtacg

SEQ ID NO: 74635 - DNA, 708 bp, Homo sapiens
  misc_feature: GYAE6OF02J0CNX.35.19.B08.1.454.CMB.1.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
  modified_base (280)..(280): a, c, t, g, unknown or other
  misc_feature (280)..(280): n is a, c, g, or t
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
  modified_base (405)..(405): a, c, t, g, unknown or other
  misc_feature (405)..(405): n is a, c, g, or t
  modified_base (699)..(699): a, c, t, g, unknown or other
  misc_feature (699)..(699): n is a, c, g, or t
  modified_base (704)..(704): a, c, t, g, unknown or other
  misc_feature (704)..(704): n is a, c, g, or t
  modified_base (708)..(708): a, c, t, g, unknown or other
  misc_feature (708)..(708): n is a, c, g, or t
tcagtacagatcgtcacgaccggtgctcgatttagtgagtcagtaaggggctgaaatgaagaagcctgggcctcagtgaaggtctcctgcaagacttctggatacaccttcaccgaatactttatacactgggtgcgacacggcccctggacaagggtttgagtggctggggcggatcagccctaanaggtcggtgccacactctctgcanagtaatttcgagggtccgtcacntacgaacagggacncggtccagaccaacncaactagagtggaggtnaatcggatgagatcgnggaccacacggtcctatacgttacnggtagtacgacgagtagttatacggtaaccgtcggtacgggaccgtaacgggaccgttcggtaacctaccgttctacccggtanaccggtacctacccgaaccggtaccgacccgtttaacggtcccggttccccgttccccggtcggtacccgttacccgtaccgttacccgtacggtaaccggaccgtacccgtaacccgtccgggaacggacggtaccgacggacccgggccgggttaccctccggggtcttaccgggccggttacggtaaccggtaacgttaccgttaccgttaccgtaccgtacgtacgttaccgtcgtaccggacgggtccggtaactcgggtaccgtaacggtccggtatacgggtacgcngtacncgan

SEQ ID NO: 74636 - DNA, 643 bp, Homo sapiens
  misc_feature: GYAE6OF02JZ0U0.35.19.B08.1.454.CMB.1.raw
  modified_base (137)..(137): a, c, t, g, unknown or other
  misc_feature (137)..(137): n is a, c, g, or t
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
  modified_base (284)..(284): a, c, t, g, unknown or other
  misc_feature (284)..(284): n is a, c, g, or t
  modified_base (337)..(337): a, c, t, g, unknown or other
  misc_feature (337)..(337): n is a, c, g, or t
  modified_base (354)..(354): a, c, t, g, unknown or other
  misc_feature (354)..(354): n is a, c, g, or t
  modified_base (634)..(634): a, c, t, g, unknown or other
  misc_feature (634)..(634): n is a, c, g, or t
  modified_base (639)..(639): a, c, t, g, unknown or other
  misc_feature (639)..(639): n is a, c, g, or t
  modified_base (642)..(642): a, c, t, g, unknown or other
  misc_feature (642)..(642): n is a, c, g, or t
tcagtacagatcgtcacgaccggtgctcgatttagtgagtcagtaagggcgtgaaatgaagaagcctggggcctcagtgaaggtctcctcgcaagacttctggatacaccttcaccgatactttatacactcgggtncgacaggtccccgtggactaagggttttgacgtggctggggcggatcagcctaacnggtcggtgccagactctctgccanagtaattcgagggccggtacaccagtcgaccgaaggggactacgccagccaacaccgaacctatagnggacgtgaatcggactgagtatcgtaggaactacgacggtaccgtatacttancggttggcgacggaatntaattggaactaggtcgggaccaacggggtaaccctgggtaccctaccggttctcccgtactacggtcctaccgtacccgaaacgggtcccacgttccgggtcccttccccggtccgaccgtcccgtacgtccgtacgtacgtacgccgacgtccgaacgtacgacgacgacgcccggtccgtcgcgtcgtccgtcggtacgtaacgtacgtaccgttaccgactacgtacgtcgtacgcgcggtccgtcgtacgggtcaacggtccgtagacgtacggngctcnctnc

SEQ ID NO: 74637 - DNA, 569 bp, Homo sapiens
  misc_feature: GYAE6OF02GMB0Z.35.19.B08.1.454.CMB.1.raw
  modified_base (290)..(290): a, c, t, g, unknown or other
  misc_feature (290)..(290): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcgagggccgggtcaccatgaccgagggacacgtccagcaacacaacctatagtggaggtgaagtggactgagntctgacgacacggcgtatattacgtggtgtgcgtagattacgttgactacgtgggccaacgggacctggtccaccgtctccgtcacgccctaccaaccgacggccctagtccggtccctccccgtcgccgccctcgcctccgaggcgccaccgtcgacgcgccacgacggcgcccgtcggctcgtccgtcgtacgacgtcctaccttccgaacgtctcgtacgtcgtggacggtcggcggtacggacgtaaccggcgacgtacgtacgngncgancncg

SEQ ID NO: 74638 - DNA, 622 bp, Homo sapiens
  misc_feature: GYAE6OF02I2F06.35.19.B08.1.454.CMB.1.raw
  modified_base (396)..(396): a, c, t, g, unknown or other
  misc_feature (396)..(396): n is a, c, g, or t
  modified_base (607)..(607): a, c, t, g, unknown or other
  misc_feature (607)..(607): n is a, c, g, or t
tcagtacagatcgtcacgaccggtgctcgatttagtgagtcagtaaggggcgttggaaactgaagaacgccgtgggtccctcagtgaaggtctcctgcaagacttctggatacaccttcaccgaatactttatacactgggtgcgacaggcccctggacaagggtttgagttggctggggcggattcagccctaacagtggtgccacactctctgcacagtaaatttcgagggccggtcaccatgaccagggacacgtccagcaacacaactatatggtagtagaatggactgacgatcgtaggacgacaccggtccgtaagtacgttacctgtgtcggacgagtatattgacttcggtgggaccacggggaaccctggtacctaaccgtctccgngacgcctaccgaacgaaccggccctagtccgttcctccccgaggtccctcccgtgccctacgacggacgaccctaccgtccgagacgtcacgacggccgcccgtagggcctacggccgtacggtacgaacggtaccttaccgttccgaagtacttccgtagttacgtggtacggtccggcgtcggacgtaacgggtccgacgtacggtacncgcgactcgcgtacg

SEQ ID NO: 74639 - DNA, 644 bp, Homo sapiens
  misc_feature: GYAE6OF02ICMYC.35.19.B08.1.454.CMB.1.raw
  modified_base (189)..(189): a, c, t, g, unknown or other
  misc_feature (189)..(189): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (636)..(636): a, c, t, g, unknown or other
  misc_feature (636)..(636): n is a, c, g, or t
  modified_base (641)..(644): a, c, t, g, unknown or other
  misc_feature (641)..(644): n is a, c, g, or t
tcagtacagatcgtcacgaccggtgctcgatttagtgagtcagtaaggggctgaaatgaagaagcctggggcctcagtgaaggtctcctgcaagacttctggatacacccttcaccgaatactttatacactgggtgcgacaggcccctggacaagggtttgagtggctggggcggatcagcccctaanagtggtgccacactctctgacacagaaactttcgacgggccggtcaccatcgaccagggaccacgtcagacaacacaacctatatggagtgaatgactgagatctgacacgacggtccgtaattacgttntggtntgcgaagtattaagtagactacggtcggggacctaacggggaaacccttgggtacctaaccgttaccgtctacgacgtccctaccgaaccgaacgggtccctaagtccggttccccttaccccgttcggcccgtcccgtacgtccctaccggaggaccgaccgtaccgtcggaacgtacgaaccgaccgacggcccggtccgtaggcctggtccctaggtaccgaacggtaccttaaccgttaccgaacgtaacgtcgttacgttacgtcgtaacggcgggtacgtacgcggaacggaccgcgtaggttacngaccnnnn

SEQ ID NO: 74640 - DNA, 936 bp, Homo sapiens
  misc_feature: GYAE6OF02IZKVC.35.19.B08.1.454.CMB.1.raw
  modified_base (127)..(127): a, c, t, g, unknown or other
  misc_feature (127)..(127): n is a, c, g, or t
  modified_base (166)..(166): a, c, t, g, unknown or other
  misc_feature (166)..(166): n is a, c, g, or t
  modified_base (920)..(920): a, c, t, g, unknown or other
  misc_feature (920)..(920): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatacttttanacactgggtagcgacgaggtacccctggacaagggtttnaggtggcgtggggtcggatcgacgccctaacagtcggtacgccaactacttctcgtcggactactaaacgtaaacgtttcgacggggtcccgggtacaaccacgtacggaacccgaggggaacctacgtaccgaagaaccaacaacctaaaccttataacggtaggtacggtagaaacgtcgggtaaccgtggaacgtacttcgtacgggaaacctaaccggtaccggtaaccggttaattacttaccggtttgggtacgttacggggaaccggtaagtaacgtttaacgttaccggtaaccgttaaccgggggaccgggggttaacccggaaccggggttaaccccgttacgggtacccgtaaccgttaccccggtaaccctacgtaaccgtaccccgtaaccgtaacccgaaaccggggtccccttaaagttccccgggtttacccctttacccccggtaccggtaccccgtaccccggtaccgtaacccgtaccgtaacgggtaccggtaaccctacccggtaaccggaaccgtaacggtacccgtaacggaccgggaccccggttacggggtaccgggtcgggtacccggttccgggtacggtttaaccgaaccggggttaaccgttaaccgttaccccgttaaccgtaaccgttacccggttacgttaacccgtagggtacccgggtaccgggtacggtaacccgggtaccgggtacggaacccgggtacctttaaacgggacgtaccnggaccgtacgtggaac

SEQ ID NO: 74641 - DNA, 684 bp, Homo sapiens
  misc_feature: GYAE6OF02GQTJ4.35.19.B08.1.454.CMB.1.raw
  modified_base (281)..(281): a, c, t, g, unknown or other
  misc_feature (281)..(281): n is a, c, g, or t
  modified_base (465)..(465): a, c, t, g, unknown or other
  misc_feature (465)..(465): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgacgacacggcccctaggacaagggtttgagtggcgtggggcgactcacgccctaacaggtcggtgccacactctcgtgcaacgagtaaacttcgagggccggtacaccgatagaccgagggacacgtcacgacaacacaacgtanagtggagtagaatggactgagatcagacacgacggctaatatacgtggtagtcgacgagtagtatacggaccttaggcggaccgacggggtaaccctggacctaccttctccacgacgtacccaccaaacccggtacgggccctaacgttcccgggtaccccttacccccgggtcggtaccccncccgtaccgggtaccccgtaccgaacggggtacctaaccccgaccgttaacccggacggacggacctaaccggaccgggtcccgggtaccgtcgggactccggtcggtacggtaaccggtaacggtacttacccgtactaacggtactaccgtaactcgacgggtcggccggtaaccgtacggccggtaacgccgtataacgtcgccttaggcagtgac

SEQ ID NO: 74642 - DNA, 858 bp, Homo sapiens
  misc_feature: GYAE6OF02G3U57.35.19.B08.1.454.CMB.1.raw
  modified_base (127)..(127): a, c, t, g, unknown or other
  misc_feature (127)..(127): n is a, c, g, or t
  modified_base (288)..(288): a, c, t, g, unknown or other
  misc_feature (288)..(288): n is a, c, g, or t
tcagtacagatcgtcacgaccggtgctcgatttagtgagtcagtaaggggctgaaatgaagaagcctggggcctcgagtgaaggtctcctgcaagacttctggatacaccttcaccgaatactttanacactgggtgcgacaggcccctggacaagggtttgagtggctggggcgatcgacgccctaagagtggtcgccacactctctgacacaagtaactttcgagggtccggtacaccagtacgaccgaagggaccacggtccagacctaacgactaacctatagnggagtagagtgactggactatcgtacgacgacgaccgggtacctattacgttacgtggtggtacggacggaagtacttagttacggaaccgttaccgggtacggggaccccgtaacgggggtaacccttcgggtaacccgtacccgttacctacccgtacgtaacccggtccccttaccccggaaaacccgggtaccggggtccccctaacggtttcccccggtttacccccgtttcccccgggtacgggtcccccggttacccccgttaggtacccccgtaccgggaaacgggtcctacccggtaacccggtacccggtaaacggaccggttacccgaacggtacccggggtcccccggtaccccggggttacggtcccggttacgtaccccgggttaacgggttaaccccgggtaaagggtttacccctttaacccgggttacccgtaaaccgggttaccctttccgggtaaccggttaccggtcggggtaaccgggtcccggggtaacgtaccggggtacccgtaacgggcccgtaacgtaacgtcggtaccgcgtaggttccagcg

SEQ ID NO: 74643 - DNA, 688 bp, Homo sapiens
  misc_feature: GYAE6OF02IGQ8Z.35.19.B08.1.454.CMB.1.raw
  modified_base (75)..(75): a, c, t, g, unknown or other
  misc_feature (75)..(75): n is a, c, g, or t
  modified_base (254)..(254): a, c, t, g, unknown or other
  misc_feature (254)..(254): n is a, c, g, or t
  modified_base (342)..(342): a, c, t, g, unknown or other
  misc_feature (342)..(342): n is a, c, g, or t
  modified_base (684)..(684): a, c, t, g, unknown or other
  misc_feature (684)..(684): n is a, c, g, or t
tcagtacagatcgtcacgaccggtgctcgatttagtgagtcagtaaggggctgaaatgaagaagcctggggcctnagtgaaggtctcctgcaagacttctggatacaccttcaccgaatactttatacactgggtgcgacacggcccctggacaagggtttgagtggcgtgggggcggtatcacgccctaacgagtggtcgccactactctctgcacagtaattcgacgggcggtcacagtcgaccgaggaccncgtccagacaaccactaacctatagtgggacggtagaagttggactagagacttgtagaccgacgaccggtccttaagtactttacgngttaggtcgacgtagtattagttcgtaaccgtcggttaggggacccgaacggggttaaccctcggtcgtaacccggtccttaccgtccgacgtcccctccgaacccggtaccggaccccgtacgtcccgggtttacccttcccccgacgggttcccgcccgtcgtcccgtaccgaccggtacgccgaccgttaccggacgtccgacgccgaccggcccggtccgtcggcgtacccggtcgttccggacgtacgtaccgttccttaccgaactcggtcttaccggtgtccggtaggccggtacggccggtacggaacggccgtacggacgtacagtcgagtcnctcg

SEQ ID NO: 74644 - DNA, 667 bp, Homo sapiens
  misc_feature: GYAE6OF02G1EP9.35.19.B08.1.454.CMB.1.raw
  modified_base (313)..(313): a, c, t, g, unknown or other
  misc_feature (313)..(313): n is a, c, g, or t
tcagtacagatcgtcacgaccggtgctcgatttagtgagtcagtaagggggctgaaatgaagaagcctggggcctcagtgaaggtctcctgacaagacttctggatacaccttcaccgaatactttatacactgggtgcgacaggcccctggacaagggtttgagtggctggggcggatcagccctaacagtggtgccacactctctgcacagaaatttcgagggccggtcaccatgaccagggacacgtccagacaacacaacctatatggacgtgaatggactgagatctgacgacacggctaatattacngtgtgacgagattagttagacgtacgtcggggaccagggaacccctggtaccaccggtctaccgtcgacgccctaccaaccgaacgggccctaacgttcccggttacccttcccccgtcggtcccgtaccccgtgtcccgtaccgaacggacgtacccgaacccgttcccggaagacgaccaaccggaaccggccgggtaccccgtcggggaccctacgcccggttacggtaccgaaacgggtacccttaaccgttacccgaaacggacgttaccgttacggtaaccgttacggacggtccggggtacgtcgggaaccgaaggtccgaaccgtaacgacggatacgacgctaga

SEQ ID NO: 74645 - DNA, 704 bp, Homo sapiens
  misc_feature: GYAE6OF02F8JWD.35.19.B08.1.454.CMB.1.raw
  modified_base (692)..(692): a, c, t, g, unknown or other
  misc_feature (692)..(692): n is a, c, g, or t
tcagtacagatcgtcacgaccggtgctcgatttagtgagtcagtaagggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatcgaccagggacacgtcagcaacacaactatatggagtagaatggactgagatctgacgacacggcgtatatactggtgtgacgagtattattgactacgtcgggaccgtacggggtaaccctcggtcctacccggtcctacccgtactacgtaccctcccgaaccgaaccgggtcccacgttccgggttaccccttccccggtcggtcccgtccccgtcgtcccgtaccggacgggacgtccctacccgtaccggaacggtcgaccgaacccgacccgggtacccgggtccccgtcgggggtcccttcgggtacccgtttacggggtacccgtaaaacggggtcccgttaacccgttttcccgaaaccgttacgttaccgtccgttaacgggtcggtacgggtaccggggtaacgttcgggaccggaaacgggtcggttacctaacggtacggtacncggtcactgccg

SEQ ID NO: 74646 - DNA, 871 bp, Homo sapiens
  misc_feature: GYAE6OF02JLNWE.35.19.B08.1.454.CMB.1.raw
  modified_base (860)..(860): a, c, t, g, unknown or other
  misc_feature (860)..(860): n is a, c, g, or t
  modified_base (865)..(865): a, c, t, g, unknown or other
  misc_feature (865)..(865): n is a, c, g, or t
  modified_base (871)..(871): a, c, t, g, unknown or other
  misc_feature (871)..(871): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctggacaagggtttgagtggcgtggggcggatcagtccctaacgaggtggtgccacactctcgtgcactaagtaaactttccgaacgggtccgggtaccacccgtaagttcggaacccgtaacgggacctaccggtaccctaacgaccgaaaccaaccgtaaaccttaagtaacggtacgggtaagggttacgaaaacggttccgggaaacgttacggaacgtaacgttccggttaacggaaccggtaaccgtaaccggggttacccgttaagtttaacgtttaacgtgggttcggttacggaccggttaagtaacgttacgttaccggtaacgttaccgggtcggggaaccccgtaacggggtaaacccctttgggtaacccgtacccggttccctaccgttacccgaccggtcccgtaacccgtaacccggaaaccggtccccgttaacgttcccgggtttaccccttccccggtacggccccgtacccgtcgtaccccgtaccgaccgggtacctacccggacccgtaccggaaccggtccgaaccggaccgtaccgggcccggttcccggtagggtccgttaccgaccggttacggtaccgtaaaccgttccgttaacccgttacccgacgttaccttaccggtacgttaccgtcgggtaacggtccgggtaacgcggtaccgaacggtcccgtagtaccgtacggctnaccgngtacgn

SEQ ID NO: 74647 - DNA, 679 bp, Homo sapiens
  misc_feature: GYAE6OF02G5UJ3.35.19.B08.1.454.CMB.1.raw
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
  modified_base (676)..(676): a, c, t, g, unknown or other
  misc_feature (676)..(676): n is a, c, g, or t
tcagtacagatcgtcacgaccggtgctcgatttagtgagtcagtaaggggctgaaatgaagaagcctggggcctcagtgaaggtctcctgcaaagacttctggatacaccttcaccgaatactttatacactgggtgcgacaggcccctggacaagggtttgagtggctggggcggatcagccctaacagtggtgccacactctctgcacaagaaatttcaggggccggtcaccatcgaccagggacacgtccagcaacacaacctatagtggaggtgaatggactgagactcagaccgacacggctaatattacgtgtgtgcgagtaattgttacgacttacggtcggggacctaacggggtacccttggtacccaccgttccgtaccctcgaaccgtccctaacccgaaccggaaccgggtcccctaacggttcccggttcccctttcccccgtcggcccgtccccgtcggcccgtaccgacgggacgacccgaccgtacccgaagcgaccgtacgaccggtcccggtacccggtcgggtccgtcggtacccggtcggttaaccggaaccggtacccttaccgttacccaaccggttacgtaccgttcgttaccgtaggacggtcgggtcggtacggacggtaacgggcggtaacgtacgtacggangntacgntcg

SEQ ID NO: 74648 - DNA, 715 bp, Homo sapiens
  misc_feature: GYAE6OF02GJHKV.35.19.B08.1.454.CMB.1.raw
  modified_base (269)..(269): a, c, t, g, unknown or other
  misc_feature (269)..(269): n is a, c, g, or t
  modified_base (670)..(670): a, c, t, g, unknown or other
  misc_feature (670)..(670): n is a, c, g, or t
  modified_base (701)..(701): a, c, t, g, unknown or other
  misc_feature (701)..(701): n is a, c, g, or t
  modified_base (705)..(705): a, c, t, g, unknown or other
  misc_feature (705)..(705): n is a, c, g, or t
  modified_base (710)..(710): a, c, t, g, unknown or other
  misc_feature (710)..(710): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaacagtggtgccacactctctgcacaagaaattttccgagggccgggtacaccagtacgaccgagggacacgtaccagaccaaanaccaacctatagtggaaggtgaagtcggactagagatctagacgaacacggtacgtatatactgtgtgcgagattagtgactagtcgggacaacgggaaccctggtaacctaccgttctaccgtaccacgtcccgtaccaacccggtaaaccggggtcccctaaaggtttcccgggtttaccccctttaccccccggtaccgggtaccccgtccccggttacgacccgttaccccggaggggaacccgttaccctaaccccggtacccggaacgaacggacccgaaccggacgggaccccggcccggttagggccgttaccggtacccgtacggtaacgaaccgggtaccttaaccgttaccgaaccgtactacgttacgtacctaggaccggaccgggtnaccgggacgaacgggccgtaacgagtaccgngacnccgancgaag

SEQ ID NO: 74649 - DNA, 656 bp, Homo sapiens
  misc_feature: GYAE6OF02HGNBS.35.19.B08.1.454.CMB.1.raw
  modified_base (541)..(541): a, c, t, g, unknown or other
  misc_feature (541)..(541): n is a, c, g, or t
  modified_base (640)..(640): a, c, t, g, unknown or other
  misc_feature (640)..(640): n is a, c, g, or t
  modified_base (643)..(643): a, c, t, g, unknown or other
  misc_feature (643)..(643): n is a, c, g, or t
  modified_base (649)..(649): a, c, t, g, unknown or other
  misc_feature (649)..(649): n is a, c, g, or t
  modified_base (651)..(651): a, c, t, g, unknown or other
  misc_feature (651)..(651): n is a, c, g, or t
  modified_base (653)..(654): a, c, t, g, unknown or other
  misc_feature (653)..(654): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttactacactgggtgcgacacggcccctggacgaagggtttgaggtggcgtggggcggatcgagccctaacgagtggtgccacactctctgcacagtaaatttcgacgggtccggtcacctatacgaccgaggacacgtccagacaacaccaactactagtggaggtagaatcggtacagagtactcgtcggaacgacgtaccggacgttaattacttagtggtgtcgacgtacgtatagtacgaccgttacggtcggggaccgaacgggtaccccgttcgtacccgtaccgttccctccgtaccgaccggtccctacccgaacccggaccggccctacgttcccgtcccttcccgacgccctacctcccgtacaacgctccgacgtcgggtcggacctggacccggtccgtcccggnggtccctcggtaccgtggaaccgtacgtaccttactaaccgcttacgttcgtacgtcgtaggccgggaggaccgtaggacggaaccggtcaacgtacgngcntaccgncncnncg

SEQ ID NO: 74650 - DNA, 662 bp, Homo sapiens
  misc_feature: GYAE6OF02FX6XF.35.19.B08.1.454.CMB.1.raw
  modified_base (301)..(301): a, c, t, g, unknown or other
  misc_feature (301)..(301): n is a, c, g, or t
  modified_base (309)..(309): a, c, t, g, unknown or other
  misc_feature (309)..(309): n is a, c, g, or t
  modified_base (488)..(488): a, c, t, g, unknown or other
  misc_feature (488)..(488): n is a, c, g, or t
  modified_base (655)..(655): a, c, t, g, unknown or other
  misc_feature (655)..(655): n is a, c, g, or t
  modified_base (662)..(662): a, c, t, g, unknown or other
  misc_feature (662)..(662): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctaggacaagggtttgagtggcgtgggggcggatcagccctaacaggtggtgccacacttcctctgcacgaagtaaacttcggagggcccggtacaccgagtcgaccgaggactacgtaccagaccaacaaccaacctatagcggagtagaagngaagtganatcgagacgacgacggtactatacttagtagtgtagacgagtatagtttacgaacttcgggtcgggaccgacggggtaaccctggttaccgaccctcctaccgtcgaccgtccctacccaacggaaccggtcccgtaccgttccggttccccttcccgtccggcccgtcccgtctcccncgggacgcaccctaccgaccgtaacggcacgacgtaccggcccggttaccgcggtcctcggtaccgttcgtaccgaacggttacctaccgttacgaccgtactcgtccgtagtacgggaccggtcgggtaccgtcgggtaacgacggcgtaacgtacgacgtgtacncgagctn

SEQ ID NO: 74651 - DNA, 751 bp, Homo sapiens
  misc_feature: GYAE6OF02HZ5YC.35.19.B08.1.454.CMB.1.raw
  modified_base (741)..(741): a, c, t, g, unknown or other
  misc_feature (741)..(741): n is a, c, g, or t
  modified_base (745)..(745): a, c, t, g, unknown or other
  misc_feature (745)..(745): n is a, c, g, or t
  modified_base (748)..(748): a, c, t, g, unknown or other
  misc_feature (748)..(748): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacacggcccctggacaagggtttgagtggcgtggggcggatcgagccctaacagtggtgccacactctctgcacagtaaatttcgagggccggtcaccatgaccagggacacgtcacgacaacacaacctatagtaggaggtacgataggactgagtactcgtggaaccggacgaccgggtaccgttaaattacttaacgtggttgtacgacgaagtattacgttagaaccgtcggttcggggacccaacgggggtaaccccttgggtacctaaccggtccttaccgtccggaaactcccggtacccaaccgggtaaaccggcccctaccggtttccggtacccccgtttccccggtcgggtaccccgtccctccggtaccctaccgggtaacggacgtacccgacccggttacggaaccgaggtaacccaccggaacggtcccgggtcccggtcgggccttacggacccggtacgggttaaccggtaaacgggtaccctttaccgttaccgtaaccgttacgttaccgttaccgttacggtacgggtaccgggtccgggtacggttacccgggaggtaacgggccgaccgttaagccggtancgtnacngtc

SEQ ID NO: 74652 - DNA, 795 bp, Homo sapiens
  misc_feature: GYAE6OF02IKQZ8.35.19.B08.1.454.CMB.1.raw
  modified_base (191)..(191): a, c, t, g, unknown or other
  misc_feature (191)..(191): n is a, c, g, or t
  modified_base (785)..(785): a, c, t, g, unknown or other
  misc_feature (785)..(785): n is a, c, g, or t
  modified_base (790)..(791): a, c, t, g, unknown or other
  misc_feature (790)..(791): n is a, c, g, or t
  modified_base (793)..(793): a, c, t, g, unknown or other
  misc_feature (793)..(793): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaattactttatacactgggtgcgacaggcccctggacaagggtttgagtggcgtggggcgatcgacgccctaaanaggtggtgccacactctctgcaactaagtaaatttcgacgggtccggtaccaacctagtacgaacccgaagggacctacggtaccagaaccaaccaacctaaacctagtaagtcgggtaggtaagtaagtgggaactagaacgtactcgtaccggaacgtaaccgtaccgggtacgtttaattaacgtttacggtggttacggtggacggtaagtaacgtttaagttacggtaaccgttaccgggtgggggaacccgtaaaccggggtaacccttacggggttccgtaaccccgttccgtttaccctaccggaacggtacccccttaaccggaaaacccggaccggggtaccccttaacggttccccgggttttccccgttcccccggtaccggtccccggtccccgtacgtcccgttccgggaaccggtacgaccccgtaacccggtacccgtaacggaccggaccgaaccgacccgggtcccgtcccggtacgggtctaccgggtccctacggtaaccgtacgtaacctaccgttaccgacgtcgtactacgtccgtagcggacggtcggacgacggacggcgacgacggtncgtgnngncg

SEQ ID NO: 74653 - DNA, 610 bp, Homo sapiens
  misc_feature: GYAE6OF02IV8RP.35.19.B08.1.454.CMB.1.raw
  modified_base (375)..(375): a, c, t, g, unknown or other
  misc_feature (375)..(375): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(610): a, c, t, g, unknown or other
  misc_feature (608)..(610): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggcccctggacaagggtttgagtggctggggcggatcagccctaaacagtggtgccacactctctgcacagaaatttcgagggccgggtcaccatgaccgagggacacgtccagacaacacaacctatatggaggtgaatggactgagatctagacgacacggcgtattacttactgtgtgcgagattattgactacgtgggaccacggaacctggtacaccgtctcctcgacnccctccaaccgacggcccagtcccggttaccttccccgtcgggcccgtcccgtcgccttacccgacggccgaccctcccgtacccggacggacgccacgtaccgggcccggtccccgtggggtccgtcggcccgttagggtaccgaaacggtaccttaccgttccgaacgtattcgtagtaccgtggcggaccgggtcgtacgggcgtaacgggcgtacgaagtacggnangnnn

SEQ ID NO: 74654 - DNA, 705 bp, Homo sapiens
  misc_feature: GYAE6OF02JBEAJ.35.19.B08.1.454.CMB.1.raw
  modified_base (191)..(191): a, c, t, g, unknown or other
  misc_feature (191)..(191): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (692)..(692): a, c, t, g, unknown or other
  misc_feature (692)..(692): n is a, c, g, or t
  modified_base (700)..(700): a, c, t, g, unknown or other
  misc_feature (700)..(700): n is a, c, g, or t
tcagtacagatcgtcacgaccggtgctcgatttagtgagtcagtaaggggctgaaaatgaagaagcctggggcctcagtgaaggtctcctgcaagacttctggatacaccttcaccgaatactttatacactgggtgcgacaggcccctggacaagggtttgaggtggctgggggcggatcgagccctaanaggtggtgccacactctctcgcaacgaagtaaatttcgacggggtccggtcaccatcgaccgagggacacgcagacaacacaactntagtggagtnaagtggactagagtctcgtacgacgaccgacggtaccttattaacgttcgtggtcgtcgacgtataattacgttacgacttacggtcggggaccaaccggggtaaccgttcgggacctacccgtccttccggtacaccggtccctaccgaaccgtaacggggcccctacgtttcccggtaccccttccccgtggtcccctcccgtcgtcccgtacggaacggtccgaccgtacccgtaccgacgtaccgaccgacggtacggcccggtcccggttacggaccttcggccgttaacgggtaccgaaccgttacctacccgttaccgaacgtacgttaccgtaggtaacccgtgggtaaccggccgggtcggtaacggacggtaaccggtccgagtaacggtagacncgacgtgntacgg

SEQ ID NO: 74655 - DNA, 696 bp, Homo sapiens
  misc_feature: GYAE6OF02G6M06.35.19.B08.1.454.CMB.1.raw
  modified_base (205)..(205): a, c, t, g, unknown or other
  misc_feature (205)..(205): n is a, c, g, or t
  modified_base (685)..(685): a, c, t, g, unknown or other
  misc_feature (685)..(685): n is a, c, g, or t
  modified_base (687)..(687): a, c, t, g, unknown or other
  misc_feature (687)..(687): n is a, c, g, or t
  modified_base (692)..(692): a, c, t, g, unknown or other
  misc_feature (692)..(692): n is a, c, g, or t
tcagtacagatcgtcacgaccggtgctcgatttagtgagtcagtaaggggctgaaatgaagaagcctggggcctcagtgaaggtctcctgcaagacttctggatacaccttcaccgaatactttatacactgggtgcgacaggccctggacaagggtttgagtggcgtggggcgatcagccctaacgagtggtgccacactctcngcacaagaatttcgagggccggtcaccatcgaccgaggacacgtccagcaacacaacctatatggaggtagaagtggactgagactgtcgacgacgaccggcgtattattacgtgtagtgacgagtatattacggactacggtacgggccgaacggtaccctgggtaccaccgttcctcctacgaccgtccctaccgacccgtaacgggccctacgttcccgttaccccttccccgtacggcccgtcccgcgtcccgtaccggacgggtacgacccgtacccgtacccgacggaccgaccaaccgggaccggtcccgggacccggtccgggtccgttcccgggtaccggttaccggtaaccggtaaaccgtacccgtttaacctaaccccggtaaccgttataccgggttaccgttaccgtacgggaccgggtaccgggtcgggaacggtcggtaacgggtacccgtaagtaagtaacgngngtganacgc

SEQ ID NO: 74656 - DNA, 776 bp, Homo sapiens
  misc_feature: GYAE6OF02IC5WX.35.19.B08.1.454.CMB.1.raw
  modified_base (768)..(769): a, c, t, g, unknown or other
  misc_feature (768)..(769): n is a, c, g, or t
tcagtacagatcgtcacgaccggtgctcgatttagtgagtcagtaaggggctgaaatgaagaagcctggggcctcagtgaaggtctcctgcagacttctggatacaccttcaccgtaatactttatacactgggtgcgacacggcccctggactaagggtttgacgtggcgtggggcgatcacgaccctaacgagtggcgccacactctctgacaacgtagtaaactttcgacggggtaccggtcaaccagtcggaaccgaaggggaccgaccgtaccgaacgaccaacctaaccgaaaccttagttaagtacgggaagggttagaagtacgggtactaggaacgtatccgtacggaaccgaccgaaccgggtcctttaagttaacgttacgttggttcgtacggtagaaagttagttacgttagtaccgtaacgggtccgggggtaaccgtaaccggggtaaccccgttcgggtacccgtaacccggttccttaccccgtacccgtacgtacccctaccgaaccccgtaccggggtacccctacgtcccgtttacccctccccggtccggcccgtccgtccgtccgtccgacgaccgacccgtaccgtaccgacgtaccgacgaccgccgggtacccgtcccggtcggtccgtacgtccgttacgggtacgtaaccgggtaccttaaccgttaccctacggtacgttaccgttcggtacgtcggacggtaccggccgtaggaccggtacggccgtacggtacacggnngcgcagc

SEQ ID NO: 74657 - DNA, 174 bp, Homo sapiens
  misc_feature: GYAE6OF01BQ400.29.37.D04.1.454.CMB.1.raw
  modified_base (173)..(174): a, c, t, g, unknown or other
  misc_feature (173)..(174): n is a, c, g, or t
tcagatagagtactcacgaccggtgctcgatttagtagcatactgttgggtttgggggaagaggaagactgacggtcccccaggagttcaggtgctgggcacagcggccctggtctgcctggtcaaggactacttccgacacgcgagctgagcgggctggcaaggcgcatagnn

SEQ ID NO: 74658 - DNA, 491 bp, Homo sapiens
  misc_feature: GYAE6OF01EP1WL.29.37.D04.1.454.CMB.1.raw
  modified_base (211)..(211): a, c, t, g, unknown or other
  misc_feature (211)..(211): n is a, c, g, or t
  modified_base (231)..(231): a, c, t, g, unknown or other
  misc_feature (231)..(231): n is a, c, g, or t
  modified_base (241)..(241): a, c, t, g, unknown or other
  misc_feature (241)..(241): n is a, c, g, or t
  modified_base (308)..(308): a, c, t, g, unknown or other
  misc_feature (308)..(308): n is a, c, g, or t
  modified_base (477)..(478): a, c, t, g, unknown or other
  misc_feature (477)..(478): n is a, c, g, or t
  modified_base (481)..(491): a, c, t, g, unknown or other
  misc_feature (481)..(491): n is a, c, g, or t
tcagatagagtactcacgaccggtgctcgatttagtagcatactgttgggtttgagggcccagtctgtgttgacgcagccgccctcaatgtctgcggccccaggacagaaggtcaccatctcctgctctggaagcagctccaacattggaggtaattatgtctcctggtaccagcagctcccaagaacacgcccccaaaattctcatttangacaatgataagcggccctnagggattccngaccgattctctggctccaagtctggcacgtctgccacctggccatccaccggactccagactgganacgaggccaattattactgcggaaacgtggactaccgagcctgagtggcgggtctagtcgggcggaggaccaagcgtgaccgtcgtaggtcagcccaggctcgcccctcggccactctcgtcccgcactctgctcgtctctactgacgcggctggcaaggcacagtagnngcnnnnnnnnnnn

SEQ ID NO: 74659 - DNA, 480 bp, Homo sapiens
  misc_feature: GYAE6OF01BK4QC.29.37.D04.1.454.CMB.1.raw
  modified_base (471)..(480): a, c, t, g, unknown or other
  misc_feature (471)..(480): n is a, c, g, or t
tcagatagagtactcacgaccggtgctcgatttagtagcatactgttgggtttgagggcccagtctgtgttgacgcagccgccctcaatgtctgcggccccaggacagaaggtcaccatctcctgctctggaagcagctccaacattggaggtaattatgtctcctggtaccagcagctcccaagaacagcccccaaaattctcatttatgacaatgataagcggccctcagggattcctgaccgattctctggctccaagtctggcacgtctgccaccctggccatcaccggactccagactggagacgaggccgattattactgcggaacgtgggataccagcctgagtgcggggctagttcggcggaggaccaagctgaccgtctaggtcagcccaaggctcgccccctggtcactctcgttcccgcatctgactcgtctctactgagcgggctggcaggcgcatagnnnnnnnnnn

SEQ ID NO: 74660 - DNA, 200 bp, Homo sapiens
  misc_feature: GYAE6OF01C1466.29.37.D04.1.454.CMB.1.raw
  modified_base (173)..(200): a, c, t, g, unknown or other
  misc_feature (173)..(200): n is a, c, g, or t
tcagatagagtactcacgaccggtgctcgatttagtagcatactgttgggttttggggggaagaggaagactgaccggtcccccaggagttcaggtgctgggcacagcgaccctggtctgcctggtcaaggctactcgacagcgagctgagcgggctggcaaggcgtcatagnnnnnnnnnnnnnnnnnnnnnnnnnnnn

SEQ ID NO: 74661 - DNA, 598 bp, Homo sapiens
  misc_feature: GYAE6OF02HGU5P.29.37.D04.1.454.CMB.1.raw
  modified_base (241)..(241): a, c, t, g, unknown or other
  misc_feature (241)..(241): n is a, c, g, or t
  modified_base (585)..(585): a, c, t, g, unknown or other
  misc_feature (585)..(585): n is a, c, g, or t
  modified_base (587)..(598): a, c, t, g, unknown or other
  misc_feature (587)..(598): n is a, c, g, or t
tcagatagagtactcacgaccggtgctcgatttagtagcatactgttgggtttgagggcccagtctgtgttgacgcagccgccctcaatgtctgcggccccaggacagaaggtcaccatctcctgctctggaagcagctccaacattggaggtaattatgtctcctggtaccagcagctcccaagaacacgcccccaaacttctcatttatgacaatgataagcggccctgagggattccngaccgattctctggctccaagtctggcacgtctcgccaccctggccatccaccggactccagactgggacgacgaggccgaatttacttacgtggacggaacggtggggaactacccgaggtcctaggaggtcggcggggtacttaggttccggggacgggaacgggacccaaggtcgtacggacccgttccgtaggtaccgacggtacccgaaggtccgtaccgcccccgttcggtccaccgttccgttccggttccccgcctacttccgtcgtaccttccggttccttaccgttacgtggacggtccgggtcgtacgggacgaacgggtccgactagtacgnannnnnnnnnnnn

SEQ ID NO: 74662 - DNA, 561 bp, Homo sapiens
  misc_feature: GYAE6OF02GLZX3.29.37.D04.1.454.CMB.1.raw
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (551)..(561): a, c, t, g, unknown or other
  misc_feature (551)..(561): n is a, c, g, or t
tcagatagagtactcacgaccggtgctcgatttagtagcatactgttgggtttgagggcccagtctgtgttgacgcagccgccctcaatgtctgcggccccaggacagaaggtcaccatctcctgctctggaagcagctccaaacattggaggtaattatgtctcctggtaccagcagctcccaagaacagcccccaaaacttctcattttatgacaatgataagccgggccctcagggtatttcctgacccgattctctggctccaagtctggcacgtctcgcccaccctggcccatcaccggactccagactggagacgaggccgattattacgtggcggtaacggtggataccgagcctagaggtggcggggcttagtcgggacgggagggaccaaggctacgacccgtccgtaggtcacgcccgaacggctccggccccctcggtccacttccgttcgtttccccgcctacttcctcgtaccttccgttccttccgttacgtcgagggtccgggtcgtagggcgaacggtccgacgagtaggnangnnnnnnnnnnn

SEQ ID NO: 74663 - DNA, 778 bp, Homo sapiens
  misc_feature: GYAE6OF02GJJLH.29.37.D04.1.454.CMB.1.raw
  modified_base (214)..(214): a, c, t, g, unknown or other
  misc_feature (214)..(214): n is a, c, g, or t
  modified_base (754)..(754): a, c, t, g, unknown or other
  misc_feature (754)..(754): n is a, c, g, or t
tcagatagagtactcacgaccggtgctcgatttagtagcatactgttgggtttgagggcccagtctgtgttgacgcagccgccctcaatgtctgcggccccaggacagaaggtcaccatctcctgctctggaagcagctccaacattgggaggtaattatgtctcctggtaccagcagcctcccaaagaacacgcccccaaattctctatttangacaatgaataacgccggcctcgagggtacttcctaggaccgtattcgtcgtggaccttccgaagttcgtcggcctacgtcctcggccctacccgtggaccctagtcccgaacccggtacctccgaaggtaccgtacgggtaacgacggtacggaccctaagttaacttacgtggaaccggtaacggtcggaactaccgacgtccgttaggacggtcggccggggtactttagggtccgggacgggtaacgggaaccgaagtccgtaacggtacccgtaccgtacgggtaccgaaccggaccgtaaacgggtcccgtacccggtccccccgttaccggtacccgtacccgtttacccgtttaccccggtttaccccggtacctaccgtttaccgttaccggttaacccgtttcccggtttacccttacccggtttaaccggttacggggtaaccgggttcccgggggttaacccggttacgggtaaccccgggtaacggggtcccggtacgtaacggttacgggaactcggtaactcggngacgcgtacgcgtctacgtcgagc

SEQ ID NO: 74664 - DNA, 525 bp, Homo sapiens
  misc_feature: GYAE6OF01AOS7I.36.76.G10.1.454.CMB.1.raw
  modified_base (467)..(467): a, c, t, g, unknown or other
  misc_feature (467)..(467): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtctgggggaggcttggtccagcctggggggtccctgagactctcctgtgcagcctctggattcacctttagtaactattggatgagttgggtccgcctggctccgaggtaagggcctgggagtgggtggccaacatacagccggatggaagtgagaaacactatgtggagtctgtgaagggcgattcaccatctcagagacaacgcaagaactcactgttctgaacatcgaccagcctgagacgccgaggactcggctctctattacngtgcgagagagggctacgtttggagttgtactttcctccctttgcgttggtaccgggg

SEQ ID NO: 74665 - DNA, 511 bp, Homo sapiens
  misc_feature: GYAE6OF01EOANF.36.76.G10.1.454.CMB.1.raw
  modified_base (471)..(471): a, c, t, g, unknown or other
  misc_feature (471)..(471): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtctgggggaggcttggtccagcctggggggtccctgagactctcctgtgcagcctctggattcacctttagtaactattggatgagttggtccgcctggctccaggtaagggcctggagtgggtggccaacatacagccggatggaagtgagaaacactatgtggagtctgtgaagggccgattcaccatctcagagacaacgccaagaactcactgttctgaacatgaccagcctgagagccgaggactcgctcgtctatactgtgcgagngagggctctttggagtgtattctccctttgcttgtcgggg

SEQ ID NO: 74666 - DNA, 527 bp, Homo sapiens
  misc_feature: GYAE6OF01AHMW8.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtctgggggaggcttggtccagcctggggggtccctgagactctcctgtgcagcctctggattcacctttagtaactattggatgagttgggtccgcctggctccaggtaagggcctggagtgggtggccaacatacagccggatggaagtgagaaacactatgtggagtctgtgaagggccgattcaccatctccagagacaacgccaagaactcactgtttctgaacatgaccagcctgagagccgaggactcggctctctattactgtgcgagaggagggctcgttttgggagttgtactttccttcccctttgtcttggtcgggg

SEQ ID NO: 74667 - DNA, 526 bp, Homo sapiens
  misc_feature: GYAE6OF01CAHPO.36.76.G10.1.454.CMB.1.raw
  modified_base (335)..(335): a, c, t, g, unknown or other
  misc_feature (335)..(335): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtctgggggaggcttggtccagcctggggggtccctgagactctcctgtgcagcctctggattcacctttagtaactattggatgagttgggtccgcctggctccgaggtaagggcctgggagtggggtggccaacntacaggccggatggaagtgagaaacactatgtggagtctgtgaagggccattcacatctccagagacaacgaccaagaactcactgtttctgaacatcgaccagcctgagagccgaggacgtcggctctctattactgtgcgagagagggctacgtttggagtgtacttctaccctttgcgttggtcgggg

SEQ ID NO: 74668 - DNA, 938 bp, Homo sapiens
  misc_feature: GYAE6OF01EU6JV.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagcttgggttttccttgttgcttattttagaaggtgtccagtgtgaggtgcagttggtggagtcgtgggggaggcttggtccagccgtgggggtcctgagctctcctgtgcacgtccttcgtggtactttcctaaccgttttaaggtaaacttagttggattggtacggtttcgggtccccgccgtgggtcctaccggtaaggggttaacggggccccgttaggggtaacgggttcgggggtcgggacccctaaacgaacgttaacgaacgggtcccgggaagttcgggaaaaggttaggaaacggaaaaacctacgttaagtagggttacgggtaacgttccggttaagggttacggggaaaccggggtccccgttaaagtttacccgaacccgtaacgtttcccgttaaccccgaaagggaaaccgtaaaccccgaaacccgggtaaccccctaaaaagggtaaacccctttacccgtaaaccgtttttacggtttttacccgtaaaccggtaaaacccttaaaccgttttaaccccgaaaaccccgtttacggaaacgggaacgggttaccccgggaaccgggttaacccggtaccgggttaccccgtttacctttaccgtttaacgttttaacccgttagggtaccggtaaccggtaaacggggtaacgggtaacgggggtacccgtttaacgggtttttaacgggttagggttacgtttaccgttttacccccgtttcccggttttacggttaccggtttcggggttaccgggggcccggttaaaccccggggg

SEQ ID NO: 74669 - DNA, 609 bp, Homo sapiens
  misc_feature: GYAE6OF01E4YVB.36.76.G10.1.454.CMB.1.raw
  modified_base (544)..(544): a, c, t, g, unknown or other
  misc_feature (544)..(544): n is a, c, g, or t
tcagtacgctgtctcacgaccggtgctcgatttagtcactcatacaggggtcagagaggagccttagccctggactccaaggccttttccacttggtgatcagcactgagcacagaggactcaccatggaattggggctgagctgggttttccttgttgcttattttagaaggtgtccagtgtgaggtgcagttggtggagtcgtgggggaggcttggtccagccgtggggggtccctgacgactctcctgtgcagcctctggattcaccttcagtagctatagcatgaacgtcgggtccgccgaggctaccggaggggaaggggcgtgggaggttgggtctcactcctattaaggtagtaggtagtagttacatactactacgcagtactcgagtaggaacggcgattcactatccacagacaacaacgacaaagacctacactgtactctagacaagtagaacacgccgtaggaagacggaccgaacggaccgccggtagttggttaggttaacgtttaccggtgggttcgggaccgggttnttcggtagtttaagttttacgtttttacggtaacgtttcggtttttaacctccccgtttaaaccg

SEQ ID NO: 74670 - DNA, 784 bp, Homo sapiens
  misc_feature: GYAE6OF01AIN7J.36.76.G10.1.454.CMB.1.raw
tcagtacgctgtctcacgaccggtgctcgatttagtcactcatacaggggtcgagagaggagccttagccctggactccaaggcctttccacttggtgatcagcactgagcacagaggactcaccatggaattgggctgagctgggtttcctgttgtctatttagagtgtcagtgtgaggtgcaggttggtggaggtcgtgggggagggcttgggtccgacgccgtcggggggtccctggacgactcgtcctggtgcgagtcctcgtggtattcaccgtttagtaactagtttggatggtagttcgggtccgccgtcggctccgagggtaggccgtagggaggtgggtcggaccgaacgtagtaaccaaggacccggaagtgggaaaggtaggaacgaaaacgacgtaatcgggtaggtacggttcgtggtacgggaaacggggtccggtagttacccgaaccctaacgtacccgtaccgaacggaacggtaacccaaacgggaacccctaaaacggtaacctacccgtaacgtttacgttttaccgtacggtaaacctacgtaccggaaacccctaggaccccgttaggaaaccgtaccggaaccggaacgggtacccgttcccggggtacctacccgttaccttaaagtttaccctggttacgtaccggtaagggtacggtaaggggtacccgttaacggttttacgggacggttaacggtttaccgtttacccttacccccggtttttcggtaacccgggtttcgggttaaccccgggggg

SEQ ID NO: 74671 - DNA, 785 bp, Homo sapiens
  misc_feature: GYAE6OF01DLKWK.36.76.G10.1.454.CMB.1.raw
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgcttattttagaaggtgtccagtgtgaggtgcagttggtggagtcgtgggggagcttggtccagccgtgggggtccctgagactctcctgtgcagcctntggattcacctttaagtaactattggatggtagttgggtcccnccgtggcctaccgagggtaacgggctgggagtgggtggaccaaacataacgaggccggagtagggaagtagaagaaactaactagttggtagggagttcgtaggtcggaaacggggtcccgtaatttccaaccgtacttaccctacccgaggaaccgaaccgaaacccgaccctaaaacggtaaacccttccgtaaccgttttgttttaccctaacgtaaaacctagttaccgaacccgtaacgtcccgtaacggaacgggtacccggaaccccggtaagggtacccgtttacccgggcctttacccgttaccgtttaacgtttacccgttgggttaccgacgggtaaacgggtaacgggtaacgggggttacccttttaacggggttttttacgggtaacgtttaccggttaacccgttttttaccccccggtttacccccgttttttacggggtaacccgtttttggggggtaaccccgggggg

SEQ ID NO: 74672 - DNA, 960 bp, Homo sapiens
  misc_feature: GYAE6OF01CLBTP.36.76.G10.1.454.CMB.1.raw
tcagtacgctgtctcacgaccggtgctcgatttagtcactcatacaggggtcagagaggagccttagccctggactccaaggccctttccacttggtgatcagcactgagcacagaggactcaccatggaagttggggctgagcgttggttttccttgttgcttattttagaaggtgtccagtgtgaggtgctaggttggtggagtcggtgggggaggtcgtttgggtccaggtcccggttcgggggggttcccctggacgtaccttccgttccgtgtcgccgacgtcccgttgtaggtactttccttaaacccgtttttaagtaaaaccttagttaggagttggtacggtttccggggtccccgaccgtcgggtaccgtaccggaaggggtaaccggggcccgttggggacgggttcgggggtaccggacccaaaacgtaacgttaaccgacgggtaccggtaaggtacggggaaaggttaggaaaacgtaaaaaccgtaacgttaaggttacggggtagggtaacgttccggttaagggtaacggggtaaacccgggggtacccgttaaccgtttaacccgaacccgttacgttaccccgttaacccggaaacgggaaaccggtaaaccccggaaaccccgaaaaccccggtaaaaaccgtaaacccgtacccgttaacgttttaccggtttttaaccgaaacggtaaaacctacgttaaccggaaccccggtaaggtacccgtaagggaaccggtaacggaaccccggggaacggttacccggttaccggtaccctttaccgtttaccgtttaacgttacggtggtaccggtaacgggaaggtaacggggtacgggttaccgttttacgggttttacggggtaacgtttaccggtttaccttttccccgtttaccccggtttaacggttcccgggtttaagggggttaccccggggg

SEQ ID NO: 74673 - DNA, 662 bp, Homo sapiens
  misc_feature: GYAE6OF01EBIQC.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagcgttgggttttccttgttgcttattttagaaggtgtccagtgtgaggtgcagttggtggagtcgtgggggagcttggtccagccgtgggggtccctgagacctctcctgtgcagcctgtggtacttcctaccttttagtaacttattggatggtagttcggtccgcgtggctccgagggtacggcgtgggagtgggtcgcaatagacgagaccggagtacggaagtgaagaaacgtactaagtggtacggaagttcgtagggtacggaacgggtcctacgttaccaccacttccgtaccaacggaacgtaccaaacgcccaaagtaacccttactaccgtttaggtttacctacggtaaaactctacggaaccctacggtcctaggaacggaccggtaccggacggttacccgtcgtcttacttacttaacttcggtgttccggagtacggagggtaggtacgttagttagggattcgttacctttacccgtttccctttaggtccgttgggtacccgggg

SEQ ID NO: 74674 - DNA, 599 bp, Homo sapiens
  misc_feature: GYAE6OF01DH8QX.36.76.G10.1.454.CMB.1.raw
  modified_base (186)..(186): a, c, t, g, unknown or other
  misc_feature (186)..(186): n is a, c, g, or t
  modified_base (246)..(246): a, c, t, g, unknown or other
  misc_feature (246)..(246): n is a, c, g, or t
  modified_base (323)..(323): a, c, t, g, unknown or other
  misc_feature (323)..(323): n is a, c, g, or t
  modified_base (462)..(462): a, c, t, g, unknown or other
  misc_feature (462)..(462): n is a, c, g, or t
tcagtacgctgtctcacgaccggtgctcgatttagtcactcatacaggggtcagagaggagccttagccctggactccaaggccttccacttggtgatcagcactgagcacagaggactcaccatgaattgggctgagctggtttccttgtgctatttagagtgtccagtgtgaggtgcagttggnggagtcgtggggagcttggtccagccgtgggggtccctgagactctcctgtgcagccctntggattcctacctttagtaactattggatgagttggtccgcctggctccgaaggtacggctggaggtgggtgccaanatacagccggatggaaagtgaagaaaccatagtggtaggagtcgtgtggaacgggccgtattccgaacctatctacccgagacgaacgaaaccgaccaacgtaactcgtacctttgttactacgaactactacgaaccngtacctaggacgacggaccggaggtccgtcggcttacgtcttaattacgtggcgtacggagtaacggacggtcttaacgtttggacgttacgttactttacccgttacccgtttcgtacgttcgggtaacccggggg

SEQ ID NO: 74675 - DNA, 570 bp, Homo sapiens
  misc_feature: GYAE6OF01EUBYV.36.76.G10.1.454.CMB.1.raw
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
  modified_base (449)..(449): a, c, t, g, unknown or other
  misc_feature (449)..(449): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgcttattttagaaggtgtccagtgtgaggtgcagttggtggagtcgtggggggaggcttggtccagccgtggggggtccctgagactctcctgtgcagcctctggattcacctttagtaactattggatgagttgggtccncctggctccgaggtaagggcctgggagtgggtcggaccaacatacagccggatgggaagtgagaaacnctatggtggagtctgtaggaagggcattcactatctacagagaccaacgaccaaagaactctactgtttacagaacatgaccnggcctgacgacgccgaggacgtcggcttcgtacttattctggtcgacggtagacggtagggccttaggttttcggacgttgtaacctttccttaccccgtttgtacgtttgggtaccgggg

SEQ ID NO: 74676 - DNA, 559 bp, Homo sapiens
  misc_feature: GYAE6OF01DC0NY.36.76.G10.1.454.CMB.1.raw
  modified_base (337)..(337): a, c, t, g, unknown or other
  misc_feature (337)..(337): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtctggggggaggcttgggtccagcctgggggggtccctgagactctcctgtgccagcctctggattcacctttagtaactattggatgagttgggtccgcctggctcaggtaagggcctggagtggtggcaacatacngccggatggaagtgagaaacactatgtggagtctggtgaagggccgattcaccatctccagagacaacgccaagaactcactgtttctgaaaccatagaccagcctgacagccgagggactcgggctcgtctacttatcgtgtacggacgaaggacgggtctcggtttttagggacgttaggtactttaccttccccttttcggtccgttcgttcggggggg

SEQ ID NO: 74677 - DNA, 783 bp, Homo sapiens
  misc_feature: GYAE6OF01E1OX1.36.76.G10.1.454.CMB.1.raw
  modified_base (267)..(267): a, c, t, g, unknown or other
  misc_feature (267)..(267): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaagttggggctgagcttgggtttttccttgttgcttattttagaaggtgtccagtgtgaggtgcagttggtggagtcgtgggggacggtcgttggtccgaggccgtggggggtccctgagtacctctccgtggtcgacncgtcctcgtggtactttcctacctttagcagtctagtggctgtggacgtcggttcgggtacccggaccgtacgggtttaccggaagggggtaacggacgtcggacgtaggttcggggttacctacgtacgttacgttagttaggtcgtacggttagggtcggttacggtaaccttactacgtttaccgtacgtacccaacggtacccgttcccggtaggggtacccggggttcccgttaaccaaccctacttcccgtacgaacggtaactaaccgtaaccttaccgaaggtaccgtaccgaaccgtaccgtttacgttaaccttaacgtaaactaaacgtaaaccgtaacccgtaaacgacggaacgggaaccggtaccggaaccgtaaccgtacccgggttaactttacgtttaacgtacgttcggaacgttactaaacgtttacttccgtaacggtaccgtaccggttaacgtacccctaaccgtccccgttttacccgttagtttaacccggg

SEQ ID NO: 74678 - DNA, 855 bp, Homo sapiens
  misc_feature: GYAE6OF01C81M8.36.76.G10.1.454.CMB.1.raw
  modified_base (695)..(695): a, c, t, g, unknown or other
  misc_feature (695)..(695): n is a, c, g, or t
tcagtacgctgtctcacgaccggtgctcgatttagtcactcatacaggggtcagagaggagccttagccctggactccaaggtccctttccacttggtgatcagcactgagcacagaggactcaccagtggtaggtttgggctggagtcgtggttctttttcgttgtggtacttaagttttaaaggtgtcctaggtgtggaggtgcagcgtgtcgtgggtaggtcggtgggggagtcgtaggtacgcggggtccggggtctgacgtcgtccgtacgtgtacgacgtccgtacgttaggtactttccgtaaccgtttagaaccgtaaggttcggtaccgtaccgttacggtacccgggtacccggttccggggtacccgtccggtaccggtaccccggtaccgggaacggggggtacgggttccggtaagggggttacgggttacggttaccgtttaaccggtttaagggttttaaggttaaggggtagggtttaagggttacgggttaacggtacgaacccgttaagaacggtttaacgttaccgaacgtaacggtacccggttaaacgggttcgggtaaacccggggttcccgttaaccgaccgttaaccgttaccgtaccgtaaccgtaacgtaaccgtaaccgttaccgaaacgacgtaccgtaggtactttagtaccgttacgaaccgtanaaggtaccgaactacggtaggtaacggacggtacggaaccggtacgaaccggtaaccgtacgttaacgttagttaattacggtagttaccgtaacgtttaacctttggttacgttagttaccgtttactaccggttacgtagtccgcgtacggtaccggg

SEQ ID NO: 74679 - DNA, 760 bp, Homo sapiens
  misc_feature: GYAE6OF01CAWLC.36.76.G10.1.454.CMB.1.raw
  modified_base (188)..(188): a, c, t, g, unknown or other
  misc_feature (188)..(188): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaagttgggctgagcgttgggttttccttgttgtcttagttttagaaggtgtccagtgtgngtgcagttggtggagtcgtggggagtcgttggtccagccggtgggggtcctggagtctctcctgtgcacgcctcgtggtacttctacctttaagtaactagttggatggtacgtttcgggtccgtccgtggcctaccggtaagggtacggccgtagggacggtggggtcgaccaaacgtataacgaggaccggtagtgggaaacgtggaaacgaaaactacgtaagtggtggtaaggtctagggtacggaacgggtaccgtacttaccgaacctaacgttcctaccgacggaacgaaccgaaaccgtaacccgaaacgtaaccgttaccgtaacgttacgtttacctaacggtaaacctacgtacggtaacccacggacccgttaggaaccggtacggaaccgggacgggttacccgtacccggtcttacccgttacttaacgtttaccgtaggttcgggaacgaaggggtaacgtaacggggttaccgtttcggttttaacgggaacgttacgttccgttttaccccgtttaccccgttttagggtaccggttttcggggtaacccggggg

SEQ ID NO: 74680 - DNA, 782 bp, Homo sapiens
  misc_feature: GYAE6OF01C4XUF.36.76.G10.1.454.CMB.1.raw
  modified_base (120)..(120): a, c, t, g, unknown or other
  misc_feature (120)..(120): n is a, c, g, or t
  modified_base (208)..(208): a, c, t, g, unknown or other
  misc_feature (208)..(208): n is a, c, g, or t
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (335)..(335): a, c, t, g, unknown or other
  misc_feature (335)..(335): n is a, c, g, or t
tcagtacgctgtctcacgaccggtgctcgatttagtcactcatacgaggggtcagagaggagccttagccctggactccaaggcctttccacttggtgatcagcactgagcacagagacncacagtggaagttggggctagagtcgtttggggtttttccttgttggtactttagtttttaggaaggtcgtccgaggtgtggaggtgngtaggttggtggagttcggtgggggagtcgttggtccaggtccggtcgggggtccctggacgtactctctgcgcncgtccngtgtcttactacgtttaanaacttagtagagtgtacggttcggccncgtggccttacggaagggtacggccgtgggagggtgggtgaccaatacgtaacggacggtacggagtagggaacgtaggaaacgaacctaggttaagtcggtaggtagttccgtggtaacgggacccgggtacgtacttaccgaaccttacgtaccgtaaccggaagaaccggaacccgaaaacccggttaacaaaacggtaaccctttcgttaaacccgtttcggtttaacctagaaacccgtagttaccggaacccgtaccgtacgacggtaaccggaccggaaccccggaagggtccccgttaccggtcctttaaccggttacttaagttccggttcggacggtaggtaacggtacggggtacgtttacctcgggtttaaagggttgttaccgtttcccgttacccgttttacccgttaggtcccggtttagggggaacccggg

SEQ ID NO: 74681 - DNA, 763 bp, Homo sapiens
  misc_feature: GYAE6OF01BS309.36.76.G10.1.454.CMB.1.raw
  modified_base (268)..(268): a, c, t, g, unknown or other
  misc_feature (268)..(268): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctggagcgttgggttttccttgttgcttagttttagaggtgtccagtgtgaggtgctaggttggtggaggtcggtgggggaggtcgttggtccaggccgtcgggggtccctggagccttcctccgtgtcgcngcctgtgtacttcctacgtttacgtactagttggtagtggtacggttcgggtcccgtccgtcggccgtaccggagggtaacggtccggtgggtggtgggtcggaccaacgtacgtacgacggcggagtaggaagtagaagaaactagtagtggtaggtagtcgtaggtacggaggaccgtacgttccactcgttacctaccgaaggaaccaaccgaccgaaccgtaaagtaccctacgttaacgtttccgtttacgtaacgaaaccttcgtaaccggaacctacggtaccgtagggtaacgaccgggacccggtaacggtcccggttaccgtccgtttacccgttacgtttacgtttaccggtcgtaccggtaagggaacggttacgggtacggtttaccgtttaccggggttttaggaacccggttcgtttaccgtttttcccccgtttaacccccggtttcgggtttaaccggttcggggggtaaccccgggg

SEQ ID NO: 74682 - DNA, 869 bp, Homo sapiens
  misc_feature: GYAE6OF01DNB7T.36.76.G10.1.454.CMB.1.raw
tcagtacgctgtctcacgaccggtgctcgatttagtcactcatacaggggtcagagaggagccttagccctggactccaaggccctttccacttggtgatcagcactgagcacagaggactcaccagtggaattggggctgagcttgggttttccttgttgcttatttagaaggtgtccagtgtgaggtgctaggttggtggacgtcggtgggggagcgttggtccaggccgtggggggtccctggagtactcctcctggtgcagtcctcgtaggtattcctacctttaagtaacttagttggaattggtacggtttcgggtcccgtccgttggccgtacccgaaggggttaacggggtccgttaggggtacgggttcgggggtacggtaccccgtaaacgtaacgtaaccggacgggtaacccgggtaggtacggggtaaaggttacggaaaaccggtaaaaaccgtaaccgtttaaggttacggggtttaggggttaaacgggtttccggttaggggtttaacggggaaaccgggggtccccggtttaaacgtttaccccgaacccgtttaacgtacccgttaacccggaacggtaaccggaaccgtaaacccggaacccgtaaacgtaacccttacgtaaccgtttacgtttacgttaacggaacctacgtaccgtaacccgtacggtacccgtagggaacgacggaccggtaacggtccgtccggttacttccgttacttaacgttacgttaggtaccgacggtaaggtacgggtagggttaccgttaacggttttagggtacgttacgtttaccgtttaccccgtttccccggtttaggtccggtttcgggggtaacccggggg

SEQ ID NO: 74683 - DNA, 679 bp, Homo sapiens
  misc_feature: GYAE6OF01DCELJ.36.76.G10.1.454.CMB.1.raw
  modified_base (202)..(202): a, c, t, g, unknown or other
  misc_feature (202)..(202): n is a, c, g, or t
  modified_base (340)..(340): a, c, t, g, unknown or other
  misc_feature (340)..(340): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtcngggggagcttggtcaggcctggggggtccctgagactctcctgtgcagcctctggattcactttagtaactagttggatgagttgggtccgcctggcctccgagggtaacgggccgtgggaggttgggtggacccaanagtacgagaccggagtaggagtgaagaaacagtatggtaggatgtaggtgaacgggccgatttccacctactcgtaccagacgaacctaacgaccaaacgtaacactacttagtttactagaactacgtacgaaccgacgtacctgaacgacgaccggaacgggtaccgtaccggtccgttacgtacttaacgtttacccttaggtcggtaccggaagggtaacgggtacgggttaccgttacgggttttttacgggtacggttacgggtttacccttttaccccggtttacccccgtttttaacgggtttacccggtttggggttaaccccggggggg

SEQ ID NO: 74684 - DNA, 801 bp, Homo sapiens
  misc_feature: GYAE6OF01BGB7H.36.76.G10.1.454.CMB.1.raw
  modified_base (787)..(787): a, c, t, g, unknown or other
  misc_feature (787)..(787): n is a, c, g, or t
tcagtacgctgtctcacgaccggtgctcgatttagtcactcatacgaggggtcgagagaggagccttagccctggactccgaaggccctttcacttggtgatcagcacgtgagcacagaggacctcaccgtagtgggtaagttggggctggaggtcgtttgggtttttaccgttggtttgacgtttaagttttaaggacggttcgtccgtaggttggtaggtacggttgcgtaggtttgggtggtagttcggtgggggtagtccgttcggtccgaggtccggtcgggggttcctggactaccgtcgtccgtggtcgcgacgtccgtggtaggtaccttacttaaccgtttagtaacttagttcgggtatggtcgttcggtccgtgtccggtcgtaccggtaaggtacggtcgtggaccggtgggtaacgctaaagtacgacgacggtacgtagtaacggtaggtaaacgaaccggttaaaaataccgggtagttacggggtacgtaacggtttcggttaccggggtaagggtaaccgggttaccgttaaactaccccggaagttttcccgaaccgttaccggaaacggtaaccggaaccgtaaacccggaacgtaaaacgttaaccgtacggttaaactttccggttaaccgtaacgtacttaaacgcgtaacgtacgttacccggagtaacggaccgtacggtaaccgtaacggtctactaccgttactagtacgtcgagggtcgaccgtaggtcgtgtaacgttgcttacgtcgttaccttcggngttcgtggtaccgg

SEQ ID NO: 74685 - DNA, 743 bp, Homo sapiens
  misc_feature: GYAE6OF01AJGZT.36.76.G10.1.454.CMB.1.raw
  modified_base (332)..(332): a, c, t, g, unknown or other
  misc_feature (332)..(332): n is a, c, g, or t
tcagtacgctgtctcacgaccggtgctcgatttagtcactcatacaggggtcagagaggagccttagccctggactccaaggtcctttccacttggtgatcagcactgagcacagaggactcaccatggaagttggggctgagtcgttgggtttttccttgttgtcttaagttttaaggaaggtgtcctagtgtggacgtgcaacgtgggtggagtcggtgggggagtcgttggccaggccggtcgggggtccctgacgcctctcctgtcgcacgccttgtggtacttactaacgtttggagtcgttagttggagtggtacgtcgggtcccncgtacgttccgaccggaggggaacgggtcgtgggtagggtcgggtacgaccctaagagtacggaggggtaggtaggtacggtaaaacgtaaaacgtgtaggtacggtacgtcgttggtcggggaccggggtcccgtacgttacccaccgtaccgtaccgtaccgaacggtaaccgaaaccgtaaccccgaaacctaaaaccgttcctaaccgtttagtaaccgttacgtaccgtaacgtaaaggtaccggaccggtacccgtggtaacgaacgttacccgggaaccggaccgtacgggtaccgttaggttaacgttagtttaacggttgggtaccggtaagggaacgttaagtaacgtttaacgtaacgtaacgtttaggtcgtaggtacgtagtagtagtgattgtatag

SEQ ID NO: 74686 - DNA, 790 bp, Homo sapiens
  misc_feature: GYAE6OF01A5Y5X.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagcttgggttttcctgttgcttattttggaaggtgtaccagtgtgaggtgcaagttggtggagtcgtgggggagcctcgtccacgtccgtcgggggtccctgacgtactctccgtgtgtacgcctcgtggaacttccaacctttaaccaacttacgtggtacttcggtccgtcgggtacccgccgaggtcctaccggaagggggtaagggcctagggaaggttcggggtcggaccctaacgtagtagtaacggaccgaggtagtacggtaacgacgaacgaactagtaacctagtggacggcttcggtacggtagggaaccggtcctaacgttacccacctacttccgaccgtaaggaacccgtacacccggacccaccgtaaactccgtaaacccgtcttaaccgttgttaaccctacggtaactaaccgaaaacgtacggtaaaccccgtaacgtcccgggtaaggaaacccgggtaaccgaccccggaaagggttcccctaaccggggtttacttttaacgtttaaccttttaccgggtcggtaacgggacggttaaagggaacggggttacccggggttaacctttttaggggtttacggggttatttacccgggtttaccttcccggttaaccggtttaaccccgg

SEQ ID NO: 74687 - DNA, 972 bp, Homo sapiens
  misc_feature: GYAE6OF01C6JF4.36.76.G10.1.454.CMB.1.raw
  modified_base (176)..(176): a, c, t, g, unknown or other
  misc_feature (176)..(176): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaagttggggctgagcgttgggttttccttgttgcttatttagaaggtntcctagtgtgagtgctagttgggtggtagtcggtggggaggtcgttggtccgacggtccggttcgggggggtccctaggagtaccgtccttccgtggtcgcacggtcctgttggtactttacccttaaccgttttaaagtaacgttatttagggagtaggtaggtttccggggttcccgcccggttcgggtccgtaccgtaagggggttaaccgggtccggtaggggtagggttcgggggtccgtaacccaaaacgtactaacggacggaccgggtaacgtagggtaaagtaaggaaacgttaaaaccgtacgttaagttagggtacggttaagtcggtttaaggacgggtaaacgggccccggtttaaatttacccgacccgttacgttacccgtaacccgaaacggaaaccgaaacccgaaaacccggacccgtaaaaacggttaaccctaaccgttaaccgtttacgttttaaccaacggtaaaccttacggtaaccccggtacccgtaaccggttaccggaggaaaacccgggtacgggtaaccccggggtaacggtcccggttacccggtccccgttttactttacccgggtttaaactttcgggtaacccgggtttcgggaacggtaacgggggtaaacggggttaacccggggtttacccgtttaaagggttttttacgggggtaaaccctttttcggggttaaaacccccgttttttccccggttttacccccggtttttaaccgggggtttcggtttccccggggggtttaaaacccccgggggggg

SEQ ID NO: 74688 - DNA, 945 bp, Homo sapiens
  misc_feature: GYAE6OF01B4Q3M.36.76.G10.1.454.CMB.1.raw
  modified_base (644)..(644): a, c, t, g, unknown or other
  misc_feature (644)..(644): n is a, c, g, or t
tcagtacgctgtctcacgaccggtgctcgatttagtcactcatacgaggggtcagagaggagcttagccctggactccaaggtcctttccacgttggtgatcagcactgagcaacagagactacacagtgtagttgggctgagtcgttggttttccttagttgtacttagttttacggaaggttcgtaccgtaggttcgtggtaaggttcgacgttagggtttggggtacgggtaggttcgggttgggggggacgttccgttttacgggtcccacggggttcccgggttcggggggttcccctaggtaacggtcccttccgttccgtaggttgacccgtgtcccgttaggtacggttactttacccgttaagtttttaacgtaaacgttgttaaggtaaccgttgggtacgggttttccgggtaacccttcggacgttccggtaccgacgggttaaccgggtctaggggttacggtcggttaccgggacctaaaaacgtcgtaacccggtaaagggtcccgggtaaaagtggggttaaacggggttaacgaaaacccaaaacggttacgttaaggttcggggttaaggtacggttacgttcggggtaaaccgggaaggggtcccttaaactccggttaaacccnggttaacccgtacgaaaacggacttaacccgaaaacggaactaaaccggttaacgtaaccgttacgtttaaccggtagttaaccgaaaccgtaagttaccgaccgtaaggtacccgggttacgaaacggcccggggttaaacggacccgggttaaaccgtgggtacccttacgttaacgttaaccgttcggaccgtaccgggtaggtaacccggtgggtaccgggtactttacggggtttagtaaccgttcgtttacctaccccggtttcgtttacgtacccgggttttcggtaacccggg

SEQ ID NO: 74689 - DNA, 699 bp, Homo sapiens
  misc_feature: GYAE6OF01CGI1M.36.76.G10.1.454.CMB.1.raw
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (190)..(190): a, c, t, g, unknown or other
  misc_feature (190)..(190): n is a, c, g, or t
  modified_base (447)..(447): a, c, t, g, unknown or other
  misc_feature (447)..(447): n is a, c, g, or t
  modified_base (608)..(608): a, c, t, g, unknown or other
  misc_feature (608)..(608): n is a, c, g, or t
tcagtacgctgtctcacgaccggtgctcgatttagtcactcatacaggggtcagagaggagccttagccctggactccaaggtcctttccacttggtgatcagcactgagcacagaggactcaccagtggaagttgggctgagcgtggtttcctgtgcttattagagtntcngtgtgagtnanggttggngagtcgtggggagtcgttcggcacggtcggttggggtaccctggacgtactccgtcgtgtggctcggtcctagtaggtacttacctaaccgttttagaaattgttacgagtcggtacggttccgggacgtccgttagccgtaccggaagggttaccggccgttagggacgggtttacggggtctaacccgaagttaacgacggtacgggaccggtaggtacggtaaaggacggaaataaaaccgtgtaaggttaggngtaactcggtagttaccgggaaggtactcttaacgacctacgttcaacgagaacgacgaaccgacaaagtctacctagttcttaacacgttacgacgtacgactacgcgtaacggagtaccggacggtaccgtacgtacgtctacgttacttaagtaccgnttacggacggagtacgggactttacggtcgttaacggtgttaaccgttcgtttacccggttcgttaacgggttggtaacgggttcccgggg

SEQ ID NO: 74690 - DNA, 717 bp, Homo sapiens
  misc_feature: GYAE6OF01BVU3S.36.76.G10.1.454.CMB.1.raw
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (665)..(665): a, c, t, g, unknown or other
  misc_feature (665)..(665): n is a, c, g, or t
tcagtacgctgtctcacgaccggtgctcgatttagtcactcatacgaggggtcagagaggagccttagccctggactccaaggcctttccacttggtgatcagcactgagcacagagactcaccatggaattgggctgagcgttggttttcctgtgacttagtttagaggtgtccgagtgtgacggtgctaggttggtggagttcggtgggggacggtcgttaggtcccaggtcccggttcgggggtccctgacgtcctctcgtagtgccagtcctgtggtacttactaccgtttaagtaacttagttgntacgtaggttcggtccncgtacggcctaccggaggtaacggcctagggtacggttgggtcgaaccaacacgtacgtacggcggtaagtagggtaagtacgaaagtaaacctataggttggtaggtaccgtagtcgggttaaggaacgggtcctacgtacccgtacgtaacgttccgtacgtaacgtaaccgaaccgtaaccgaaccctaaagtaccttacgaacgttttcgttaacgtacgtaactagtaccggacctacggtaccgtaagacggaacggaccgacgttccggacgttctacgtacttacgtagtcgtagaacggtgtacgggtacggttacgttcggtttaagngtttaacgtcctttaacccgtttcccgttaggttcggtcggtaaccccgggg

SEQ ID NO: 74691 - DNA, 796 bp, Homo sapiens
  misc_feature: GYAE6OF01C451P.36.76.G10.1.454.CMB.1.raw
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagcttgggttttccttgttgctattttagaggtgtccagtgtgaggtgctagttggtggagtcgtgggggagcttggtccaggtccggtggggggtcccctggacgactctccgtgtgcagtcctntggtacttctacctttagtaactagttggatgtaggttggtccnccgtggcctaccgaagggtacgggcctgggaggtgggtcggaccaaacgatacgaggtccggtaagtagggaagtagaaacgtaaaacacgttacgtaggtacggtaacgtcgttagggtacgggaaacgggtcccgttaagttacccaaccgttagttaccccgtaccgtaaaggaaaccggaaacccgaaacccggtacccgtaaaacgtaaaccccgttaccgttaaccgtttaccgttttaccgtaacggtaaacctaaggtaccggtaacccacggtaccgttacgggaacgaaccgggtacccgggaacgggtaccgttacccggtactttaccggttacttaacgtttaccggtcggtaccggtacggtaacgggacgggtacgggtttcctttaaaccgggttttgggtaacgttacgttaccgttttcccccgtttacccgggtttttacggaaccggttttcgggggtaacccgggg

SEQ ID NO: 74692 - DNA, 533 bp, Homo sapiens
  misc_feature: GYAE6OF02IT3V4.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagcttggttttccttgttgctattttagaaggtgtccagtgtgaggtgcagttggtggagtctgggggaggcttggtccagcctggggggtccctgagactctcctgtgcagcctctggattcacctttagtaactattggatgagttgggtccgcctggctccaggtaagggcctggagtgggtggccaacatacagccggatggaagtgagaaacactatgtggagtctgtgaagggccgattcacatctcagagacaacgcaagactcactgtttctgaacatgaccagcctgagagccgaggacgtcggctctctattactgtgcgaggaggacgggctacgttttggagttggtactttccgttcccctttggtaccttggtaccgggg

SEQ ID NO: 74693 - DNA, 548 bp, Homo sapiens
  misc_feature: GYAE6OF02GITYH.36.76.G10.1.454.CMB.1.raw
  modified_base (498)..(498): a, c, t, g, unknown or other
  misc_feature (498)..(498): n is a, c, g, or t
tcagtacgctgtctcacgaccggtgctcgatttagtcactcatacaggggtcgagagaggagccttagccctggactccaaggcctttccacttggtgatcagcactgagcacagaggactcaccatggaattggggctgaggctggggttttccttgttggtctattttagaaggtgttccagtgtgaggtgcagttggtggaggtcgtgggggagggcttgggtccgagccgtgggggggtccctggagactctcctgtgcagcctctggattcacctttagtaactattggatgagttgggtccgcctggctccaggtaaggccgtagggaggtggggtggccgaacgactaacagcccggatgggaagtgagaaacactatgtggagtctgtgagggcgagttcacatctcagacgacaacgccaaagaactcactgttctgaacatgaccagcctgagagccgaggacgtcggctctctattactgtgcgagnggaggcgtacttttggagttgtacttcctccctttgaccttggtccgggg

SEQ ID NO: 74694 - DNA, 529 bp, Homo sapiens
  misc_feature: GYAE6OF02I9WUL.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtctgggggaggcttggtccagcctggggggtccctgagactctcctgtgcagcctctggattcacctttagtaactattggatgagttgggtccgcctggctccgaggtaagggcctggagtggggtggccaacatacagccggatggaagtgagaaacactatgtggagtctgtgaagggccgattcaccatctccagagacaacgccaagaactcactgtttctgaacatgaccagcctgagacgccgaggactcggctctctattactgtgcgaggaggaggctacgtttggagtgtacttcctccccgtttgtacgttggtcgggg

SEQ ID NO: 74695 - DNA, 535 bp, Homo sapiens
  misc_feature: GYAE6OF02GZCXW.36.76.G10.1.454.CMB.1.raw
  modified_base (358)..(358): a, c, t, g, unknown or other
  misc_feature (358)..(358): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagcgtggtttcgtgttagctatttagaaggtgtccagtgtgaggtgcagttggtggagtctgggggaggcttggtccagcctgggggggtccctgagactctcctgtgcagcctctggattcacctttagtaactattggatgagttgggtccgcctggctccgaggtaagggcctgggagtgggtggccaacatacagccggatggaagtgagaaacnctatgtggagtctgtgaagggccgattccgaccatcctccagagacaacgccaagaactcactgtttctagacatgacagcctgagacgccgagcgtcggctctctattactgtgcgaggaggagggctacgtttaggagtggtacttccttccccgtttgtaccgttggtacgggg

SEQ ID NO: 74696 - DNA, 705 bp, Homo sapiens
  misc_feature: GYAE6OF02GJC9C.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagcttggttttccttgttgctattttagaaggtgtccagtgtgaggtgcagttggtggagtctgggggaggcttggtccagcctgggggtccctgagactctcctgtgcagcctctggattcacctttagtaactattggatgagttgggtccgcctggctccgaggtaaggcctgggaggtgggtcggaccaagtactacgacggccggagtaggtaagtaggaaacgaaacacttagtggtaggtagtcgttaggtagggaacgggccgtagttaccaactatccctacgagaacgaacctaacccgaaccgaaacgaaccctactaccgtttacgtttctaacgaaccgttagtacccgaacaccgtaccgtacggaacgaccggaccggaacggttaccggtccggtaccgtttcctaacgtttaacttaccgttaggttccggacgggtaacgggtaagggaccgggttaccgtttaacggtttttagggaagtttcggtttaaccttttcccccgtttaccccgttttaggttcccggtttagggggttacccccggggg

SEQ ID NO: 74697 - DNA, 564 bp, Homo sapiens
  misc_feature: GYAE6OF02FZUQG.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtcgtggggggaggcttggtccagccgtggggggtccctgagactctcctgtgcagcctctggattcacctttagtaactattggatgagttgggtccgcctggctccgaggtaagggcctggaggtgggtggccaacatacagccggatggaagtgaagaaacactatggtggagtctggtaggaagggccgattccaccatcctccagagacaacgaccaaagaactcacttgtttctagaactatacgaccacgtcctgacgacggccgaggaccgtcggcctctacttattactgtcgcgaggaggagggtcttacgtttggagttgtactttccttcccgtttgtacgtttcggtacgggg

SEQ ID NO: 74698 - DNA, 719 bp, Homo sapiens
  misc_feature: GYAE6OF02GBCDM.36.76.G10.1.454.CMB.1.raw
  modified_base (331)..(331): a, c, t, g, unknown or other
  misc_feature (331)..(331): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtcgtgggggaggcttggtccaggccgtggggggtccctgagactctcctgtgcagcctctggattcacctttagtaactattggatgagttgggtccgctggctccgaggtaggcctggagtgggtgccaanatacagccggatgggaagtgaagaaacactagtgtaggagttcgtagtagaaggggtcccgtatttccaaccgtatcctacccgaaggaacgaacccaaaccggtacccaaaacggtaaaccctacctaaccgttgttttaccgtaacgtaaacctaagttacggaacccgagtacccgtacggaaggtaacggacccgggtagggaacccgttccgggtaccttaccgttaccgtttaagtttacccgttggttacggaccggtaagggaacgggtaacggggtccttaaccgggttttttagggaacggtttacggttaaccgtttttccccggtttacccccgtttttacgggttaacccggttttcggggttaaccccgggggg

SEQ ID NO: 74699 - DNA, 528 bp, Homo sapiens
  misc_feature: GYAE6OF02FN2FV.36.76.G10.1.454.CMB.1.raw
  modified_base (352)..(352): a, c, t, g, unknown or other
  misc_feature (352)..(352): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (408)..(408): a, c, t, g, unknown or other
  misc_feature (408)..(408): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtctggggggaggcttggtccaggccgtggggggtccctgagactctcctgtgcagcctctggattcacctttagtaactattggatgagttgggtccgctggctccgaggtaacgggcctggagtgggtgccaacatacagccggatggaagngagaaacactatgtggagtctgtgaaggccgatcaccntcncagagacaacgcaanactcactgttactgaacatgaccagctagacgagccgagacgtcgctctctattactgtgcgagaggaggctacgttttggagttcgtactttccgttacccgtttcgtcgttggtcggg

SEQ ID NO: 74700 - DNA, 570 bp, Homo sapiens
  misc_feature: GYAE6OF02JVKWK.36.76.G10.1.454.CMB.1.raw
  modified_base (500)..(500): a, c, t, g, unknown or other
  misc_feature (500)..(500): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtctgggggaggcttggtccagcctggggggtccctgagactctcctgtgcagcctctggattcacctttagtaactattggatgagttgggtccgcctggctccgaggtaacggcctggagtgggtggcccaacgatacgagccggatgggaagtgaagaaacacgtatggtaggacgtctggtaggaacggggtccgattcacctatcctcccgagacgaacaacgaccaaagaacctcacttgttcagaacatacgacctagcctagagacgccgagacctcggctctacttacttcgngtgacgaggagacgggtctaacgtttggagttcgacctttccgttcccgtttgtaccgttggtaccgggg

SEQ ID NO: 74701 - DNA, 528 bp, Homo sapiens
  misc_feature: GYAE6OF02I7JZ8.36.76.G10.1.454.CMB.1.raw
  modified_base (339)..(339): a, c, t, g, unknown or other
  misc_feature (339)..(339): n is a, c, g, or t
  modified_base (434)..(435): a, c, t, g, unknown or other
  misc_feature (434)..(435): n is a, c, g, or t
  modified_base (474)..(474): a, c, t, g, unknown or other
  misc_feature (474)..(474): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgtgctattttagaaggtgtccagtgtgaggtgcagttggtggagtcgtgggggaggcttggtccagccgtggggggtccctgagactctcctgtgcagcctctggattcactttagtaactattggatgagttgggtccgcctgggctccaggtaacgggcctggagtgggtggccaacatacgngccggatggaagtgagaaacactatgtggagtctgtggaacgggcgattcaccatctcagagacaacgcaagactcactgttctagaacatgacnncctgagagcgagctcggctcgtctattactgtgcgaggnggacggcttacgtttggagttcggtacttccttccccgtttgtcgttgtcgggg

SEQ ID NO: 74702 - DNA, 661 bp, Homo sapiens
  misc_feature: GYAE6OF02IBEXG.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtcgtgggggaggcttggtccagccgtggggggtccctgagactctcctgtgcacgcctcgtggattcctaccttttagtaacttattggatggtagttcgggtccgccgtggcctccgagggtaacgggccgtgggaggttgggtcggacccaacagtaccgacggacccggagtagggaagtgaagaaactactagtggtaggagtcgtgggtagaacgggccgtattccgaacctatcctaccacgaacgaacgaaccgaccgaaacgaactacctacgttacgtttacgttacgtaactaactaccgaaccgacgccgtagtacggaacggtaccggacgggtaccgtaccggtccgtccttacttactttacgtgtcgacggaggaggtacgggtcgttaaaaacgtttggtaggttacgtacgttccgtttcccgtttcgttacgttcggtacgggg

SEQ ID NO: 74703 - DNA, 845 bp, Homo sapiens
  misc_feature: GYAE6OF02JNLZR.36.76.G10.1.454.CMB.1.raw
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggtttccttgttgctattttagaaggtgtccagtgtgaggtgcagttggtggagtctgggggaggcttggtccagccgtggggggtccctagagactctccgtgtgcagcctcnggattcacctttagtaactnttggatgtagtggtccgcttggctccgagggtaacgggccctgggaggtggggtcggaccaaacgtattacgacggccccggggtaatggggtaaagtaggaaacgtaaaaccgtacttaaggttgggtaggtacggttcgttagggtacgggtaaaagggggtcccggtaattttcccgaaacccgtagtttccccgttaaccgaacgggttaaaacggtaaacccccgtaaaaccgggtaaaccccgaaaagggtaaaacccgtttccctaaacggttttcccgggttttttaaaccacgggttaaaaacccctaggtttaacgggaaacccccttacggtaaccccggttaggaaacgggtaacccggtacccgggaaaccgggtaacctttcccgggacccttttaccgtaaccgttttaaccgtttaaccgttcgggttaacgggccggtaaaaggaccggggttaacgggttacccttaacggttttttggggaaacggtttcgttaaccgttttcccctttacccccgggttttaagaccgtttttgggggaccccgggg

SEQ ID NO: 74704 - DNA, 708 bp, Homo sapiens
  misc_feature: GYAE6OF02FPIYZ.36.76.G10.1.454.CMB.1.raw
  modified_base (359)..(359): a, c, t, g, unknown or other
  misc_feature (359)..(359): n is a, c, g, or t
  modified_base (502)..(502): a, c, t, g, unknown or other
  misc_feature (502)..(502): n is a, c, g, or t
  modified_base (537)..(537): a, c, t, g, unknown or other
  misc_feature (537)..(537): n is a, c, g, or t
  modified_base (548)..(548): a, c, t, g, unknown or other
  misc_feature (548)..(548): n is a, c, g, or t
tcagtacgctgtctcacgaccggtgctcgatttagtcactcatacagggggtcagagaggagccttagccctggactccaaggcctttccacttggtgatcagcactgagcacagaggactcaccatggaattggggctgagcttgggttttccttgttgctattttagaaggtgtccagtgtgaggtgcgagcttgggtggtagttcgtgggggggaggtccgtgggtcaaggcccggttcgggggggttcccctggaagaccttcctcccgttgtcggccacggtcccttcgtaggtacttcctacccctttcgaagttacgccttaatagcctattggaaacgttcgggggtcccnccgaggcctccggaagggggaaggggtccgtagggacggtggggtctcgtacttcgtaagttagtaggtaagtagttaacgttacattaacttaccgtacgcagtactcgaggtaggaaccgggcgttacttcgacctatccnccagaacgacaacgaccgaaagtactacctacttntaacctcgtanaacctaaataggaacctagaccgtaggacgtacgaccgggtaggaccgtaccggacgttagttaccgttaacgtttccgagggttacgggtaacgggtacgtacgttacgttaagttttaaggttttggaaccgtttttagggtttaccctttaaccccg

SEQ ID NO: 74705 - DNA, 986 bp, Homo sapiens
  misc_feature: GYAE6OF02I5RYR.36.76.G10.1.454.CMB.1.raw
  modified_base (185)..(185): a, c, t, g, unknown or other
  misc_feature (185)..(185): n is a, c, g, or t
  modified_base (218)..(218): a, c, t, g, unknown or other
  misc_feature (218)..(218): n is a, c, g, or t
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
tcagtacgctgtctcacgaccggtgctcgatttagtcactcatacagggtcagagaggagccttagccctggactccaaggcctttccacttggtgatcagcactgagcacagaggctcaccatggaattgggctgagctgggttttacctgttgctattttagaaggtgtccagtgtgaggtgnagttggtggagtcgtgggggagtcttggtaccnggccgttggggggtaccctgagtactcgtcctgttgacgtacgtccctcgtaggtactttaccaccgttttaaggtaaaccttagttgggaagttcggtaaggtttcgggggtccctccgttacgggccttacccggtaaggggtaaccgggccggttaggggtaaggttcggggtaccggtaaccctaaacgaaacgttccggaccgggttaccggtaaggtacggggttaanaagggaacctaaaaaccgtntttaggtaggggttacggtaaattccggtttaggggaacggggtaaacgggtcccctttaaaagtttcccccggaaaaccctttgttaccccgttaacccggtaaacgggtaaaccgaaaaaccccggtaacccgttaaaacccggggaaaaactttaaaaccgggttaccccttaaccgggttttaacgttttttaaacccggaaacggttaaaacccttaacggttaacccccgggtaaacccggaacgtacccccggtttaaagggtaccgggaaaaacccgggtaccccggggtttaaaacccggggttcggtaccccgggttttaaaccccgttccctttaaaggttaaaaccccgttttttacggtccgggttaaccgggacgggttttaaaacgggcggggtttaaccgggttacccggttaaacggttttcgggacgttttaacgggtcctttttaccccggttttacccggtttacggtttagggtcccggtttaacccgggggg

SEQ ID NO: 74706 - DNA, 527 bp, Homo sapiens
  misc_feature: GYAE6OF02GB9OP.36.76.G10.1.454.CMB.1.raw
  modified_base (297)..(297): a, c, t, g, unknown or other
  misc_feature (297)..(297): n is a, c, g, or t
  modified_base (358)..(358): a, c, t, g, unknown or other
  misc_feature (358)..(358): n is a, c, g, or t
  modified_base (445)..(445): a, c, t, g, unknown or other
  misc_feature (445)..(445): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
tcagtacgctgtctcacgaccggtgctcgatttagtcactcatacagggggtctcagagaggagccttagccctggactccaaggcctttccacttggtgatcagcactgagcacagaggactcaccatggaattggggctgagctgggttttccttgttgctattttagaaggtgtccagtgtgaggtgcagttggtggagtcgtgggggagcttggtccagccgtggggggtccctgagactctcctgtgcagcctctggattcacctttagtaactattggatgagttggtccnctggctcgaggtaggcctggagtgggtggccaacatacagccggatggaagtgaagaaacnctatgtggagtctgtgaagggccgtattcgaccatcctcagagacaaccgaccaaacgactacacttgtttctagaacatacgaccngacctgagacgccgaggactcgctctcttatactgncggngagagggtctagtttggagtgtcttctcccgttgtattcggg

SEQ ID NO: 74707 - DNA, 615 bp, Homo sapiens
  misc_feature: GYAE6OF02GOPWI.36.76.G10.1.454.CMB.1.raw
  modified_base (546)..(546): a, c, t, g, unknown or other
  misc_feature (546)..(546): n is a, c, g, or t
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtcgtggggggagcttggtccagccgtggggggtccctgagactctcctgtgcagcctcgtggattccacctttagtaacctattggatgtagttgggtccgccgttggctccgaggtacgggcctgggaggtggggtggaccaacacgtacagcccggatcgggaagtagaagaaacactatggtggagtctaggtgaacgggcgtaattcaaccgatcctaccagagaaccaacgacccaaagaacctccgtacttacgttaccgaagaactagtacgaaccagtacccgtagacgaacgccggaggaccgtcgtcctcgtacgtacttcgtagtcggacgtaggnggacggtagttacgtttaggacgttcggtacttccgttacccgtttaggttaccggttggtacccgggg

SEQ ID NO: 74708 - DNA, 747 bp, Homo sapiens
  misc_feature: GYAE6OF02FYMPB.36.76.G10.1.454.CMB.1.raw
tcagtacgctgtctcacgaccggtgctcgatttagtcactcatacagggggtctcagagaggagccttagccctggactccaaggcctttccacttggtgatcagcactgagcacagaggactcaccatggaattggggctgagcttgggttttccttgttgcttattttagaaggtgtccagtgtgaggtgctagttggtggagtcgtgggggagcttggtccagccgtggggggtccctgagactctccgtgtgcacgccttcgtggattcctaccttttagtaacttattggaatggtaggtttcgggtcccgccgtggcctccgagggtaacgggccctgggaggttggggtcggacccaacgagtaccgacggccggatgggaagtgaagaaacactagtggtaggtaagtcgtaggtaggaacggggtccgtacgttccaacctacttccctaccgaaggaaccgtaaccgaaacccgtacccgaaaacgtaaacccttacctaaccgtttacgttttaccgtacgtaaactacgtacgaacccgtagacccgttagggaacgtaccggacccgggtaacggtacccgtccggtacctaccgttacttaacgtttacgttgttacggacggtaagggacgggtacggggtaccgtttaaccgggttttttaggggaacgtttacggttaaccgttttccccggtttacccccgtttttaggttaccggttttaccgggggg

SEQ ID NO: 74709 - DNA, 893 bp, Homo sapiens
  misc_feature: GYAE6OF02GB7O4.36.76.G10.1.454.CMB.1.raw
  modified_base (780)..(780): a, c, t, g, unknown or other
  misc_feature (780)..(780): n is a, c, g, or t
  modified_base (882)..(882): a, c, t, g, unknown or other
  misc_feature (882)..(882): n is a, c, g, or t
tcagtacgctgtctcacgaccggtgctcgatttagtcactcatacaggggtcgagagaggagccttagccctggactccgaaggcctttccacttggtgatcagcactgagcacagaggactcacataggaagttggggctggagcgttgggttttccttgttgacttattttagaaggtgtccagtgtgaggtgcgtaggttggtggtagtcggtagggggagtcgtttcgggtccaggtcccggttcggggggtccctaggtacgaccttctccgttggtcgccgtaaggtccctacggttcgtaactttcccgttaaaccgttttaacggttaaaacttaacggtttacggggaaattcggggtaacgggttttccggggtaccccgtccggttcggtacccgttacccgggtaaagggggttaaccgggtacccggttagggggtacgggttacgggggtcggaaaccccgtaaacgtacgttaacggaccgggtacccgggtaagttaggggaaacggttacgggtaaaaaccgtaacgttacggttacgggtacgggtacggttacggttacggggttaacggtaaacgggggtaacccggtaaccgtttaacccgtcccgtaaactaccggttaccgaacgtaaccggaaacgaaaccggaacccgaaacgtaaacccgtacttaacgtaccgttttacggtaacgtaaacctaacgttacgaaaccgtccgtaacgtacggtaacggaacggaccgaaccggtcggttaccnccggttactacttacgtaacgttagcgtacgagtacgggtaggtacgtcggttaaggtgtaccggttcgttacccgtttcccgttacgttcggtttaccggnggtaacccggg

SEQ ID NO: 74710 - DNA, 698 bp, Homo sapiens
  misc_feature: GYAE6OF02J0CGX.36.76.G10.1.454.CMB.1.raw
tcagtacgctgtctcacgaccggtgctcgatttagtcactcatacaggggtcagagaggagccttagccctggactccaaggcctttccacttggtgatcagcactgagcacagaggactcaccatggaattggggctgagctgggttttccttgttgctattttagaaggtgtccagtgtgaggtgcagttggtggagtcgtgggggaggcttggtccaggccgtggggggtccctgagactctcctgtgcagcctctggacttcactttataactattggatgagttgggtccgctggctcgaggtacggcctggaggtgggtggaccaacatacacggccggagtagggaagtgaacgaaactacgtagtcggtaggagttcgtagtacgggaaggggtaccgagtttaccgaccgtaacttaccgtaccgaaggtaacgaaacccgaacggacctaaaacggtaaccttcctaacgtttacgttttacgaacgtaaaccagttaccggaaccaggcccgttaggaacggacgacccgggtacggaaccgtccgggtacccttacgtaccttagtttaacccgtggtaggaccggtaacggtagggtaacgggtcctttaacgggttttacggaagttacggttacctttacccctttaccccggtttaggtacccggtttgggtaacccggggg

SEQ ID NO: 74711 - DNA, 834 bp, Homo sapiens
  misc_feature: GYAE6OF02HCM3Q.36.76.G10.1.454.CMB.1.raw
  modified_base (571)..(571): a, c, t, g, unknown or other
  misc_feature (571)..(571): n is a, c, g, or t
  modified_base (683)..(683): a, c, t, g, unknown or other
  misc_feature (683)..(683): n is a, c, g, or t
  modified_base (759)..(759): a, c, t, g, unknown or other
  misc_feature (759)..(759): n is a, c, g, or t
tcagtacgctgtctcacgaccggtgctcgatttagtcactcatacaggggtcagagaggagccttagccctggactccaaggcctttccacttggtgatcagcactgagcacagaggactcaccagtggaagttggggctggacgtcgtttcggggttttccttgttcgcgttaagttttagaaggttgtccaggttgtaggtaggtgtcgtaggtttgggtggtaggttcggtaggggggtcggtcgttttcgggtaccgagggtcccgggttacgggggggttcccctaggtaccggtaccttccgttccggttggtacggccgtacgtcccgttacgtgggttaacctttcccttaaaccgtttttaacggttaaacctttagggttaggtacgttacgggtacgggttttccggggtccccgtccgtaggtcccgtacggtaaccggggtaaggtccggtggggtacggttcggggtaccgtaaccgaagtccgtaaccggaagggtccggtaaggttaacgggaagttacggaaaacgtaaacccgttgtacgtagggtacgggtnttcgggtagtacgggtacggtaccgttactacctaacctgtaccgaccgtaagtacgaacccgaaacgacgtaaacgtacctacgtacgtttacgttacgtaacgtaaactnttaccgacgtaacggtccgtaaggcgtaaccggcggtaacgtccgtacgtcctcgttacgttaagttcgtgtacgnggtacggtggtacgttacgttcggtagtacgttacgtttcggttcccgttacgtttacggtacggtggtacccgg

SEQ ID NO: 74712 - DNA, 904 bp, Homo sapiens
  misc_feature: GYAE6OF02FTH5V.36.76.G10.1.454.CMB.1.raw
  modified_base (679)..(679): a, c, t, g, unknown or other
  misc_feature (679)..(679): n is a, c, g, or t
  modified_base (856)..(856): a, c, t, g, unknown or other
  misc_feature (856)..(856): n is a, c, g, or t
tcagtacgctgtctcacgaccggtgctcgatttagtcactcatacaggggtcagagaggagccttagccctggactccaaggccttccacttggtgatcagcactgagcacagaggactcaccatggaattggggctagacgtcgttgggtttttcctgttcgtacttattttaaggaaggttcgtcctaggtggtcggaggttgacgtaggttcgggtggtaacgtcggttagggggggaaggtccgtttcgggtacccgaggtccccgggttacggggggggtccccttaggaacggtacccgttccttcccggttagggtcggtaccgtacggtcccgttacgtgggtaaccttaccggtttaacccttttaaacggttaaccgttaaagttttacgggaacgtttacggggttaaacggggtttttcgggggtcccccgtcccgggttacgggtacccgttaccgggtaacgggggttaaaccggggtcccggttaaggggtaacggggttcggggggttaccgaacccgtaaacgttacgtaacccggaagggtaccccggggtaagtggggtaaaacggttacgaaggtaaaaacctaccggttaagtaccggtagggttacttacgggttaacgggacggtaaccgggggtccttacgttacccgtaaaccnccgtttcctaaccggaacggaacgtaaccccgtaacgaacccgtaaaacgtacccttaccggtaaccgtttccggttaccttaacgaaacttacgttacgaccgttaacgccgtaaggacggacgtaccggcgtaccgtcgccttactcgttactgtgcgtacgaggcggtacggtnttacggtgacgttcgtaccttccggttctacgttacggtcggtccggg

SEQ ID NO: 74713 - DNA, 647 bp, Homo sapiens
  misc_feature: GYAE6OF02H99FW.1.85.H08.1.454.CMB.1.raw
  modified_base (271)..(271): a, c, t, g, unknown or other
  misc_feature (271)..(271): n is a, c, g, or t
tcagacgagtgcgtcacgaccggtgctcgatttagtatcactcagtcgcgggggagtcagactcagtcaggacacagcatggacatgagggtccccgctcagctcctggggctcctgctgctctggctcccaggtgccgaatgtgacatccagatgacccagtctccttccaccctgtctgcatctataggggacagagtcacatcacttgccggccagtcagagtattagtagcgtggttggcctggtatcagcaagaaaccagggaacncccctaagcctacctgactactatgtactcgccctctaggtttaggtaaaacgtcggggtacccagttaccgaaggttcaggtcggctagtggatcgtggaacagtaactcactactaacctatacgcaacgtcctgacgtacgcctagacttagttacctttagttaaagtttacgttacgtacgaacctaacgtaagttaacttaagttacgttaccgttacgggtaaccggtttaccggaaccggtaaacgggaacccgtaagggtacgtaaaccggtaccgtaaacccggtaacgttacggtacggtacccgtacgtacccgtaaccgtacgtttacccgttacgtttaccttaccgtaccgtttacccccg

SEQ ID NO: 74714 - DNA, 426 bp, Homo sapiens
  misc_feature: GYAE6OF02F377Y.1.85.H08.1.454.CMB.1.raw
  modified_base (349)..(349): a, c, t, g, unknown or other
  misc_feature (349)..(349): n is a, c, g, or t
  modified_base (362)..(426): a, c, t, g, unknown or other
  misc_feature (362)..(426): n is a, c, g, or t
tcagacgagtgcgtcacgaccggtgctcgatttagtatcactcagctcgtctgggacagatttcactctcaccatcagcagtctgcaaggttgaagtattttcgactaaactttacctactgtacaaacagtagttaccacgtcccccctgggacgttccggaccgaaaggggacctaaagggtaggaaaactaccaaaaacggaacttggtacgggcctaggcccaaacctattccttaggttcctttaacacgtttcccttaccccccggacctattccgtacgaaaaccggcccaacttccgtcgtaggacggcgggacctgggacctaaaggccgacagttacgngcatcagcagctnnnnnnnnnnnnnnnnnnnnnnnnnnnnnnnnnnnnnnnnnnnnnnnnnnnnnnnnnnnnnnnnn

SEQ ID NO: 74715 - DNA, 495 bp, Homo sapiens
  misc_feature: GYAE6OF01CV1BO.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggcccctgtcttggtgatttataaaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctcgcccctggtcc

SEQ ID NO: 74716 - DNA, 703 bp, Homo sapiens
  misc_feature: GYAE6OF01ELL7I.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtcgtctgagacaggacgcgagctaccacgtgctcgtggcgtagtcgactagttcgaaaccaaaaactaattagtcgttacttacgtacggtaaccagacgaaggacgaccgacggaccgaccggtccccttggtttcgttgggtagttaatttaaagtaaaacgttacgtttaggaacggtacccggtccccttacggaacccgggtaccccgtaggaccggtaccgttactttccgtcggtcggtcctaccgacgtcctacggaacgggaaccaacgtacgtaccctaccgttacgaacctactacgtagggtacggtaccggtcccggaccgaagggacggaacggacggtctacgtaaccttaagtttaccgtcgtacgtaccggtccgaacgtaacgacgacgacggtaggtcgtacgttagttagtcgtacgttacgtcgggaggtacggtaactcggcgtacggacccgttccgtagtacgacccgtaccggaacgccgtccccgtccccgtcgtaccc

SEQ ID NO: 74717 - DNA, 497 bp, Homo sapiens
  misc_feature: GYAE6OF01EH8QX.49.20.B09.1.454.CMB.1.raw
  modified_base (484)..(484): a, c, t, g, unknown or other
  misc_feature (484)..(484): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagacttttgagaggccctcagggacccctgagcgattctctggctccagctcagggacaacagtcaccttgaccatcagtggagtccggcagaggacgaggctgactattactgtcagtccgcagacagcagtggcagttatgtcgtattcggcggagggactacgctgaccgtcctaggtcacgcccaaggcncgccccctggtcc

SEQ ID NO: 74718 - DNA, 519 bp, Homo sapiens
  misc_feature: GYAE6OF01CLT70.49.20.B09.1.454.CMB.1.raw
  modified_base (354)..(354): a, c, t, g, unknown or other
  misc_feature (354)..(354): n is a, c, g, or t
  modified_base (419)..(419): a, c, t, g, unknown or other
  misc_feature (419)..(419): n is a, c, g, or t
tcagagtcgagagacacgaccggtgctcgatttagtgtagtgtgaaggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtcttggtgatttataaagtactttgagaggccctcgacgggacccctgagcgattctctggctccagctcgagggacaacngtcaccttgacccatcagtggacgtccggccaggaggacgaggctgactattactgtcagtccgnagacagcaggtgctagttatgtcgtaagttcgggcggtagggacctacgcgtgacccgttcgtacggtcacggcccaaggcctccgcccccgtggtaccc

SEQ ID NO: 74719 - DNA, 566 bp, Homo sapiens
  misc_feature: GYAE6OF01CVZIS.49.20.B09.1.454.CMB.1.raw
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagacggccaggccacggcccctgtcttggtntatttaanaaagtctttgagacggccctcgacgggacccctgacgcgtatttcctcgtggccttccgagtctacgaaggggaaccaaacgtagtccaaccgttgaaccctatcgagttggacggtcccggacgaaggacggacgaggctagacttattacgtgtacacgtccgacagacagcgagtggctagttatgtcgtagttcgggacggacgggactacgcgtacggacccgttcgtacggtacacgtacccgaaggcctccgcccccgtggtaccc

SEQ ID NO: 74720 - DNA, 493 bp, Homo sapiens
  misc_feature: GYAE6OF01B17SZ.49.20.B09.1.454.CMB.1.raw
  modified_base (410)..(410): a, c, t, g, unknown or other
  misc_feature (410)..(410): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggcaaggcccctgtcttggtgatttataaagactttgagaggccctgagggacccctgagcgattctctggctcagctcagggacaacagtcacttgaccatcagtggagtccggcagaggacgaggctgactattactgtcagtccgnagacagcagtgctagttatgtcgtagttcggcggaggactacggctgaccgtctaggtcacgcccaaggctcgcccctggtcc

SEQ ID NO: 74721 - DNA, 503 bp, Homo sapiens
  misc_feature: GYAE6OF01AKJT2.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggccccctgtcttggtgatttataaaagacttttgagaggccctcagggacccctgagcgattctctggctccagctcagggacaacagtcaccttgaccatcagtggagtccggccagaggacgaggctgactattactgtcagtccgcagacagcagtggcagttatgtcgtattcgggcggagggactacggctgaccgtccgtaggtcaggcccaaggctcgccccctcggtcc

SEQ ID NO: 74722 - DNA, 496 bp, Homo sapiens
  misc_feature: GYAE6OF01BKVXV.49.20.B09.1.454.CMB.1.raw
  modified_base (233)..(233): a, c, t, g, unknown or other
  misc_feature (233)..(233): n is a, c, g, or t
  modified_base (289)..(289): a, c, t, g, unknown or other
  misc_feature (289)..(289): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaaanatatgcttaactggtaccagcagaggccaggccaggcccctgtcttggtgatttanaaagactttgagaggccctcagggacccctgagcgattctctggctccagctcgagggacaacagtcaccttgaccatcagtggacgtccggcagaggacgaggctgactattactgtcagtccgcagacagcaggtgcagttatgtcgtattcggcggaggactacgctagaccgtctaggtcacgccaagctcgccccgtggtcc

SEQ ID NO: 74723 - DNA, 523 bp, Homo sapiens
  misc_feature: GYAE6OF01B37M6.49.20.B09.1.454.CMB.1.raw
  modified_base (351)..(351): a, c, t, g, unknown or other
  misc_feature (351)..(351): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggcccctgtcttggtgatttataaagactttgagaggccctgacgggacccctgagcgattctctggctcagctcgagggacaacngtcaccttgaccatcagtggagtccggcagaggacgaggctgactattactgtcagtccgcagacagcaggtgactagtttatgttacgtagttcgggacggtagggacctacggcgtagacccggtccgtaggtaccacggacccaaggccctcgcccccgtcggtacccg

SEQ ID NO: 74724 - DNA, 506 bp, Homo sapiens
  misc_feature: GYAE6OF01EFNL6.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgccaaaaacatatgcttactggtaccagcagaggccaggccaggcccctgtcttggtgatttataaagctttgagaggccctcagggacccctgagcgattctctggctccagctcagggacaacagtcaccttgaccatcagtggagtccggcagaggacgaggctagactattactgtcagtccgcagacagcaggtggctagttatgtcgtagttcggcgggtagggactacggctcgaccgttcaggtcacgccaacggcctcgcccccgtggtaccc

SEQ ID NO: 74725 - DNA, 575 bp, Homo sapiens
  misc_feature: GYAE6OF01DX2T8.49.20.B09.1.454.CMB.1.raw
  modified_base (235)..(235): a, c, t, g, unknown or other
  misc_feature (235)..(235): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcagaggccaggccaggcccctgtcttggtgtatttanaaagtctttgagnggccctgacgggacccctgacgcgtattctcgtcggctccgagctcgaagggaccaacgagtccaccttgaacctatcgaggtggacgtccggacgaggacggacgaggctagacttattacgtgtcgacgtccgacgagacgacgcaggtcggactagtttagtggttacggttagttccgggacgggacgggtacctaccggtcgttacggacccgttcgtacggtaccgacgtacccgaacggtccctccggtcccccgtcggtaccc

SEQ ID NO: 74726 - DNA, 507 bp, Homo sapiens
  misc_feature: GYAE6OF01C4WYG.49.20.B09.1.454.CMB.1.raw
  modified_base (283)..(283): a, c, t, g, unknown or other
  misc_feature (283)..(283): n is a, c, g, or t
  modified_base (411)..(411): a, c, t, g, unknown or other
  misc_feature (411)..(411): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggngatttaataaagactttgagacggcctcgacgggacccctgagcgattctctggctcagctcgagggacaacagtcacttgaccatcagtgagtccgcagagagagctgactatactgtcagtccganagacagcagtgactagttatgtacgtagttcggcggagggactacgctaggaccgtcgtaggtcacgtcccgaaggcctccgcccccgtggtaccc

SEQ ID NO: 74727 - DNA, 531 bp, Homo sapiens
  misc_feature: GYAE6OF01CTHRY.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgccaaaaacatatgcttactggtaccagcagaggccaggccaggcccctgtcttggtgatttataaagactttgagaggcccctcgacgggacccctggagcgattcctctggcctccagctcagggacaacagtcaccttgaccatcagtggagtccggccaggaggacgaggctgactattactgtcagtccgacagacagcgagtggctagttatgtcgtagttcgggcggagggactacggtcctacggtacccggtccgtacggtcgacgacccgaaggtcctccggcccccgttcggtccc

SEQ ID NO: 74728 - DNA, 627 bp, Homo sapiens
  misc_feature: GYAE6OF01C0QAM.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagccaccctcggtgtctgtgtcctcaggacagacggccagtatcacctgctctggagatgcattcgccaaaagcaaatatgaacttactggtaccagcagaagccaggccaggcccctgtctgatcaatttaataaagtactttgagagggcctcgacgggacccctgagcgtattctctggctcagctcacgcgaacaacagtacacgttacgaacctatccgaaggtcgggacggtcccgggacaagggaagggaacggaggtccgttaggaacctttaagtttaccgttcggtacacggttacaagttaccgaaggtacctagggttaacgttcgggaccttaccgtttcgtacggttaccgtaggtttccgggacgggtaacggggaaccctaacgggtcgttacgggtacccgttacccggttacgggttaccacggaccccgaaaggtcccgttaccccgg

SEQ ID NO: 74729 - DNA, 513 bp, Homo sapiens
  misc_feature: GYAE6OF01BCPP3.49.20.B09.1.454.CMB.1.raw
  modified_base (309)..(309): a, c, t, g, unknown or other
  misc_feature (309)..(309): n is a, c, g, or t
tcagagtcgagagacacgaccggtgctcgatttagtgtagtgtgaagggggctgtgggtccaggaggcagaactctgggtgtctcaccatggcctggatccctctacttctcccccttctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctnagggacccctgagcgattctctggctcagctcgaggacaacagtcaccttgaccatcagtggagtccggcaggaggacgaggctgactattactgtcagtccgcagacagcagtggctagttatgtcgtagttcggcggagggactacgcgtgacccggtccgtaggtccgacggcccaaggcctcgccccccgtcggtacccg

SEQ ID NO: 74730 - DNA, 510 bp, Homo sapiens
  misc_feature: GYAE6OF01DF4GU.49.20.B09.1.454.CMB.1.raw
  modified_base (289)..(289): a, c, t, g, unknown or other
  misc_feature (289)..(289): n is a, c, g, or t
  modified_base (356)..(356): a, c, t, g, unknown or other
  misc_feature (356)..(356): n is a, c, g, or t
  modified_base (386)..(386): a, c, t, g, unknown or other
  misc_feature (386)..(386): n is a, c, g, or t
  modified_base (455)..(455): a, c, t, g, unknown or other
  misc_feature (455)..(455): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaagccaggccaggcccctgtctgatcatttanaaagtactttgaggagggcctcgacgggcccctggagcgattctctggctccagctcagcgacaacngtcacgttgaccatcagtggagtccggganaggaggacgaggctgacttattactgtcagtcatcaagacagtagtgctacttctgtcgtagttcgggnggacgggaccaaggcgtcggacccgtcgaggtccacgcccaaggcctcgcccccg

SEQ ID NO: 74731 - DNA, 538 bp, Homo sapiens
  misc_feature: GYAE6OF01APIUH.49.20.B09.1.454.CMB.1.raw
  modified_base (289)..(289): a, c, t, g, unknown or other
  misc_feature (289)..(289): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttanaaagtactttgagacggccctcacgggacccctgacgcgattctctggctccagctcgagggacaacagtcacttgaccatcagtggagtccggacaggaggacgaggctgactattactgtcagtccgcaagacagcaggtgtactagttatgttacgtagttcggcgggacgggtacctaacggccgttggacccggttccgtaggtccacggaccccgaaggaccctcggcccccgttcggtaccg

SEQ ID NO: 74732 - DNA, 510 bp, Homo sapiens
  misc_feature: GYAE6OF01C9SYO.49.20.B09.1.454.CMB.1.raw
  modified_base (308)..(308): a, c, t, g, unknown or other
  misc_feature (308)..(308): n is a, c, g, or t
  modified_base (371)..(371): a, c, t, g, unknown or other
  misc_feature (371)..(371): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagctttgagaggccctnagggacccctgagcgattctctggctccagctcagggacaacagtcacttgaccatcagtggngtccggcagaggacgaggctgactattactgtcacgtcgcagacagcagtggctagttagtgtcgtagttcggacggagggtactacggcgtagaccggttccgtacggtcacgcccgaaggcctcgccctcgtaccgg

SEQ ID NO: 74733 - DNA, 509 bp, Homo sapiens
  misc_feature: GYAE6OF01AFFUF.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccaggcccctgtcttggtgatttataaagactttgagaggccctcgacgggacccctgagcgattctctggctccagctcgagggacaacagtcaccttgaccatcagtggagtccggcaggaggacgaggctgactattactgtcagtccgcagacagcaggtgacagttatgtcgtagttcggcggagggactacgcgtgacccgtcgtaggtcacgcccaaggcctcgcccccgtggtaccc

SEQ ID NO: 74734 - DNA, 765 bp, Homo sapiens
  misc_feature: GYAE6OF01BA7AQ.49.20.B09.1.454.CMB.1.raw
tcagagtcgagagacacgaccggtgctcgatttagtgtagtgtgaaggggtcgttgggtagggtccgaaggaggcaggaacctcctgggtgtctcgaccatgggcctcggtagtccctcggtacgttctccccctcctcaactcttcgtgccacgaggcctcgtgaggccggtccgtagtggacgctcgacgaacacgtcaccctcggtgtcctgtgtccgtcgacggtacagacggcctaggatctacctggccttcgtggcgactcgctagttcgaccgaaaaacaaggtactggacttacgtcggttaccgaggtacctaggtacggccgaacggaccgaacggtacccccttggtaccttaggtagtaactttaacgtaaacggtacgttttcggaacggacgggtcccctacgtaccggggaaccccctaggtacgccgtaacgttccgtacgttcggactaccgaaccgtctacgacggtaacaactaacgtaccgtaaccgttacgaacctaagtacgtacggtacgggacgtacccgggtacctaagggtaacggacggtacggtccgtaacgtaccgttaagttacgtggtaccgtaacggtaacccgtcgtaacgtacgacgtacgtacggtcgtaccgttaggttacggtcggtacggtaccgtcgggacgggtaccggtaccgtacgtccgtacgacccgttccgtacggtacgaccggtacccgacggtcccgtcccgtccccgtcggtccc

SEQ ID NO: 74735 - DNA, 507 bp, Homo sapiens
  misc_feature: GYAE6OF01D8VLY.49.20.B09.1.454.CMB.1.raw
  modified_base (234)..(234): a, c, t, g, unknown or other
  misc_feature (234)..(234): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaanaatatgcttactggtaccagcagaggccaggccaggcccctgtcttggtgatttataaagactttgagacggccctcgacgggacccctgacgcgattctctggctccagctcgagggacaacagtcaccttgaccatcagtggagtccggcagaggacgaggctgactattactgtcagtccgcagacagcagtggactagttatgtcgtagtcgggcggagggactacgcgtgaccgtctaggtcacgtcccaaggcctcgcccctggtcc

SEQ ID NO: 74736 - DNA, 504 bp, Homo sapiens
  misc_feature: GYAE6OF01DLXN6.49.20.B09.1.454.CMB.1.raw
  modified_base (351)..(351): a, c, t, g, unknown or other
  misc_feature (351)..(351): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtctggtgatttataaagctttgagaggccctcgacgggacccctgagcgattctctggctccagctcagggacaacngtcaccttgaccatcagtgagtccggcagaggacgaggctgactattactgtcagtccgcagacagcagtgctagttatgtcgtagttcggcggagggactacggctacgaccgttccgtaggtcacgcccgaacggctcgccccgtcggtcc

SEQ ID NO: 74737 - DNA, 552 bp, Homo sapiens
  misc_feature: GYAE6OF01DUQMP.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaacatatgcttactggtaccagcagaggccaggccaggcccctgtcttggtgatttataaagactttgagtaggcccttgacgggacccctgagcgattctctggctccagctcgaagggacaacagtcaccttgaccatcagtggagtccggccaggaggacgaggctaggacttagttactgtcacgtccgacacgacagacagtggcgtagttagtagtccgtagttcgggacggaggtacgtaccggtcgtacggacccggtccgttacgggtaccacggtacccgaagggtccctccggtccccccgtcgggtaccc

SEQ ID NO: 74738 - DNA, 504 bp, Homo sapiens
  misc_feature: GYAE6OF01ECO0K.49.20.B09.1.454.CMB.1.raw
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggcccctgtcttggtgatttaanaaagactttgagaggccctnagggacccctgagcgattctctggctccagctcagggacaacagtcaccttgaccatcagtggacgtccggcagaggacgaggctagactattactgtcagtccgcagacagcagtggcagttatgtcgtagttcggcggagggactacgctagaccgtccgtaggtcacgcccaaggcctcgcccccgtggtccc

SEQ ID NO: 74739 - DNA, 506 bp, Homo sapiens
  misc_feature: GYAE6OF01AMY7D.49.20.B09.1.454.CMB.1.raw
  modified_base (405)..(405): a, c, t, g, unknown or other
  misc_feature (405)..(405): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaacaatatgcttactggtaccagcagaggccaggccaggcccctgtcttggtgatttataaagactttgagaggccctcacgggacccctgagcgattctctggctcagctcagggacaacagtcaccttgaccatcagtggagtccggcaggaggacgaggctagactattacngtcagtcgcagacagcaggtgcagttatgtacgtagttcgggcggagggtactacggctgaccgtccaggtcagcccgaaggcctcgcccccgtggtaccc

SEQ ID NO: 74740 - DNA, 737 bp, Homo sapiens
  misc_feature: GYAE6OF01DKT4W.49.20.B09.1.454.CMB.1.raw
  modified_base (185)..(185): a, c, t, g, unknown or other
  misc_feature (185)..(185): n is a, c, g, or t
  modified_base (293)..(293): a, c, t, g, unknown or other
  misc_feature (293)..(293): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctnaggacagacggccaggatcacctgctctggcgatgcattgaccaaaaacatatgcttactggtaccagcagacggccaggccacggcccctgtcttggtagtatttanaaagtctttgacgacggccctcgacgggacccctgacgcgtattctcgtcggctccagcctacgaacgggaaccaacgtacgtcctaacccgtttcgaaccctattacgaaggttacgggacggttaccccgggaccgaacgggaacgggtaaccggaacgggtccgttacggtaaccttaagtttaaccgtacggttacgtaaccggttcccgacgaacggaaccgacggtaccgtaacgggttcgggtaccgttaaggtttacgttcggtttaccggttaacggtttccggggtaccgggtaacgggggtaaccgttaacccgggtacccggttaccgggtaaccccggtttcccggttaaccgggttcccgtaaacccgggtacccccgtaaacgggtccccgttaccccggttccccccccggttcccgggtttaccccg

SEQ ID NO: 74741 - DNA, 516 bp, Homo sapiens
  misc_feature: GYAE6OF01C2RWY.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggccccctgtctttgggtgaatttataaaagactttgagaggccctcacggggacccctgagcgattctctggctccagctcagggacaacagtcaccttgaccatcagtggagtccggcagaggacgaggctgactattactgtcagtccgcagacagcagtggcagttatgtcgtagttcggcggagggactacgctgaccgtccgtaggtccgacgtcccgaacggcctcgcccccgtcggtaccc

SEQ ID NO: 74742 - DNA, 594 bp, Homo sapiens
  misc_feature: GYAE6OF01C4WPP.49.20.B09.1.454.CMB.1.raw
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
tcagagtcgagagacacgaccggtgctcgatttagtgtagtgtgaagggggctgtgggtccaggaggcagaactctgggtgtctcaccaatggcctggatccctctacttctcccctcctcactctctgcacaggctctgaggcctcctatgagctgacacagtcaccctcggtgtctgtgtcctcacggacagacggccaggatcacctgctctggcgatgcattgaccaaaaacatatgcttactcggtaccagcagaggccaggccaggcccctgttcttggtgtatttataaacgtactttagacgacggccctacgacgggacccctgacgcgtattctctggctcagctcgaaggacaacngtcacttnaccatcagtggacgtccgcgaggaggacgacggctacgtactattacgtcgtcacgtcgcagacgagcgtaggtcggtacgtaggttagttcggttacgttacgttcgggaccgggtacgggtaccgttacggtccgttacggtaccccggttcccgttacgggtacccgaacggtccccgaaacgggtcccgttcccggccccccgttcggttacccg

SEQ ID NO: 74743 - DNA, 568 bp, Homo sapiens
  misc_feature: GYAE6OF01CPKJ5.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttaactggtacagcagaggccaggccacggcccctgtcttggtgtatttataaagtactttgagacggccctagacgggacccctgagcgtattcctctggctcgagctacgagggacaacgacgtcaccttgaccatcgagtcggacgtcccgggccaagggacggacgacggtacgtagtaacttattaacgtgtaccgacggttccgacaacgacgtagacgaggtcgactagttatgttcgtagttcgggacgggaggtactacggtcgtagtacccgtccgtaggtcgacgacccgaaggccgtccgcccccgttggtaccc

SEQ ID NO: 74744 - DNA, 505 bp, Homo sapiens
  misc_feature: GYAE6OF01CMCM6.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagctttgagaggcctcagggacccctgagcgattctctggctcagctcagggacaacagtcaccttgacccatcagtggagtccggcagaggacgaggctgactattattgtcaatcaacagacacattggtaacttatgttcttcgactgacgacaacggtcaccgtctgggtacacgacccgaagcccgaaaccccactgccactcttacccg

SEQ ID NO: 74745 - DNA, 499 bp, Homo sapiens
  misc_feature: GYAE6OF01EC173.49.20.B09.1.454.CMB.1.raw
  modified_base (287)..(287): a, c, t, g, unknown or other
  misc_feature (287)..(287): n is a, c, g, or t
  modified_base (307)..(307): a, c, t, g, unknown or other
  misc_feature (307)..(307): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggcccctgtctggtgatttanaaagctttggagaggccctnagggacccctgagcgattctctggctccagctcgagggacaacagtcaccttgaccatcagtggacgtccggcagaggacgaggctgactattactgtcagtccgcagacagcagtggctagttatgtcgtagtcggcggagggactacggctgaccgtcctaggtcacgccaacggctcgccccgtggtcc

SEQ ID NO: 74746 - DNA, 523 bp, Homo sapiens
  misc_feature: GYAE6OF01CYM2N.49.20.B09.1.454.CMB.1.raw
  modified_base (355)..(355): a, c, t, g, unknown or other
  misc_feature (355)..(355): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgaatttataaaagtctttagagaggccctcgagggacccctgagcgattctctggctcagctcagggacaacngtcaccttgaccatcagtggagtccggcagaggacgaggctgactattactgtcagtccgcagacagcagtggctagttatgtcgtaagttcggacggagggactacgcgtagacccggtcctacgggtcacgtccccgaaaggtcctacgccccccgttggtacccg

SEQ ID NO: 74747 - DNA, 540 bp, Homo sapiens
  misc_feature: GYAE6OF01BCQ3Y.49.20.B09.1.454.CMB.1.raw
  modified_base (308)..(308): a, c, t, g, unknown or other
  misc_feature (308)..(308): n is a, c, g, or t
  modified_base (420)..(420): a, c, t, g, unknown or other
  misc_feature (420)..(420): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctnacgggacccctgacgcgattctctggctccagctcgagggacaacagtcaccttgaccatcagtggacgtccggccaagacggacgaggctagactattacgtgtcagtccncaacgacagcagtggacagttatgtacgtagttcggacgggagggtactaccggcgtacggaccggttccgtaggtaccacggtaccccgaagggcctaccggcccccgtcgggtacccg

SEQ ID NO: 74748 - DNA, 540 bp, Homo sapiens
  misc_feature: GYAE6OF01AIIZY.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacaatatgcttactggtaccagcagaggccaggccaggcccctgtcttggtgatttataaagtctttgagaggccctcgacgggacccctgacgcgtattctctggctccagctacgaggacaacagtccacttgaccatcagtggacgtccggacagaggacgaggctgacttattactgtacagtccgcagacagcaggtggacagtttatcgttcgtagttccgggcggtaacgggactacggccgtaggacccgttccgtacggtccacggtccccaaggcccgtccgccccccgtggtacccg

SEQ ID NO: 74749 - DNA, 602 bp, Homo sapiens
  misc_feature: GYAE6OF01CL160.49.20.B09.1.454.CMB.1.raw
  modified_base (337)..(337): a, c, t, g, unknown or other
  misc_feature (337)..(337): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtccaccctcggtgtctgtgtcctcaggacagacggccaggatcacctgctctggcgatgcattgaccaaaaacatatgcttacgtggtaccagcagacgcaggccacggccctgtcttggtatatttataaagtctttgagacggccctacgacgggacccctgagcgtattcnctggctcgagctcgaggaacaacgtacgtacctaccgttcgaacctatacgaggtcggacgtcccggacgaggaggacggagacgtgaacttagttactgtcgacgtccgacaacgacgacggacgtaggtcggtacgtaagtttacgttaggttcgtaaggttccgggtacgggaacgggtaccgtacggtcgtacgggtacccggttccgttacggtaccgaccgtaccccgtaacggccctcccggtcccccgtcggtcccg

SEQ ID NO: 74750 - DNA, 623 bp, Homo sapiens
  misc_feature: GYAE6OF01C7D9W.49.20.B09.1.454.CMB.1.raw
  modified_base (234)..(234): a, c, t, g, unknown or other
  misc_feature (234)..(234): n is a, c, g, or t
  modified_base (283)..(283): a, c, t, g, unknown or other
  misc_feature (283)..(283): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcaggagccaggccaggcccctgtcttggtntatttaataaagtctttgagacgccctgacggtaccctgacgcgtattctcgtggcctccagtctacgaagggaaccaacgtacgtaccaccgttgaaacccattacgacggtacggacggtacccgggaccgaagggaacggacggtacgggtaccttaggaacctttaatttaccgtcgtacctaacggtacccgagaacggaacacgaccgtaggtacgggtacctaagttagttacggttacggtacgttcgggacgggtacgggtactaccggcgtaggacccgtcgtacggtacgaccgtacccggacgtccgtcccggccccgtcggtacccg

SEQ ID NO: 74751 - DNA, 724 bp, Homo sapiens
  misc_feature: GYAE6OF01CQCUK.49.20.B09.1.454.CMB.1.raw
  modified_base (249)..(249): a, c, t, g, unknown or other
  misc_feature (249)..(249): n is a, c, g, or t
tcagagtcgagagacacgaccggtgctcgatttagtgtagtgtgaagggggctgtgggtccaggaggcagaactctgggtgtctcaccatggcctggactcctctacttcctcccctcctcactctctgcacgaggctctgacggcctcctatgagctgacacagtccacccgtcggtgtctgtcgtcctcgaggacaggaccggccaggactcacctgctcgtggcatcgactattcgaaccaaaaanaatagtcgtacttacgtacggtaccagaccgaaggacggaccgacggccgaccggtcccctggttccgtttgggtagttaattttaaagtaaaacgttacgttttaggaaggtaaccggtccccttacggaacccgggtaacccctggacggaccgtaactttcctcgtcggcctccgaacgtctacggaacgggaacaaacgtacgtacctaaccgttagaaccctagtacgacggtacggtacggtacccggacgaagggtaacggacggacggtctagtaacttagttaacgtcgtactacggtacccagaacgacgacgacgtaggtcggacttaaggttgttcggtacgttaggttccgggacgggaacgggtacctaccgggtcgtaccgggtaacccgttcggtaacggtacccaccggtaaccccgaaacgggtccctaccccggtcccccgttcgggttaaccccg

SEQ ID NO: 74752 - DNA, 516 bp, Homo sapiens
  misc_feature: GYAE6OF01DKBVS.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagactttgagaggcccttcgagggacccctgagcgtattctctggctccagctcagggacaacagtcaccttgaccatcagtggagtccggcagaggacgaggctgacttattactgtcacgtccgcagacaagcacgtggactagttatgtcgtagttcggacgggagggactacgctgacccgttccgtacggtcacgtccaaggcctcgcccccgtggtccc

SEQ ID NO: 74753 - DNA, 533 bp, Homo sapiens
  misc_feature: GYAE6OF01B3IG2.49.20.B09.1.454.CMB.1.raw
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttaataaagtactttgagaggccctcgacgggacccctgagcgattctcgtggctcagctcgagggacaacagtcaccttgaccatcagtggagtccggcagaggacgaggctgactattacgngtcacgtcgnagacagcagtggactagttatgttcgtagttcgggacgggagggacctacggctacggacccgttcgtacgggtcacggcccgaacggccgtccggtcccccgtcgggtaccc

SEQ ID NO: 74754 - DNA, 508 bp, Homo sapiens
  misc_feature: GYAE6OF01DDLWG.49.20.B09.1.454.CMB.1.raw
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaanaatatgcttactggtaccagcagagccaggccaggccctgtcttgtgtatttanaaagactttgagacgcctcgacgggacccctgagcgattcgtctggctccgagctcgagggacaacagtcacttgaccatcagtggagtccggcagaggacgagctgactattactgtcagtccgacacgacagcagtggactagttatgtacgtagtcggcggaggactacgcgtagacccgtcgaggtcacgcccaaggcctcgtcccccgtggtccc

SEQ ID NO: 74755 - DNA, 734 bp, Homo sapiens
  misc_feature: GYAE6OF01BCZ8B.49.20.B09.1.454.CMB.1.raw
  modified_base (242)..(242): a, c, t, g, unknown or other
  misc_feature (242)..(242): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtccacccgtcggtgtctgtgtcctcaggacagacggccaggactcacctgctcgtggcgatgctattcgaaccaaaaanatatgtcttacgtaggtaccagcaaggacggccacggacctacgggtcccccttggttccgtttagggtagtaacttttaagtaaaacggtccgttttaggaacggtaccggtccccttacggaaccggggtacccccttaggaacggtccggtaactttccgtcgttcgggacccttccgaacggccgtaccggaacgggaacctaaacgtacgttaccgtaaccctttacggaccctaacgttacgaagggtcgggtaaccggtcccggaccgaagggacgggacggaacggtctaagtaaccttaagtttacgtcggtaccgtacggtaccgacgaacggtacacggacgtaaggtcggtacgttaagtttacgttggtacggttacggttcgggacgggtaggtaccgttacggcgtaccggtaccgttccggtaacggtccgaacggtaccccgtacggtacccgtcccggtaccccgtcggtaccc

SEQ ID NO: 74756 - DNA, 510 bp, Homo sapiens
  misc_feature: GYAE6OF01BLAP5.49.20.B09.1.454.CMB.1.raw
  modified_base (237)..(237): a, c, t, g, unknown or other
  misc_feature (237)..(237): n is a, c, g, or t
tcagagtcgagagacacgaccggtgctcgatttagtgtagtgtgaagggggctggtgggtccaggaggcagaacctctgggtgtctcaccagtggcctggatccctctacttctcccctcctcactctctgcacaggctctgaggcctcctatgagctgacacagtcaccctcggtgtctgtgtcctcaggacagacggccaggatcacctgctctggcgatgctattgaccaaaanatatgcttactggtaccagcagagcaggccaggcccctgtctggtgatttataagactttgagaggccctcagggacccctggacgcgtattctctggctcagctcgagggacaacagtcaccttgaccatcagtgagtccggccagaggacgaggctgactattactgtcagtccgcagacagcagtgctagttatgtcgtagtcggcggaggactacgctgacccgtcgtacggtcgacgcccgaaggcccgtcgcccccgtcgggtaccc

SEQ ID NO: 74757 - DNA, 528 bp, Homo sapiens
  misc_feature: GYAE6OF01BG6L2.49.20.B09.1.454.CMB.1.raw
  modified_base (441)..(441): a, c, t, g, unknown or other
  misc_feature (441)..(441): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttataaagactttgagaggccctcgacgggacccctgagcgattctctggctccagctcgagggacaacagtccaccttgaccatcagtggagtccggcagaggacgaggctgactattactgtcagtccgcagacagacgagtggactagttntgtcgttagttcgggacgggagggactacgcgtcggaccgttccctaggttccacgtcccgaaggcctccgtcccccgtggtacccg

SEQ ID NO: 74758 - DNA, 517 bp, Homo sapiens
  misc_feature: GYAE6OF01BYM5U.49.20.B09.1.454.CMB.1.raw
  modified_base (129)..(129): a, c, t, g, unknown or other
  misc_feature (129)..(129): n is a, c, g, or t
  modified_base (250)..(250): a, c, t, g, unknown or other
  misc_feature (250)..(250): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctncacgaggcgtctggacggaccgtcctatgagctgacacagtcaccctcggtgtctgtgtcctcaggacagacggccaggatcacctgctctggcatgcattgccaaaaacatatgcttacnggtaccagcagacggcaggccaggccccctgtcttggtgtatttataaaagctttgagaggccctgacgggacccctgagcgattctctggctccagctcgaggacaacagtcaccttgaccatcagtgacgtcgccgagacggagagctgactattactgtcagtcncagcagnagngctagttagtgtgtagttcggcggagggacgtacgctcggaccgttcctacggtcacgtaccgaacgccgtcgcccccgtcggtacccg

SEQ ID NO: 74759 - DNA, 515 bp, Homo sapiens
  misc_feature: GYAE6OF01BQ7RM.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacaatatgcttactggtaccagcagaggccaggccaggccccctgtcttggtgatttataaagactttgagaggccctcagggacccctgagcgattctctggctccagctcagggacaacagtcaccttgaccatcagtggacgtccggcagaggacgaggctgactattactgtcagtccgcagacagcaggtggctagttatgtcgtagttcgggcggagggacctacggcgtgacccgtccgtaggtccacgcccgaaggcctcggcccccgtggtccc

SEQ ID NO: 74760 - DNA, 513 bp, Homo sapiens
  misc_feature: GYAE6OF01DJJ8W.49.20.B09.1.454.CMB.1.raw
  modified_base (360)..(360): a, c, t, g, unknown or other
  misc_feature (360)..(360): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtaatttataaagtctttgagaggccctgacgggacccctgacgcgtattctctggctccagctcgaagggacaacngtcaccttgaccatcagtggacgtccggcaggacggacgaggctcgactattactgtcagtcgcagacagcagtgctagttatgtcgtagtcggcggaggtactacgctagaccgtcgtaggtcacgcccgaaggctccgccccgtcggtacc

SEQ ID NO: 74761 - DNA, 524 bp, Homo sapiens
  misc_feature: GYAE6OF01BRZ4J.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtagtatttaataaagtactttgagacggccctcgacgggacccctgagcgattctctggctccagctcgagggacaacagtctaccttgaccatcagtggacgtccggcaggaggacgaggctgactattactgtcagtccgcagacagcgaggtgctagttactgtacgttagtcgggaggaggcgtacgctcggaccgtccgtaggtcacgtcccaaggcctccgtcccccgtggtaccc

SEQ ID NO: 74762 - DNA, 541 bp, Homo sapiens
  misc_feature: GYAE6OF01C41D9.49.20.B09.1.454.CMB.1.raw
  modified_base (233)..(233): a, c, t, g, unknown or other
  misc_feature (233)..(233): n is a, c, g, or t
  modified_base (291)..(291): a, c, t, g, unknown or other
  misc_feature (291)..(291): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaanatatgcttactggtaccagcagaggccaggccacggcccctgtcttggtgtaatttanaaagtactttgagtaggccctacgagggaccccctggaacgcgtaattctctcggctccgagtctacgaacgggacaacagtccaccttagaaccatcagtggacgtccggaccaggaggacgaggctgtactattactgtcaggtccgacagacagcaggtgactagttatgtcgtagttcggacgggaggacgacgcgtagtacccgtcgtacgtccagtacccgaagcctccggccccgtggtaccc

SEQ ID NO: 74763 - DNA, 516 bp, Homo sapiens
  misc_feature: GYAE6OF01BPX5S.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcagggacccctgagcgattctctggctccagctcagggacaacagtcaccttgaccatcagtggagtccggcagagacgaggctagactattactgtcagtccgcagacagcagtgctagttatgtacgtagttcgggacggagggactacgcgttggacccgttccgtacggtccacggccccaaggcctccgcccccgtggtaccc

SEQ ID NO: 74764 - DNA, 503 bp, Homo sapiens
  misc_feature: GYAE6OF01CSN24.49.20.B09.1.454.CMB.1.raw
  modified_base (488)..(488): a, c, t, g, unknown or other
  misc_feature (488)..(488): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcagggacccctgagcgattctctggctccagctcagggacaacagtcaccttgaccatcagtggagtccgcagaggacgaggctgactattactgtcagtcgcagacagcagtggctagttatgtcgtagttcggacggagggactacggctgaccgtccgtaggtcacgcccgaaggtcncgcccccgtggtccg

SEQ ID NO: 74765 - DNA, 504 bp, Homo sapiens
  misc_feature: GYAE6OF01DBQUP.49.20.B09.1.454.CMB.1.raw
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (352)..(352): a, c, t, g, unknown or other
  misc_feature (352)..(352): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccaggcccctgtcttggtnatttanaaagctttgagaggccctgacgggacccctgagcgattctcgtggctccagctgagggacaacngtcaccttgaccatcagtgagtccggcagaggacgaggctgactattactgtcacgtccgacagacagacagtgctagttatgtcgtagttcggcggaggctacgctgaccgtccgtaggtcacgcccgaaggcctccggcccctggtaccc

SEQ ID NO: 74766 - DNA, 519 bp, Homo sapiens
  misc_feature: GYAE6OF01EDKG5.49.20.B09.1.454.CMB.1.raw
tcagagtcgagagacacgaccggtgctcgatttagtgtagtgtgaaggggctgtgggtccgaggaggcagaactctcgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagacttttgagaggccctcagggacccctgagcgattctctggctccagctcagggacaacagtcaccttgaccatcagtggagtccggcagaggacgaggctgactattactgtcagtccgcagacagcaggtggctagttatgtcgtagttcgggcggtagggactacggctggacccgtcgtacgggtcaacggtcccgaaggcctcggtcccccgtgggtaccc

SEQ ID NO: 74767 - DNA, 510 bp, Homo sapiens
  misc_feature: GYAE6OF01D27EE.49.20.B09.1.454.CMB.1.raw
  modified_base (236)..(236): a, c, t, g, unknown or other
  misc_feature (236)..(236): n is a, c, g, or t
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgacccaaaaanatatgcttactggtaccagcagagccaggccaggcccctgtcttggtgatttataaagctttgagaggccctgacgggacccctgagcgattctctggctccagctcagggacaacngtcaccttgaccatcagtggacgtccggcagaggacgaggctagactattactgtcagtccgnagacagcagtggctagttatgtcgtagttcggacggaggacgtacgcgtagaccgtctacggtcacgtccgaaggcctcgccccgtcggtaccc

SEQ ID NO: 74768 - DNA, 499 bp, Homo sapiens
  misc_feature: GYAE6OF01BFGFI.49.20.B09.1.454.CMB.1.raw
  modified_base (309)..(309): a, c, t, g, unknown or other
  misc_feature (309)..(309): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggccccctgtcttggtgatttataaagactttgagaggccctnacgggacccctgagcgattctctggctcagctcagggacaacagtcaccttgaccatcagtggagtccggcagaggacgaggctgactattactgtcagtcgcagacagcagtgcagttatgtcgtagttcgggcggagggactacggctgaccgtcctaggcacgcccgaaggctcgcccccgtggtcc

SEQ ID NO: 74769 - DNA, 632 bp, Homo sapiens
  misc_feature: GYAE6OF01CXWJA.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatcgcttactggtaccagaccaggacggccaggccacggcccctgtcttggtagtatttataaagtctttgagacgccctacgaacgggacccctggagccgtattcgtcgtcggcctaccgagacgtcgaacgggaactaaacgacgtacccaacctttacgaaccctagtacgaaggtcgggaacgtcccgggacaagggtacggaacgacggactacggaacttagttaacgtcgtacacggttcccgagaacgacaggactacggtaggtaccgtaagtttacttaggttcgttaagttccgggaacggacgggtactaccggcgttacggaccggttccgtaacggaccgaccgtcccgaacggcccgttccggtccccgtcgggtacccg

SEQ ID NO: 74770 - DNA, 511 bp, Homo sapiens
  misc_feature: GYAE6OF01DAQ3U.49.20.B09.1.454.CMB.1.raw
  modified_base (305)..(305): a, c, t, g, unknown or other
  misc_feature (305)..(305): n is a, c, g, or t
  modified_base (354)..(354): a, c, t, g, unknown or other
  misc_feature (354)..(354): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcgggacagacggccaggatcacctgctctggcgatgcattgaccaaaaacaatatgacttactggtaccagcagaggccaggccaggcccctgtcttggtgatttataaagtactttgagnggccctcgagggcccctgagcgattctctggctcagctcagggacaacngtcaccttgaccatcagtggacgtccggaccagacggacgaggctgactattactgtcacgtccgcagacagcagtggctagttatgtcgtagttcggacggaggactacgcgtcgacgttctaggtcagcccgaaggcctcgcccctgtcctaccg

SEQ ID NO: 74771 - DNA, 669 bp, Homo sapiens
  misc_feature: GYAE6OF01ENHDC.49.20.B09.1.454.CMB.1.raw
  modified_base (383)..(383): a, c, t, g, unknown or other
  misc_feature (383)..(383): n is a, c, g, or t
tcagagtcgagagacacgaccggtgctcgatttagtgtagtgtgaagggggctgtgggtccagggaggcagaactcgtgggtgtctcaccatggcctggactccctctacttcctcccctcctcactctctcgcacgaggctctggacggcctcctatgagctgacacagtccacccgtcggtgtctgtcgtcctcgaggacaggaccggccgaggactccactgcctcgtggcatgctattcgaaccaaaaatatatcgtacttacgtacggtaccagcaggacggccaacggccacggcccctgttcgttggtgtatttaagtaaagtctttaggagacggccctcgaccgggaccctgacgcgtacttctcgtcggctcngtcctacgacgggacaacgacgtacctaccgttcgacctatcgtaggtcggacggtaccggacgaaggacggacggacggtctacggtaacttacgttacgtgtacgtacgtcccgacgtacgacgacgacgtacgggtcggtacgttagtttacgttcggttacgttacggtaccggggtacggggacgggtaccgtacggtccgttaggtaccccggttccggttacggtaccgaccggtacccggtaacgggcccgttccccggtcccccggtggttaccccg

SEQ ID NO: 74772 - DNA, 528 bp, Homo sapiens
  misc_feature: GYAE6OF01BPL7I.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccacggcccctgtcttggtgtatttataaagtactttgagacggccctcgacgggacccctgacgcgtattctcgtggctccagctcgaaggacaacacgtacaccttacgaccatcgaggtggacgtccggcgaggaggacggaggctagacttattactgtacacgtccgctagacagacaggtggctagttatgtcgtagtcggcggaggactcgcgtcgaccgtcgtaggcacgccacggcctccgccccgtggtccc

SEQ ID NO: 74773 - DNA, 692 bp, Homo sapiens
  misc_feature: GYAE6OF01BTLP1.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacagtctctgaggcctcctatgagctgacacagtcaccctcggtgtctgtgtcctcaggacagacggccaggatcacctgctctggcgatgctattcgaaccaaaacatatgtacttacgtacggtaccagacgaggacggaccgacggccgaccggtccccttggttccgttggtagttaattttaaagtaaacgttacgtttaggaacggaccggtcccgtacggaacccgggtaccccttaggaacggtcgtactttccgtcgtcggtcctaccgacgtccgtacggaacgggaacctaacgtacgtaccctaccgttacgaacctacgtaccgtaggtacgggtaccggtcccggacgaagggacgggaaccggacggtcgtagtaaccgtttacgttaccgtcgtaccgtacggtcccgagacgacgagacgtaggtcggtacttagttacgtcggtacgttacggtcgggacggtacgggtaccgtcggtcgtacggtacccgtcgtacggtaccaccggtacccgacggtcccgtccccgccccggtcggtacccg

SEQ ID NO: 74774 - DNA, 514 bp, Homo sapiens
  misc_feature: GYAE6OF01DV29V.49.20.B09.1.454.CMB.1.raw
  modified_base (308)..(308): a, c, t, g, unknown or other
  misc_feature (308)..(308): n is a, c, g, or t
  modified_base (352)..(352): a, c, t, g, unknown or other
  misc_feature (352)..(352): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtcttggtgatttataaagctttgagaggccctnacgggacccctgagcgattctctggctccagctcagggacaacngtcacttgaccatcagtggacgtccggcaggaggacgagctgactattactgtcagtccgcagacagcagtgcgtagttatgttcgtagttcgggacggagggtaccgtacgcgtagacccgttcgtacggtcacgcccaaggcctccgccccgtgtacccg

SEQ ID NO: 74775 - DNA, 517 bp, Homo sapiens
  misc_feature: GYAE6OF01DZSPB.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagtactttgagaggccctcgagggacccctgagcgattctctggctccagctcgagggacaacagtcaccttgaccatcagtggacgtccggcagaggacgaggctgactattactgtcagtccgcagacagcagtggcgtagttatgtcgtagttcggcgggagggactacggctagaccgttccgtaggtcacgcccaagggcctcggcccccttcgggtaccc

SEQ ID NO: 74776 - DNA, 684 bp, Homo sapiens
  misc_feature: GYAE6OF01BHHQO.49.20.B09.1.454.CMB.1.raw
  modified_base (173)..(173): a, c, t, g, unknown or other
  misc_feature (173)..(173): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtntctgtgtcctcaggacagacggccaggatcacctgctcgtggcgatgctattcgaccaaaaacatatgcttactcggtaccagcaaggaggccacggccacggtcccctgttcgttggtacgtaatttaagaaagtactttgagacggtccctgaacgggacccctggacgcgtattcctcgtcgctccagtctacgaaggacaactacgtcctaaccttcgaaccacgttacgaggtcggaccggtccggaccgaaagggtacggaacggacgggtacgtaggtaacctttaacttacgtcgtaccgacgtccgtacgaacgtacaggacgtacggtagggtaccgttaaggtttacgttcggttacggttacggttccggggacgggtacggggtaaccgttaccggtcggttaccggttacccggttaccggtaccgggttaacccggaaccggtaccccggtaaacgggttccccgtacccggtccccccggttcggttaacccccg

SEQ ID NO: 74777 - DNA, 620 bp, Homo sapiens
  misc_feature: GYAE6OF01CO7NZ.49.20.B09.1.454.CMB.1.raw
  modified_base (147)..(147): a, c, t, g, unknown or other
  misc_feature (147)..(147): n is a, c, g, or t
  modified_base (166)..(166): a, c, t, g, unknown or other
  misc_feature (166)..(166): n is a, c, g, or t
  modified_base (177)..(177): a, c, t, g, unknown or other
  misc_feature (177)..(177): n is a, c, g, or t
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (251)..(251): a, c, t, g, unknown or other
  misc_feature (251)..(251): n is a, c, g, or t
  modified_base (304)..(304): a, c, t, g, unknown or other
  misc_feature (304)..(304): n is a, c, g, or t
  modified_base (465)..(465): a, c, t, g, unknown or other
  misc_feature (465)..(465): n is a, c, g, or t
  modified_base (606)..(606): a, c, t, g, unknown or other
  misc_feature (606)..(606): n is a, c, g, or t
tcagagtcgagagacacgaccggtgctcgatttagtgtagtgtgaaggggtcggtgtgggtccaggaggcgagaacctcgtgggttcgtcgtcaccgagtggccctgggactccctacgtacttctcccctcgtcactctctgcagnggtctctgaggcctcctangagctgacacngtccaccctggtntctgtgtcctnaggcagcggccaggntcacctggcgtcnggacatgcattgacccaaaaangtatgtctattcgtacagcagaacgccggcaggccctgtgtggtagatgttanaaagcactgagacgcctagagggacttcccgagaagccgtaagttctcgttggctccgacggtcgaggaaccgacgggtctaactagttcggaccagttcgaaggttcggacgttccgaaggtccgaaggtaggaacgtaggtcgtagactacgttagttnacgtaagtccaacgacgacaccgtaagttacggtacttagtcgtaccgttacggacttcggaccgtaccgaacgggtaccgaccggttaccgtcggggttcccaaccggtaccccgaaaccggtacccaaacccccgtacncggtaccctacccg

SEQ ID NO: 74778 - DNA, 562 bp, Homo sapiens
  misc_feature: GYAE6OF01EAU0R.49.20.B09.1.454.CMB.1.raw
  modified_base (238)..(238): a, c, t, g, unknown or other
  misc_feature (238)..(238): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccagggatcacctgctcgtggccgatgccattgcccaaaaanatatgcttactggtaccagcagagccaggccaggcccctgtcttggtgatttataaagctttgagaggccctgagggacccctgaagcgattctcgtggcctacagcctcaacgggtacaacgacgtcaccttgaccaatcagtggagtccgccagaggcgaggcagactattactcgtcagtccgacagacaagtagtacggctacttctagttcgtagtttcgggacgggtacgggtaccaaggtctacgggtaacccgttcccgttaggtaccgagacccccgtaaggcccgttccggaccccccttcgggtccttacccg

SEQ ID NO: 74779 - DNA, 786 bp, Homo sapiens
  misc_feature: GYAE6OF01EPV5Q.49.20.B09.1.454.CMB.1.raw
tcagagtcgagagacacgaccggtgctcgatttagtgtagtgtgaaggggctgtgggtccaggaggcagaactctgggtgtctcaccatggcctggatccctctacttcctcccctcctcactctctgcacaggctctgaggcctcctatgagctgacacacgtccaccctgtcgtcgtgtcgtccgtcgtacgacgacgacggaccgacgacgtactaccgtacgtcgtcgtcggtcggtacgtacgtacgtacgtacgtaaccgtaaaacctaaaactaaactaacgtacgttacgttacgttaaccgtaacgacgacggaacggaccggaccggaccggaccggtacccggtaccgttcgttcggttacggttaacgtttaaagttaaacgttaacgtttaacgttacggtaacggtctaacgggtaacccggtacccgtacgggaaccggtaccgtacgttaccgtacggttcggttcccttaccggtacgtccgtaccggtaacggtaacctaaacggtaacgtaacctaaccgttaccgtaaccttactaccgtaacgtacggtacggtaccgggtaccggtaacggtaccggaacggaacggacgtacggtaacgttacgttacgtacgttacgtacgtccgacgacgaccgacgacgtacgtacgacgtagtacgtacgttacgttacgttcggtacgggtacgggtacggtacggtacggtacgtaccgtaccgtaccggtaccgtaccgtaccgtacggtccgtacccggtacccg

SEQ ID NO: 74780 - DNA, 519 bp, Homo sapiens
  misc_feature: GYAE6OF01A4TCQ.49.20.B09.1.454.CMB.1.raw
  modified_base (425)..(425): a, c, t, g, unknown or other
  misc_feature (425)..(425): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcgacgggacccctgagcgattctctggctccagctcaggacaacagtcaccttgaccatcagtggacgtccggccaggaggacgaggctgactagttactgtcagtccgacagacngacagtggctagttatggtcgttagtcgggacggagggactacggctagaccgtccgtaggcacggcccaagggcctcgcccccgtcggtaccc

SEQ ID NO: 74781 - DNA, 530 bp, Homo sapiens
  misc_feature: GYAE6OF01D50TL.49.20.B09.1.454.CMB.1.raw
  modified_base (233)..(233): a, c, t, g, unknown or other
  misc_feature (233)..(233): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattgaccaaaaanatatgcttactggtaccagcagaggccaggccaggcccctgtcttggtgatttataaagtactttgagaggccctgacgggacccctgacgcgattctctggcctcagctcgagggacaacagtcacgttgaccatcagtggacgtccggcaggaggacgaggctgacttattactgtcagtccgcagacagcagtggctaggttatgtcgtagttcgggacggtagggacgtacggtcgtaggacccgtcgtaggtccgacgtaccccgaaggcctccggcccccgtcgggtaccc

SEQ ID NO: 74782 - DNA, 588 bp, Homo sapiens
  misc_feature: GYAE6OF01BT729.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtcagtcgtccccaggacagacggccaggatcacctgctctggagatgcattgaccaaaccgatatgcttattggtaccagcagaagccgggcacggcccctgtgttggtgatgtaataaagacactgagacggccctcgagggactcccgtgagcgtattctcgtgctcgaggtcgaggacacggtcactagttcggcctatcgtaggtggacgtccgaggcaggaggacgagtactagacttagttagttgtactaactacaacagaaccaactagttacggtaacttagtcgttaccgttacgaacttggaccgaaccgtaaggttaccctaccggttaccggtacgggttacccacgtaccccgaaacggacccctaaacccccgtatacccggtacctaccgttaccccg

SEQ ID NO: 74783 - DNA, 551 bp, Homo sapiens
  misc_feature: GYAE6OF01B02HL.49.20.B09.1.454.CMB.1.raw
  modified_base (291)..(291): a, c, t, g, unknown or other
  misc_feature (291)..(291): n is a, c, g, or t
  modified_base (334)..(334): a, c, t, g, unknown or other
  misc_feature (334)..(334): n is a, c, g, or t
  modified_base (360)..(360): a, c, t, g, unknown or other
  misc_feature (360)..(360): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgatttaanaaagtctttgagacggccctgacgggacccctgagtcgattcncgtggctccagtctcgaaggacaacngtcacttgaccatcagtggacgtccgggaccaggaggacgacgggactaggacttagttactcgtacacggtccagtacgacgagcgagtcgggctacggtttatcgacgttagtcgggacgggacggtacgaccgcgtacggacccgtcgtaaggtccacgcccaagggccctcggcccccgtggtaccc

SEQ ID NO: 74784 - DNA, 629 bp, Homo sapiens
  misc_feature: GYAE6OF01EG7N0.49.20.B09.1.454.CMB.1.raw
  modified_base (188)..(188): a, c, t, g, unknown or other
  misc_feature (188)..(188): n is a, c, g, or t
  modified_base (237)..(237): a, c, t, g, unknown or other
  misc_feature (237)..(237): n is a, c, g, or t
  modified_base (347)..(347): a, c, t, g, unknown or other
  misc_feature (347)..(347): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtccaccctcggtgtctgtgtcctnaggacagacggccaggatcacctgctctggcgatgcattgaccaaaaanatatgacttacgtggtaccagcagacggccaggccacggcccctgttcgttggtgtaatttaagaaagtctttgagacggccctgacgggacccctgagcgtattctcgnggtcctccagctcgacggacaacacgtcaccttagaccatactaggtcgacggtccgacgaggaggacgaaggctagacttagtactagtcacgtcgacacgacgacgacgtaggtcgggtaacttaggttaacttcggttaaccggttagttacccggggtacgggacgggtaaccgttaaccggtccggttaccggtacccggttaccgttaacgggtcccgaacccggtacccggtaaaccggtccccgtacccgtccccccggttacggttaaccccg

SEQ ID NO: 74785 - DNA, 553 bp, Homo sapiens
  misc_feature: GYAE6OF01B4R16.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccacggcccctgtcttggtgtatttataaagtactttgagacggccctcgagggacccctgagcgtattctctggctcgagctcgaagggacaacgacgtaccaccttcgaacctagtaaggtcggacgtccggaccaggacggacgaggctagacttattactgtcgagtccgacagacagcagtggctagttatgtcgtagttccggcgggtacgggactacggcgtcggtaccggttcgacggtcgacggtacccgaggtccctccggcccccgtcggtcctaccg

SEQ ID NO: 74786 - DNA, 704 bp, Homo sapiens
  misc_feature: GYAE6OF01A1C1M.49.20.B09.1.454.CMB.1.raw
  modified_base (234)..(234): a, c, t, g, unknown or other
  misc_feature (234)..(234): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaanatatgcttacgtggtaccagcagacggccaggccacggcccctgtcgttggtagtatttaataaagtctttagagacggccctcgacgggacccctgacgcgtacttctacgtcggcctccgagtccgtacgaacgggaacaacgtacgtacctaaccgttcgaaccctagttaccgtaaggtcgggtaaccggtccccgggaccgtaacgggaacgggtaaccggacgggtaccgttacggtaacctttaacgtttaccgttcggtaccgtaaccggtcccgaacgtaacggaacgacggacgtacggtacgggtacttaaggtttacgttacggttacgttaacggttccggggacgggtaacggggtaaccttacgggccggttaccggtacccggttaccggttaacggtaccgaccgggtacccgaacgggtcccgtacccggtccccccggttcgggtaccccg

SEQ ID NO: 74787 - DNA, 514 bp, Homo sapiens
  misc_feature: GYAE6OF01DHPFW.49.20.B09.1.454.CMB.1.raw
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (434)..(434): a, c, t, g, unknown or other
  misc_feature (434)..(434): n is a, c, g, or t
  modified_base (440)..(440): a, c, t, g, unknown or other
  misc_feature (440)..(440): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggatcacctgctctggcgatgcattgaccaaaaacatatgacttactggtaccagcagacggccaggccacggcccctgtcttggtntaatttanaaagtactttgagacggccctgacgggacccctgaacgcgattctcgtgctcagctcgaggacaacagtcaccttgaccatcagtggacgtccggcaggaggacgagctgactattacgtgtcagtccgacagacagnagtcgntagttatgtcgtagtcggacggacggtactacgcgtgaccgtcgtaggtcacgccacgctccgccccgtgtacc

SEQ ID NO: 74788 - DNA, 546 bp, Homo sapiens
  misc_feature: GYAE6OF01A7U5P.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgtatttaataaagtactttgagacggccctcgacgggacccctgacgcgtattcgtctggctccgacgctcgacggacaacacgtcaccgttgacctatcgagtggacgtccgcgaggacggacgagctagacttattacgtgtcacgtccgacacgacagcgagtggacgtagttagtgtacgtagttcgggacggtacgggactacggcgttacgaccgtcgtacgtccgacgtacccgaggcctccgccccgtcggtacc

SEQ ID NO: 74789 - DNA, 547 bp, Homo sapiens
  misc_feature: GYAE6OF01BMWEB.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggccccggtgttgctcatctatgacgacagaaaaccgccctaccgggactccctgagagattctctggctccactcgagggaccatcggcctacgttgactatcacggcgggcccagggtggaggatgaaggtgactactattgtactcacctagaccaccgagtagaaactcaacgagaggaatagttcgggacggagggaccaaggctacggaccgttaccgtagggtccaacggccccgaaacggtccctacggacccccctcggtcccaccttcccg

SEQ ID NO: 74790 - DNA, 521 bp, Homo sapiens
  misc_feature: GYAE6OF01A2UE3.49.20.B09.1.454.CMB.1.raw
  modified_base (357)..(357): a, c, t, g, unknown or other
  misc_feature (357)..(357): n is a, c, g, or t
  modified_base (420)..(420): a, c, t, g, unknown or other
  misc_feature (420)..(420): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccacggcccctgtcttggtgtatttaataaagtactttgagacgccctcgacgggacccctgagcgtattctctggctcagctcgaggacaacngtccacttgaccatcgagtggacgtccgcagaggacgagctagactattactgtcagtccganagacagcgagtggctagttatgtacgtagttcgggcggtaggacgtacgcgtacggccgttccgaggccacggacccaacggcctaccgccccgtggtacc

SEQ ID NO: 74791 - DNA, 525 bp, Homo sapiens
  misc_feature: GYAE6OF01A3KXX.49.20.B09.1.454.CMB.1.raw
  modified_base (416)..(416): a, c, t, g, unknown or other
  misc_feature (416)..(416): n is a, c, g, or t
tcagagtcgagagacacgaccggtgctcgatttagtgtagtgtgaagggggcgtgtgggtccaggaggcagaactctgggtgtctcaccatggcctggatccctctacttctccccctccctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgtatttactaaagctttgaagagggcctacgacgggacccctgagcgattctctggctccagctcagcgacaacagtcacgttgaccatcagtggagtccgggcaggaggacgaggctagactattacgngtcagtcatcagactagtagtggctacttcgtgtcgtgttccgggcggagggaccgagtcgtggtacccggtccgtaggtccacggacccgaaggctccgccccgtccg

SEQ ID NO: 74792 - DNA, 557 bp, Homo sapiens
  misc_feature: GYAE6OF01CFEQW.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgtatttataaagtactttgagacggccctcgacgggacccctggagcgtattctcgtggctccgagcctcgaacgggaacaacgtagtacctaaccttgaacccatcgtaagtcggacgtcccgggaccaggacggacgaggctagactattacgtgtacacgtccgacagacgagacagtggactagttatgtcgtagttcgggacggtacggactacgtctggaccgttcgtacggtccacggcccaaggcctccgtccccgtggtacccg

SEQ ID NO: 74793 - DNA, 505 bp, Homo sapiens
  misc_feature: GYAE6OF01BDFRH.49.20.B09.1.454.CMB.1.raw
  modified_base (452)..(452): a, c, t, g, unknown or other
  misc_feature (452)..(452): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggccccctgtcttgatcatttataaagtacttttgagacgggcctcgacgggaccccctgacgcgattctctggctccagctcagcgacaacagtcacgttgaccatcaggtggagtcccgggcaggaggacgaggctagactattactgtcagtcatcagacagtagtcgctactctgtcgtnttcggcggagggaccagctgaccgtctaggtcagcccaaggcctcgtcccccg

SEQ ID NO: 74794 - DNA, 552 bp, Homo sapiens
  misc_feature: GYAE6OF01BOPRX.49.20.B09.1.454.CMB.1.raw
  modified_base (442)..(442): a, c, t, g, unknown or other
  misc_feature (442)..(442): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagagccaggccaggcccctgtcgttggtgtatttaataaagtactttgagacggccctcgacgggacccctgacgcgtattcgtcgtggcctccgagctcgaagggacaacgacgtaccaccttgacctatcgagtcggacgtccggacaggacggacgaggctagactattacgtgtcacgtccganagacagcaggtgactagttatgtacgtagtcggacggagggtacgtacggcttacggaccggttccgtacggtcacggtacccgaaggccgtcccgcccccgtggtaccc

SEQ ID NO: 74795 - DNA, 509 bp, Homo sapiens
  misc_feature: GYAE6OF01A0IFG.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcgacgggacccctgagcgattctctggctccagctcagggacaacagtcaccttgaccatcagtggagtccggcagaggacgaggctgactattactgtcagtccgcagacagcagtggctagttatgtacgtagttcggcggaggacgtacgctgaccgtcgtacggtcacggcccaaggcctcgcccccgtggtcccg

SEQ ID NO: 74796 - DNA, 517 bp, Homo sapiens
  misc_feature: GYAE6OF01C2ZB8.49.20.B09.1.454.CMB.1.raw
  modified_base (358)..(358): a, c, t, g, unknown or other
  misc_feature (358)..(358): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgagcctcctatgagctgacacagtcaccctggtgtctgtgtcctcaggacagacggccaggatcacctgctctggcgatgcattgaccaaaacatatgcttactggtaccagcagaggccaggccacggcccctgttcgttggtagtattttaataaagtctttgagacggccctgacgggacccctgagcgtattctctggctcagctcgaggacaacngtcacttgacctatcagtggacgtccggcaggaggacgaggctagactattacgtgtcagtccgcagacagcagtgactagttgtgtcgtagtcgggcggtagggactacggcttgacccgtcgtacggtcacgcccaaggcctcgccccgtggtaccc

SEQ ID NO: 74797 - DNA, 547 bp, Homo sapiens
  misc_feature: GYAE6OF01EX937.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacaatatgcttactggtaccagcagaggccaggccacggcccctgtcttggtgtatttaataaagtactttgagtacggccctacgacgggacccctgacgcgtacttctcgtggcctccagctacgagggacaacgtacgtcaccgttgacctatcgagtggacgtccggaccgaggacggaacgaggcgtagacttattactgtcgacgtccgcagacagcaggtgctagttatcgtcgtagtcgggacggtaggacgtacggctacgaccggtcctaggtcacgaccgaacggcctccgccccgtggtcccg

SEQ ID NO: 74798 - DNA, 673 bp, Homo sapiens
  misc_feature: GYAE6OF01CLINR.49.20.B09.1.454.CMB.1.raw
  modified_base (293)..(293): a, c, t, g, unknown or other
  misc_feature (293)..(293): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagacgccaggccacggcccctgtcttggtagtaatttanaaagtctttagagacgccctcgacgggacccctgacgcgatttcctcgtcggcctccgaagctacgaagggaacaacgtacgtcctaaccgttcgaacctagtaccgagggttcgggaccggtcccgggaccaagggaacggaacggacgggaccttaggtaacttaagtttaccgtgttacccaacggtcccgacgaacggaaccgacggaccgagggtacgggaccttaaggtttaacgtcggttacggttacgttccggggacggggaacgggtacctaccgggtccttacggggtaaccccgttccggttaacgggtaccaacgggacccccgtaaacgggtcccttccccgggccccccgttacgggttaccccg

SEQ ID NO: 74799 - DNA, 786 bp, Homo sapiens
  misc_feature: GYAE6OF01AO5JH.49.20.B09.1.454.CMB.1.raw
  modified_base (175)..(175): a, c, t, g, unknown or other
  misc_feature (175)..(175): n is a, c, g, or t
  modified_base (238)..(238): a, c, t, g, unknown or other
  misc_feature (238)..(238): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctcggtntctgtgtcctcaggacagacggccaggatcacctgctcgtggcgatgctattcgaccaaaaanatatgacttacgtacggtacagacagacggccacggccacggcccctgtcgttggtagtaatttaagtaaagtacgtttaggacgtaccggtccctacgaccgggacccctagacgtcgtacttcgtcgtcggtcctacccgacgtcgtaccgaacgggtaacctaaacgtacgtaccgtaccgtttacgaacctacgtacgaggtacgggtaccggtccccgggaccgtaagggaacgggtaaccgggtacggtaccgttacggtaaccttaacgtttaaccgtcgttaccgtaccggtacccgaacgtaacggaaccgtaacgggtacggtaacgggttacgggtaaccgttaggttttaccgttacgggtttacccggttaacgggttcccggggtaacggggtaaccggggtaacccgttacccgggttacccgttaacccgggtaacccggttcccggttaacgggtaccccgaacgggtacccccggtaaacggggttcccccgtacccccgggttacccccccgtttaggggttacccccc

SEQ ID NO: 74800 - DNA, 653 bp, Homo sapiens
  misc_feature: GYAE6OF01BYYKB.49.20.B09.1.454.CMB.1.raw
  modified_base (187)..(187): a, c, t, g, unknown or other
  misc_feature (187)..(187): n is a, c, g, or t
  modified_base (359)..(359): a, c, t, g, unknown or other
  misc_feature (359)..(359): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtccaccctcggtgtctgtgtcctnaggacagacggccaggatcacctgctctggcgatgctattcgaccaaaaacaatatgtactttaacgtcggtaaccagacagacggccaggccacggccccttgtcgttggtagtaatttaataaagtctttagagacgtccctacgacgggccctagagcgtattctacgnggtcctcagctacgaacgggaacaacgtacgtacctacgttacgacctatacgaggtaggacggtccggaccgaggacggacggagcttagacttattacgtcgtacgacgtccgagaagacgagcgtaaggtcggtacgtaaggtttagtacgttacggttacggttcggggtacgggtacggtaacgttaccgggaccgttacgggtaaccccggttcggttaaccggggtccgaaccggtaccccggaaccgggtacccggttccccgtccccccggttggttaacccccg

SEQ ID NO: 74801 - DNA, 517 bp, Homo sapiens
  misc_feature: GYAE6OF01DM7NR.49.20.B09.1.454.CMB.1.raw
  modified_base (186)..(186): a, c, t, g, unknown or other
  misc_feature (186)..(186): n is a, c, g, or t
  modified_base (234)..(234): a, c, t, g, unknown or other
  misc_feature (234)..(234): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggatctgaggcctcctatgagctgacacagtcaccctcggtgtctgtgtcctnaggacagacggccaggatcacctgctctggcgatacattgaccaaaanatatgcttactggtaccagcagaggccaggccaggcccctgtcttggtgatttataaagtactttgagaggccctcgagggacccctgagcgattctctggctccagctcgagggacaacagtcaccttgaccatcagtggacgtcgccagaggacgaggctgactattactgtcagtccgcagacagcagtggctagttagtgtacgtagttcgggcggagggactacggcgtggacccgtctaggtccagacccgaaggcctcgccccctgggtctacccg

SEQ ID NO: 74802 - DNA, 599 bp, Homo sapiens
  misc_feature: GYAE6OF01ECN4V.49.20.B09.1.454.CMB.1.raw
  modified_base (234)..(234): a, c, t, g, unknown or other
  misc_feature (234)..(234): n is a, c, g, or t
  modified_base (283)..(283): a, c, t, g, unknown or other
  misc_feature (283)..(283): n is a, c, g, or t
  modified_base (290)..(290): a, c, t, g, unknown or other
  misc_feature (290)..(290): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctggaggcctcctatgagctgacacagtcaccctcggtgtctgtgtcctcaggacagacggccaggatcacctgctctggcatgcattgaccaaaaanatatgcttactggtaccagcagaggccaggccaggcccctgtcttggtntatttanaagtattagtagacgccgtcgacggacccgtcgagcgtacttactcgtgtctccacgcgtacgagggaacaactaacgtactacccgtacgtaccactacgtaggtcggtacggtaccggccgaacggaaggacggtaggttaggtactaagtttacgtcgtacgtacgtaccgtcgagacgacgacgtacgtaggcgtatttagtcgttacgttacggtacgggtcgggtaaggcggtaccgtcgtacggtcccgtacgtcggtaccgacgacccgtacggccgtccgtccccgtccgtcgttacccg

SEQ ID NO: 74803 - DNA, 515 bp, Homo sapiens
  misc_feature: GYAE6OF01EXTQS.49.20.B09.1.454.CMB.1.raw
  modified_base (236)..(236): a, c, t, g, unknown or other
  misc_feature (236)..(236): n is a, c, g, or t
  modified_base (505)..(505): a, c, t, g, unknown or other
  misc_feature (505)..(505): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggagatgcattgccaaaaccgntatgcttattggtaccagcagaagccggccaggcccctgtgttggtgatgtataaagacactgagacggccctcgagggatcccctgacgcgtattctctggctccgaggtcagggacaacggtcacagttggccatcgagtggagtccaggcagaggacgaggctgactattattgtacaatcaacagacaccgtattaggtacttagtgtacttacggaactgacgaccaaggtccaccgtctgggcacgcccaacggcccaacccnctcgtctacc

SEQ ID NO: 74804 - DNA, 526 bp, Homo sapiens
  misc_feature: GYAE6OF01DU7Z7.49.20.B09.1.454.CMB.1.raw
  modified_base (358)..(358): a, c, t, g, unknown or other
  misc_feature (358)..(358): n is a, c, g, or t
  modified_base (433)..(433): a, c, t, g, unknown or other
  misc_feature (433)..(433): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtcttggtgtatttataaagtactttgagacggccctgacgggacccctgagcgtattctctggctccagctcgagggacaacngtcaccttgaccatcagtggacgtccggcagaggacgaggctgactattactgtcagtccgcagacagcaggtgntagttatgtcgtagttcgggcggacgggactacggcgtaggacccgttcgtacggtcacggtcccaacgggcctcggcccccgttggtacccg

SEQ ID NO: 74805 - DNA, 560 bp, Homo sapiens
  misc_feature: GYAE6OF01DBUEE.49.20.B09.1.454.CMB.1.raw
  modified_base (281)..(281): a, c, t, g, unknown or other
  misc_feature (281)..(281): n is a, c, g, or t
  modified_base (301)..(301): a, c, t, g, unknown or other
  misc_feature (301)..(301): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagacggccaggatcactgctctggcatgcattgaccaaaaacatatgcttactggtaccagcagaggccaggccaggtcccctgtcttggtntatttataagtacttgacgngccctgacggaccctgacgcgtattctcgtggctcagctcgaacgggacaacgcgtacactattcgacctagtcgagtcggaacgtcccggcaaggaggaacgacggtctacgacttattactgtacgacgtccgcagacaggtcaggtggaccttaggtttctcggttcggtacgttcgggacggtaacgggtacctacgggactcggtaccgtccgtaaggtccacggacccgaaggtcctcccggcccccgttcgg

SEQ ID NO: 74806 - DNA, 536 bp, Homo sapiens
  misc_feature: GYAE6OF01D3MO1.49.20.B09.1.454.CMB.1.raw
  modified_base (436)..(436): a, c, t, g, unknown or other
  misc_feature (436)..(436): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccacggcccctgtcttggtgtatttataaagtactttgagacggccctcgacgggacccctgacgcgtattctcgtggctccgagctcgagggacaacgacgtcaccttcgaccatcgagtggacgtccggcgaggacggacgaggtctagactattacgtgtcacgtccgnagacagcagcgtactagttactgtacgtacgttcgggcggagggactacgcgtacgaccgtcgtacggtcacgcccgaaggcctccgccccgtcgtaccg

SEQ ID NO: 74807 - DNA, 530 bp, Homo sapiens
  misc_feature: GYAE6OF01BYEVO.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccaggcccctgtcttggtgatttataaagactttgagagggcctcgagggacccctgagcgattctctggctccagctcacgcacaacagtcacgttcgaccatcagtggacggtccgggacgaggaggacggaggcgtgaacttattactgtacagtacatacagtacagtagtggactacttcgtgtcgtagttcggacggagggaccaggtcgtcgcccgttacctacgggtcacggacccgaggaccgtcgcccccgttccgg

SEQ ID NO: 74808 - DNA, 559 bp, Homo sapiens
  misc_feature: GYAE6OF01CD6KI.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttataaagactttgagacggccctacgacgggacccctggacgcgattcctcgtggctccgagctcgagggacaacagtcaccttgaccatcagtggacgtccggacaggaggacgaggctgactattactgtcgagtcccgacagacgagcaggtcggactagttagtggtcgtacgttcgggcgggtaacgggaccgtacggcgtacggtacccggtcgttacggtccacggtaccccgaaggcccttcccggcccccgttcggttaccc

SEQ ID NO: 74809 - DNA, 710 bp, Homo sapiens
  misc_feature: GYAE6OF01ELU2A.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgagcctcctatgagctgacacagtccacccgttcggtgtctgtcgtcctgaggacagaccggccaggactcacctgctcgtggcgatgactattacgaaccaaaaactatacgtcgtacttacgtcggtaaccaggcaaggacggccaacgggccgaaccggtcccccttggttccgtttggtacgttaattttaaagtaaaacgtacttttaggaacgtacggtaccccttacggaaccggggtacccctggaacggcgttaacttccgtacgtcggtccctccgaagtccgtacggaaacgggaacctaaacgtacgtaccctaaccgtttcgaacctacgtcgacggttacggaccggtccggaccgaagggtaacggaacgacggtactagtacttaagtttacgtcgtacaccggtccgacaacgacgtagacgtaaggcgtacgtagtttagtacggttaggttacggtcgggacgggtacggtaaccttcggtacgttaccggaacccggttcgaacggtacgaccgtacccgaacgtcccgtcccgtcccccgtggtaccccg

SEQ ID NO: 74810 - DNA, 540 bp, Homo sapiens
  misc_feature: GYAE6OF01AIRJQ.49.20.B09.1.454.CMB.1.raw
  modified_base (245)..(245): a, c, t, g, unknown or other
  misc_feature (245)..(245): n is a, c, g, or t
  modified_base (290)..(290): a, c, t, g, unknown or other
  misc_feature (290)..(290): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
  modified_base (455)..(455): a, c, t, g, unknown or other
  misc_feature (455)..(455): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttacnggtaccagcagaggccaggccaggcccctgtcttggtgtatttanaaagtactttgagacggccctcgacgggacccctgacgcgtattctcgtggcctccagctcgagggacaacagtccaccttgaccctagtcaggtggacgtccgaaccgagacggacgaggctagactattactgtacagtccgnacgacngcagngngtagttntgtcgtagttcgggcggtaggtacgtacgtcgtcgaccgtccgtaggtccacgacccgaggtccctccggcccccgttggtaccc

SEQ ID NO: 74811 - DNA, 519 bp, Homo sapiens
  misc_feature: GYAE6OF01A95TD.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttaataaagtactttgagaggccctcgacgggacccctgagcgattctctggctccagctcgagggacaacacgtcaccttgaccatcagtggacgtccggcagaggacgaggctgacttattactgtcagtccgcagacagcagtggactagttatgtacgtacgtcgggcggtagggactacggcgtcgaccggtctaggccacgcccgaaggcctccgccccgtcggtcc

SEQ ID NO: 74812 - DNA, 534 bp, Homo sapiens
  misc_feature: GYAE6OF01BIR3Q.49.20.B09.1.454.CMB.1.raw
  modified_base (234)..(234): a, c, t, g, unknown or other
  misc_feature (234)..(234): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcagaggccaggccaggcccctgtcttggtgtatttataaagtactttgagacggccctcgacgggacccctgagcgtattctctggctcgagctcgaggacaacagtcaccttgaaccatcaggtggacgtccggacgaggaggacgaggctaggacttacttacgtgtacacgtccgcacgacagcgaggtgactagttatgtcgtagttcggacggaggtacgtacgcgtagacccggttcgtaggtcacgtaccgaggacctccgccccgtggtaccc

SEQ ID NO: 74813 - DNA, 535 bp, Homo sapiens
  misc_feature: GYAE6OF01BPIKE.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgtatttataaagctttgagaggccctcgacgggacccctgagcgattctctggcctccagctcgaggacaacagtcaccttgaccatcgaggtggacggtccgcgaagacgggacgaggctagacttattactgtcgagtccgacagacagcaggtgctagttatgtacgtagttcgggacggtagggacgtacggcgtacggaccggttcgacggtcgacgcccgaaggccctccgcccccgtcggtacc

SEQ ID NO: 74814 - DNA, 516 bp, Homo sapiens
  misc_feature: GYAE6OF01BLUFA.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcgagggacccctgagcgattctctggctccagctcgagggacaacagtcaccttgaccatcagtggacgtccggccagaggacgaggctgactattactgtcagtccgcagacagcagtgacagtttatgtcgtagttcggacgggtaggacgtacggctggaccgttcgtacggtcacgcccgaaggcctcgcccccgtcggtaccc

SEQ ID NO: 74815 - DNA, 514 bp, Homo sapiens
  misc_feature: GYAE6OF01ETTCP.49.20.B09.1.454.CMB.1.raw
  modified_base (375)..(375): a, c, t, g, unknown or other
  misc_feature (375)..(375): n is a, c, g, or t
  modified_base (451)..(451): a, c, t, g, unknown or other
  misc_feature (451)..(451): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggatcacctgctctggcgatgcattgaccaaaaacaatatgcttactggtaccagcagaagccaggtcacggcccctgtcttgatctatttaataaagtactttagagagggcctcgacgggacccctgagcgattctctggctcagctcagcgacaacagtcacgttgaaccntcgagtggacgtccgggagagaggacgaggctagacttattacgtgtacagtcatcagacgtagtagtgctacttntggtctagtcggacggtacggacagctgacccgtcgtacgtcacgaccacggcgtcgtccccg

SEQ ID NO: 74816 - DNA, 778 bp, Homo sapiens
  misc_feature: GYAE6OF01B317C.49.20.B09.1.454.CMB.1.raw
  modified_base (242)..(242): a, c, t, g, unknown or other
  misc_feature (242)..(242): n is a, c, g, or t
tcagagtcgagagacacgaccggtgctcgatttagtgtagtgtgaaggggctgtgggtccaggaggcagaactctgggtgtctcaccatggcctggatccctctacttcctccccctcctcactctctgcacaggctctgaggcctcctatgagctgacacagtcaccctggtgtctgtgtcctcgaggacagaccggccaggactccacctgctcgtggcgatgactattcgaccaaaaanatatcgtacttacgtacggtaccagacgaacggacggaccgacggccccgaacggtccccccgtggttccgtttagggtagttaagttttaaacgtaaaaggttaccttttaggaacggtacgggtacccccttaccggaaccgggtaaccccccgttggaacggtaccgtaatttccgtcgtcggtccctccgacgccgtacggaacgggaacaaaccgtacgttacccgtaacccgttcgaacccgtagtaccggtaaggttcgggaccggttaccccgggaccgaaggggacggaaccggacgggtaccgttaacgtaaccgtttaacgtttaaccggtacgttaccgtaccggttacccgacgaaccgtaacgacggtaccgtaagggtacggttaccgtaggttttaacgtacggttaccggttaggttaccggggacgggtaacgggtacccgtaccgtcgtaccggtacccggtaccgtacggtacgaccgacccgtacggtccccgtcccgtaccccggtccgtcccg

SEQ ID NO: 74817 - DNA, 565 bp, Homo sapiens
  misc_feature: GYAE6OF01BVIUV.49.20.B09.1.454.CMB.1.raw
  modified_base (234)..(234): a, c, t, g, unknown or other
  misc_feature (234)..(234): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcagaggccaggccaggcccctgtccttggtgatttataaagactttgagaggccctcacgggacccctgagcgattctctgctccagctcgaagggacaacgacgtcaccttgaccatccgaggtggacggttcccggaccgaggaacgggacgaacgggctcggaacttattactcgtacagtcccgacacgacgagacgagtacgggtactagtttacgtggttcgttacgttcgggacggtacgggtactacggctggacccgttccgtacggtcacgacccgacggcctccggcccccgtgggtaccc

SEQ ID NO: 74818 - DNA, 692 bp, Homo sapiens
  misc_feature: GYAE6OF01B2MQH.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagacggccaggatccacctgctcgtggcatgcattcgaccaaaaacatatgtacttactcggtaccagcagacggccaggccacggcccctgtcgttggtgtatttaataaagtctttgagacgtccctcgacgggaccctgacgcgtattcctcgtggcctccagtctacggaagggaacaacgtacgtacctaccgttcgaaccctagtaccgacggtacgggaccggtcccggaccgtaagggaacggaccggacggtcttacgtactttaacgtttactcgtaccgacggttcccgacgtaacgaacgtacggacgtagggtacggacgttaaaggtttacgtacgggttacgttacgggttccggggacggggttaacgggtaacccgttaccgggtaccgttacgggtaccccggttacggttaacgggttacccgaaccggtaccccggttaaacgggccccgttacccccggtccccccgttcgggttaaccccc

SEQ ID NO: 74819 - DNA, 534 bp, Homo sapiens
  misc_feature: GYAE6OF01ECPDW.49.20.B09.1.454.CMB.1.raw
  modified_base (450)..(450): a, c, t, g, unknown or other
  misc_feature (450)..(450): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccacggcccctgttcttggtgtatttaataaagtctttaggagacggccctcgacgggacccctgagcgtattctctggctcagctcgaggacaacagtcacttgaccatcgagtggacgtccggcaaggacggacgaggctagacttattactgtacacgtccgacagacagcaggtgactagttntgtcgtagttcgggcggtacggactacggcgttaggacccgttcgtaggtccacggacccaaggcctccgccccgtggtacccg

SEQ ID NO: 74820 - DNA, 530 bp, Homo sapiens
  misc_feature: GYAE6OF01D5HKQ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttagaaagtctttagagacggccctgacgggacccctggacgcgtattcctcgtcggtctccgagctacgagggacaacacgtcaccttgaccatcaggtggacgtccggcaggaggacgaggctgactattactgtcacgtccgacagacagcagtggactagttatgtacgtagtcggcggaggacgtacgctacggaccgtccgtaggtcacggtcccaggcctccgccccgtcggtaccc

SEQ ID NO: 74821 - DNA, 560 bp, Homo sapiens
  misc_feature: GYAE6OF01BRS9D.49.20.B09.1.454.CMB.1.raw
  modified_base (214)..(214): a, c, t, g, unknown or other
  misc_feature (214)..(214): n is a, c, g, or t
  modified_base (234)..(234): a, c, t, g, unknown or other
  misc_feature (234)..(234): n is a, c, g, or t
  modified_base (343)..(343): a, c, t, g, unknown or other
  misc_feature (343)..(343): n is a, c, g, or t
  modified_base (467)..(467): a, c, t, g, unknown or other
  misc_feature (467)..(467): n is a, c, g, or t
  modified_base (541)..(541): a, c, t, g, unknown or other
  misc_feature (541)..(541): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcacaggctctgaggcctcctatgagctgacacagtcaccctggtgtctgtgtcctcgaggacagaccggccaggactcacctgctntggcatgcattgaccaaaanatatgcttacgtggtaccagcagacggccaggccaggcccctgtccttggtgtatttataaaggtctttgacgacggtcccctgacgggcccctaggacgcgtacttcncgtggcctccgagctcgagggacacgacgtcacttgacctattccagttcggacgtccggacaggacggacgaggctgacttattacgtcgtcacgtccgacgagacagcaggtgtactagttntggtcgtagttcgggacggaggtacctacggtccgtaggtacccgttcgacggtcaccggaccgaacgggtccnccggtcccccgtggtcccg

SEQ ID NO: 74822 - DNA, 579 bp, Homo sapiens
  misc_feature: GYAE6OF01EDDLM.49.20.B09.1.454.CMB.1.raw
  modified_base (244)..(244): a, c, t, g, unknown or other
  misc_feature (244)..(244): n is a, c, g, or t
  modified_base (345)..(345): a, c, t, g, unknown or other
  misc_feature (345)..(345): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattgaccaaaacaatatgcttacnggtaccagcagaggccaggccaggcccctgtcttggtgtatttataaagtactttgagacggccctcgacgggacccctggacgcgtattctctggctccngcctacgacgggaacaacacgtcaccttgacctatcagtggacgtccggacagggacggacgaggctagacttaattacgtgtacgacgtcccgagacgacgacgacgtaggtggacgttaagttattggttacgttaggttccgggacgggacgggtacctaccggcgttacggacccggttccgtacggtccaacgaccccgaagggtccctccgtcccccgtcggtacccg

SEQ ID NO: 74823 - DNA, 580 bp, Homo sapiens
  misc_feature: GYAE6OF01BW7EO.49.20.B09.1.454.CMB.1.raw
  modified_base (234)..(234): a, c, t, g, unknown or other
  misc_feature (234)..(234): n is a, c, g, or t
  modified_base (461)..(461): a, c, t, g, unknown or other
  misc_feature (461)..(461): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcagaggccaggccacggcccctgtcttggtgtatttagtaaagtctttgagacggtccctacgaacgggacccctgacgcgtattccgtcgtcggcctccagctacgaagggaccaaacgcgtaccaaccttcgaacctagtcgtaggtcgggtacgtcccggacgaaggacggacgaggtctagacttagttactgtctacgtccgnaacgcacgcaggtcgacgtagttagtgtacgtagttcgggacggtaggaccgtacgtcgtcggtacccgtcgtacggacaccggaccgaacggcccttcccggcccccgttcggtaccc

SEQ ID NO: 74824 - DNA, 773 bp, Homo sapiens
  misc_feature: GYAE6OF01EB557.49.20.B09.1.454.CMB.1.raw
  modified_base (288)..(288): a, c, t, g, unknown or other
  misc_feature (288)..(288): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtgtctgtgtcctcaggacagacggccaggatcactgctctggcgatgcattgaccaaaaacatatcgcttacgtggtaccagcagacggccaggccacggcccctgtcgttggtntatttaataaagtctttagagacggccctacgacgggacccctggacgcgtacttcctcgtcggcctccgagtcctacgaacggggaaccaaacctacggtccctaaccgtttcgaaccctacgtaccgtaaggtacgggtaccggtacccgggacccgaacgggaacgggtaaccggacgggtaccgttaacggtaaccctttaacgtttaaccgttaccgggtttccgtaaccgggttaccccggaccgaacgggtaacccgaacgggtacctaacggggttcgggtacccgtttaaagggtttaacgttacgggtttaccggttaacgggtttccggggaccgggggtaaaccggggtaacccggttacccgggtaccgttcccgggtaaccccggttacccggttaacgggttacccgtaacccgggtaccccgtaaacgggtccccgttacccggtcccccccggttcgggtacccccgg

SEQ ID NO: 74825 - DNA, 523 bp, Homo sapiens
  misc_feature: GYAE6OF01D48SW.49.20.B09.1.454.CMB.1.raw
  modified_base (362)..(362): a, c, t, g, unknown or other
  misc_feature (362)..(362): n is a, c, g, or t
  modified_base (445)..(445): a, c, t, g, unknown or other
  misc_feature (445)..(445): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgtaatttaataaagactttgagacggccctcgacgggacccctgagcgtattctctggctccagctcgagggacaacngtcacttgaccatcagtggacgtccggcaaggaggacgaggctagactattactgtcacgtcgcagacagcaggtgctagttntgtcgtagtcggacggacggacgtacgcgtacgaccggttcgacggtcacgcccgaaggcctcgccccgtcggtaccc

SEQ ID NO: 74826 - DNA, 608 bp, Homo sapiens
  misc_feature: GYAE6OF01CKM9P.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtcaccctcggtgtctgtgtcctcaggacagacgccaggatcacctgctctggcgatgcattgaccaaaaacatatgcttactggtaccagcagacgccaggccacggcccctgtcttggtagtatttataaagtactttgaggacgccctcgacgggacccctgacgcgtattcctcgtcggcctaccgagtcgtcgaacgggaaccaacgtacgtcctaccgttcgaacctactacgtaggtcggtacggtccccgggacgaacggaggaccggagggctaggaaccttagttacgtgtacacggtcccgagtaacgacgacgaccgtaggtcggcgtacgttagtcgtacggtacggttcgggacgggtacggacttacggcttaccggtacggttcccgtaggtacccgacgcccgaaggccgtccgtccccgtcggtaccc

SEQ ID NO: 74827 - DNA, 545 bp, Homo sapiens
  misc_feature: GYAE6OF01DG8YB.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccacggcccctgtcttggtgtatttataaagtactttgagacggccctcgacgggacccctgacgcgtattctcgtggctccagctacgacgggacaacgacgtcaccgttcgaccatcaggtggacggtcccggcgaggacggacgaggctgacttattacgtcgtcagtccgcagacagcgagtggctagttacttgtcgttagttcgggacggacgggtacctacggcgtcggacccgttccgtaggtcacggcccaggcctccgccccgtggtaccc

SEQ ID NO: 74828 - DNA, 538 bp, Homo sapiens
  misc_feature: GYAE6OF01CY9VW.49.20.B09.1.454.CMB.1.raw
  modified_base (363)..(363): a, c, t, g, unknown or other
  misc_feature (363)..(363): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaaacagtatgcttactggtaccagcagaggccaggccaggcccctgtcttggtgtatttataaagtactttgagtaggccctacgacgggacccctgacgcgattcctcgtggcctcagctcgagggacaacngtcaccttgaccatcagtggacgtccggcaggaggacgaggactgtactattacgtgtcgacgtccgcagacagacaggtgctagttatgtcgttagtcggcgggaggaccgtacgcgtgtacccgtcgtacgggtaccacgtacccgaaggcctacccgtccccgtcgggtccc

SEQ ID NO: 74829 - DNA, 567 bp, Homo sapiens
  misc_feature: GYAE6OF01BOZA9.49.20.B09.1.454.CMB.1.raw
  modified_base (395)..(395): a, c, t, g, unknown or other
  misc_feature (395)..(395): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagtctttagagacggccctgacgggaccctgagcgattctctggctccagctcgaggacaacagtcaccttgaccatcgagtggacgtccggacaggaggacgngctagactattcngtcgagtcccganagacagcagtcggactagtttatggttacggttagttccgggacggtacgggtaccttacggcgttaccggacccggttccgtaacgggttccgaaccggtaccccgaaacgggtccgttccccggtccccccgttcgggtaaccc

SEQ ID NO: 74830 - DNA, 565 bp, Homo sapiens
  misc_feature: GYAE6OF01AO8UE.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaacatatgcttactggtaccagcagaggccaggccacggcccctgtcgttggtgtaatttataaagtactttgagacggccctacgacgggacccctggagcgtattctcgtggctccagcctcgagggaccaacgacgtccaccttgacctatcgaggtcggacgtccggacgaggaggacggaggctagacttattacgtcgtacacgtccgcaagacagacaggtggactaggttatggtacgtagttcgggcggtacgggtactacggcgtacggacccgttccgtacgggtcacggtacccgaacggtccgtccgcccccgtggtacccg

SEQ ID NO: 74831 - DNA, 543 bp, Homo sapiens
  misc_feature: GYAE6OF01DGPTV.49.20.B09.1.454.CMB.1.raw
  modified_base (367)..(367): a, c, t, g, unknown or other
  misc_feature (367)..(367): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacatatgcttactggtaccagcagaggccaggccaggcccctgtcttggtgtaatttataaagtactttgaggacggccctcgacgggacccctgacgcgtattctcgtggctccagctacgacgggacaacngtcaccttgaccatcgagtcggacgtccggcaggaggacgagctgactattacgtgtcacgtccgacacgacgagcgaggtggactagttatggttcgtagttcgggcgggaggtactacggtcgtagacccgtcgtacggtcacgcccgaacggcctccgcccccgtggtacccg

SEQ ID NO: 74832 - DNA, 516 bp, Homo sapiens
  misc_feature: GYAE6OF01BZRCA.49.20.B09.1.454.CMB.1.raw
  modified_base (343)..(343): a, c, t, g, unknown or other
  misc_feature (343)..(343): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttataaagactttgagaggccctcagggacccctgagcgattctctggctcagctnagggacaacagtcacttgaccatcagtggacgtccggccaggagacgaggctgactattactgtcacgtccgcagacagcagtggcagtttatgtcgttagtcggacgggaggactacgcgtacgccggttccgacggtccacggcccaaggcctccggccccctcggtaccc

SEQ ID NO: 74833 - DNA, 609 bp, Homo sapiens
  misc_feature: GYAE6OF01EICDD.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgctattcgaccaaaaacaagtatgcttactggtaccagcagacggcaggccacggtcccctgtccttggtagtatttaataaagctttgagtacggccctgacgggaccctgacgcgattctcgtggctccgagctcgaacggaccaacgtacgtcctaaccttggacccatcgagtcggacgtccgacgaaggacggacgagtcgtagtactacttactgtctacgtccgacgacgacgagaccgaggtcggtacctaagtttctacggtttacgttacgttcggggacgggtaacgggtaaccgttaccggcgtaccggtacccggtccttacgggtacgtaccggaacccctacgggtccctcccggtccccccgtgggttaacccc

SEQ ID NO: 74834 - DNA, 575 bp, Homo sapiens
  misc_feature: GYAE6OF01D0QKZ.49.20.B09.1.454.CMB.1.raw
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
  modified_base (450)..(450): a, c, t, g, unknown or other
  misc_feature (450)..(450): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (484)..(484): a, c, t, g, unknown or other
  misc_feature (484)..(484): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtgtctgtgtcctcaggacagacggccaggatcactgctctggcgatgcattcgaccaaaaacatatgtcttactggtaccagcgagaggccacggccacggcccctgtcttggtntatttaataaagtntttgagcggccctacgacgggacccctggacgcgtattccgtcgtcggcctccgagctacgaagggaccaaacgacgtctaaccgttacgacctagtcgaggtcggacgtccggacgaaggacggacgacgcgtagacttagttacgngtcacgtccganacganagcgaggtgactagttntgtcgttagtcgggacggtagggacctacgtcgtacggaccgttcgtacggtccgaacgacccgacggtctcccggccccgtcggtacccg

SEQ ID NO: 74835 - DNA, 663 bp, Homo sapiens
  misc_feature: GYAE6OF01BE5CZ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagaccggccaggatcacctgctctggcgatgcattgaccaaaacatatgcttaactggtaccagcagaggccaggccacggcccctgtcgttggtagtatttagtaaaagtactttgaagacggccctgacgggacccctggacgcgtattcgtcgtcggcctccgtagttcgaagggaaccaacgtacggtccaacctttcgaacctactcgaagtgggacggtcccggaccgaaggacgggaacgacgggtctaggtaaccttaagtttaccgtaggtcctaacggttcccggacaacggaacctacgacgtaggtacggaccgttaaggtttattcggtacggtttacggttaccgggacgggaacgggtaccgttaacggtccgtaccggtaacccggttaccgtacgggtacccgacggtaccccgaaacggtcccgttacccggccccccgttcggtccgtaaccccg

SEQ ID NO: 74836 - DNA, 681 bp, Homo sapiens
  misc_feature: GYAE6OF01ECCIU.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacagactctgaggcctctatgagctgacacacgcccacccgtcggtgtctgtcgtcctcgaggacaggaccggccagtactccacctgctcgtggagatgctattcgaccaaaagcaatatgtacttacgtcggtaccagacaagaacgccgacggcccgacggccccttggtcttagacttactaattttaagtaaagtacgtttaggaggtacgggtcctacggaccgggtacccctggacgcgtactttccgtcgtcggtcctccgacgtcctcgaacggaccgaaacaaacgtacgtacctaacggtttacgaacctacgtaccgaagggtcgggacgggtcccgggagaagggacgggacggaggtcgtagtacttagttacgtgtacgacgtacaacgttacgaagtaccgtaggttacggttacggaccttacgttcgttcggttacggttacggttccggggacgggtaaccggtaaccgacggtcgtaccggtacccggttaccgtacggtaccaccggacccgtaggtcccgtacccccgg

SEQ ID NO: 74837 - DNA, 707 bp, Homo sapiens
  misc_feature: GYAE6OF01DN63D.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggactcacctgcctcgtggcgatgctattcgaaccaaaaactatatgtacttacgtcggtaccagcaaggacgccgaggcccgacggtcccctgttcgttggtagttaatttaagtaaagtacgtttaggacggacgtcccgtcgaccgggacccctgacgtcgtattccgtcgtacggcctaccgagtcctacggaacgggaaccaaacgtacggttaccctaacccgtttacggaaccctaacgttcgaacgggttacgggtacccgggtaccccgggaccgaagggaaccgggtaacgggaacgggtaccgttacgtaaccgtttaacgtttacgttacgtaccgtaccggtcccgtacgaaccgacgaacgcgaggttcggtacgttagtttagttcggttacggttacggtccgggtacgggacggtaccgtaccggtcgtaccgtaccggtccgtacggtccgacgtcccgaacggccttcccgtccccgttcggtacccg

SEQ ID NO: 74838 - DNA, 557 bp, Homo sapiens
  misc_feature: GYAE6OF01BX9ZH.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcgttggtgtatttaataaagtactttgagacggccctcgacgggacccctgacgtcgattctctggctccagctacgagggacaacgacgtactaccttacgaccatcgaggtcgggacgtccggcgaaggacggacgaggcgtagacttagttactgtcgacgtccgacagacagcgaggtgactagttatggtcgtacgtcgggacggtacggacgtacggcgtagaccggtccgtaggtcgacgtcccgaaggtcccgtccgtccccgtcggtaccc

SEQ ID NO: 74839 - DNA, 501 bp, Homo sapiens
  misc_feature: GYAE6OF01CGCWA.49.20.B09.1.454.CMB.1.raw
  modified_base (234)..(234): a, c, t, g, unknown or other
  misc_feature (234)..(234): n is a, c, g, or t
  modified_base (308)..(308): a, c, t, g, unknown or other
  misc_feature (308)..(308): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcagagccaggccaggcccctgtcttggtgatttataaagactttgagaggccctnagggacccctgagcgattctctggctccagctcagggacaacagtcacttgaccatcagtggacgtccggcagaggacgaggctgactattactgtcagtccgnagacagcagtggctagttagngtcgtagttcgggcggagggactacggctagaccgtctaggtcacgccaaggctcgccccgtggtacc

SEQ ID NO: 74840 - DNA, 601 bp, Homo sapiens
  misc_feature: GYAE6OF01DMI9J.49.20.B09.1.454.CMB.1.raw
  modified_base (365)..(365): a, c, t, g, unknown or other
  misc_feature (365)..(365): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcactgctctggcgatgcattcgaccaaaaacatatgtcttactggtaccagcagacgccaggccacggcccctgtcttggtagtatttaataaagtctttgagcggccctacgacgggacccctgacgcgtattctctcggctccagctcgagggacaacncgtacaccgttgacctatcgaggtggacggtaccggcgaaggacgggacgaaggtctagtaacttattacgtcgtacgacggtccgactaacgacgagacgtaggtcggacgtagtttacgttacggtcgttaagttccggggacgggtacgggtacgtaccggcgtaccggtacccgttaccggtacgggtacaccggtacccgaacggtccctccccggtccccgtcggtaccc

SEQ ID NO: 74841 - DNA, 737 bp, Homo sapiens
  misc_feature: GYAE6OF01DKXV6.49.20.B09.1.454.CMB.1.raw
  modified_base (285)..(285): a, c, t, g, unknown or other
  misc_feature (285)..(285): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctctgtgtctgtgtcctcatgacagacggccaggatcacctgctctggcgatgcattacgaccaaaacatatgcttactggtaccagcagacgccaggccacggccctgtcttggtntatttataaagtcgtttgacgacggccctcgacggacccctgacgcgtacttcgtcgtcggccttaccgacggtctacgaacggggaccaaacgtacgtacctaaccgttagaaccctagtaccgacggttacgggacggtacccgggaccgtaacggaacgggaacggtacgggtaccgttacgtaaccgttaacgtttaccgttcggttaccgtacggttaccggaccgtaacggaaccgaacggtccgtaacgggtacggtacgttaacggtttacggttacggtttaccggttaacgggttccggggacccggggtaacggggttaacccggttaccgggttaccggttacccggtaaacccgggttaccccgtttaaacggggtacccgtaaacccgggtacccccggtaaacgggtccccggttacccgggttacccccccccggg

SEQ ID NO: 74842 - DNA, 526 bp, Homo sapiens
  misc_feature: GYAE6OF01BYWNW.49.20.B09.1.454.CMB.1.raw
  modified_base (325)..(325): a, c, t, g, unknown or other
  misc_feature (325)..(325): n is a, c, g, or t
  modified_base (358)..(358): a, c, t, g, unknown or other
  misc_feature (358)..(358): n is a, c, g, or t
  modified_base (397)..(397): a, c, t, g, unknown or other
  misc_feature (397)..(397): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtccttggtgtatttataaagactttgagaggccctgacgggacccctgancgattctctggctccgagctcgaagggacaacngtcaccttgaccatcagtggacgtccggcaggaggacgnggctgactatactgtcagtcgacagacagcaggtgacagtttagtgtcgtagttccgggaggacgggacctacgcgtacgacccgtccgtaggtccacgccccgaaggtcctccgccccgtcggtaccc

SEQ ID NO: 74843 - DNA, 570 bp, Homo sapiens
  misc_feature: GYAE6OF01EYYUQ.49.20.B09.1.454.CMB.1.raw
  modified_base (214)..(214): a, c, t, g, unknown or other
  misc_feature (214)..(214): n is a, c, g, or t
  modified_base (235)..(235): a, c, t, g, unknown or other
  misc_feature (235)..(235): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggatcacctgctntggcatgcattgaccaaaaanatatgcttactggtaccagcagaggccaggccacggcccctgtcttggtgatttataagactttgagacggtcctcgacgggtacccctgagcgattctctcggctccagctcgagggacaacgtacgtctaccgttcgaacctatacgtaggtcggaacgtccggacgaaggacggacgaggactagtaactacttacgtgtacaggtccacgagtacgagacaggtcggactagttatacggtcgttacgttcgggcggtacgggtactacgcgttacggacccgttcgtacggtacgacgtacccgaggcctccggcccccgtcggtacccg

SEQ ID NO: 74844 - DNA, 571 bp, Homo sapiens
  misc_feature: GYAE6OF01E3FI2.49.20.B09.1.454.CMB.1.raw
  modified_base (186)..(186): a, c, t, g, unknown or other
  misc_feature (186)..(186): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggatcacctgctctggcgatgcattcgaccaaaaacatatgcttacgtcggtaccagcagacggccaggccacggcccctgtcttggtgatgtaataaagacatgagcgccctgaggtctccgtgacgcgtattctcgtggcctcgaggtcgacgggaccaacggtcacgtagttcgacctagtcgaggtcggacgtccgaaggacgaggaggaacgaggctacgtacttattagttgtaactaatacaacgagacctaactagtttacgtaacttagtcgttacgttaggactggaccgtaaccgtacggtccgaaccggttccgtacgggtccaccggaccgaaccgacccaaccccgtagtcgtaccc

SEQ ID NO: 74845 - DNA, 591 bp, Homo sapiens
  misc_feature: GYAE6OF01CN3GS.49.20.B09.1.454.CMB.1.raw
  modified_base (237)..(237): a, c, t, g, unknown or other
  misc_feature (237)..(237): n is a, c, g, or t
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
  modified_base (334)..(334): a, c, t, g, unknown or other
  misc_feature (334)..(334): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtccaccctcggtgtctgtgtcctcaggacagacggccaggatcacctgctctggcgatgcattgaccaaaaanatatgcttacnggtaccagcagagccaggccagccctgtcttggatatttanaaagtctttagagtacggccctagacgggacccctgagcgattcncgtggctcgagctacgagggacaacacgtcaaccttgaaccatcagtaggacgtccggacaggaggacgaggctggacttattacgtgtcacgtccgacaagacgtaacgacgaaggttcggacctaaggtttagtcggttacggttacgtaccggggacggaacggggtacctaacggccgttaggacccgttcccgtaaggtaccgaccggtaccccgtaagggcccttaccccggcccccgttcgggttacccc

SEQ ID NO: 74846 - DNA, 564 bp, Homo sapiens
  misc_feature: GYAE6OF01B5OW1.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgtatttataaagtactttgagacggccctcgacgggacccctgacgcgtattctcgtcggctccagctcgagggacaacagtcctaccttgacctatcgagtcggacgtccggacgaggacggacgaggctagacttattactgtcacgtccgacacgacgagcaggtggtactagttactggttacgttagttcgggacgggagggtaccgtacgccgtagacccggttccgtacggtaccgacgacccgaaggcccgtccggtcccccgtcggtaccc

SEQ ID NO: 74847 - DNA, 599 bp, Homo sapiens
  misc_feature: GYAE6OF01DDDD7.49.20.B09.1.454.CMB.1.raw
  modified_base (372)..(372): a, c, t, g, unknown or other
  misc_feature (372)..(372): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcaggaggccaggccacggcccctgttcgttggtgtaatttaagtaaagtactttggacgacggccctcgaacgggacccctgacgcgtattctcgtggctccgagctacgaggacaacncgtcaccttgaccatcagtcggacggtccgacgaggacggacgacggtactagtaactagtttacgtacgtcacgtccgacacgacgagcgtaggtcgacgtagttacttcggtacgttacggtacggacgggtaacggtaccgtacggtcgttacggacccgttcggttaaccggtacgaccgtacccgaacgggtcccgttacccggtcccccgtgggttacccg

SEQ ID NO: 74848 - DNA, 612 bp, Homo sapiens
  misc_feature: GYAE6OF01DECRG.49.20.B09.1.454.CMB.1.raw
  modified_base (392)..(392): a, c, t, g, unknown or other
  misc_feature (392)..(392): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggccctctatgagctgacacagtcaccctcggtgtctgtgtcctcaggacagacggccaggatcacctgctcgtggcgatgctattcgaaccaaaaaacattaatgtactttacgtacggtaaccagccaggacggccaggccgacggcccctgtctttgggtagtaatttagtaaaagtactttaggagtacggccctacgacgggacccctgacgctattctcgtcgctccagtctacgagggtacaacncgtactaccttgaccatcgagtggacgtccgcgaggacggacgaggactgtaacttagttactgtcgacgtccgacagacagctaggtcgtacgttagtagtcgttacggttacggtacgggcgggaacggtacgtaccggtctaccggtaccgtccggttacggtacgaaccggtaccccgaagggtccccttacccggcccccgttcggttaaccccg

SEQ ID NO: 74849 - DNA, 740 bp, Homo sapiens
  misc_feature: GYAE6OF01BDO5P.49.20.B09.1.454.CMB.1.raw
  modified_base (197)..(197): a, c, t, g, unknown or other
  misc_feature (197)..(197): n is a, c, g, or t
tcagagtcgagagacacgaccggtgctcgatttagtgtagtgtgaagggggacggtgtgggtccaggaggcagaacgtctgggtgtctcaccgatggcctgggacctccctctacttctccccctccgtcacctctctcgcacgacggtcctcgtgacggcctcctagtgacgcctagacacgacgtcaccctcgtntcctcgtgtcctcagcagacggcaggatcacctgctctggtcgacgtgacgtagttcgaccaaaaacattaagtacgtactttacgtaggttaccgagtcaggacggaccgacggaccgacggacccctccgtacgttcggtacgtaatttaacgtaaacgtacgtttacggacggtacggtaccccgttacgtaccgggaacccctaggaccgggtccgtaactttccgtacgtcggtcttaccgacgtcgtcggaacgggtactaacgacgtacctaacctttcgacctactacgacgtacggtaccggtcccggacgaacggtacgggaacgtacgggtacgttacggttaacgtaactttaacgttcgttacgtacgtacccgacaacgtaactaacgtaccgtaacggttacggtactttacggttacgtacgggttaccgtaggttccgggtacggaacggtaccgtacggtaccgtaggaccccgttcggtacggcgtaccggtaccgacgtaccgtccgtaccccgtcggtaccc

SEQ ID NO: 74850 - DNA, 721 bp, Homo sapiens
  misc_feature: GYAE6OF01CWDJF.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcgaggacagacggccaggatcacctgctcgtggcgatgctattcgaccaaaaacatatgtacttacgtaggtaaccagcgaaggacggccgaacggcccgacggtcccccttaggttccgtttgggtacgttaattttaagtaaaaacgttaccgttttagggaaggtaccggggtcccttaccggaaaccggggtacccccttggaacggtcccggtaatttccgtcgttcggcccgttacccaacgtcctcgaacggcgaaaccaacgtacgtaccgtacgttacgaacctagtacgagggtcgggtacggtcccgggagaacggacgggacgaacgggtcttaggtaacttacgtttacgtcgttaccgtaagtccaagttcgaacgaacgtaaggtaggtcggaccttacgtttccgttggtaccgtttacggtccgggtacggggtacggaaccgtaacggtccgttacgggtaacccgtccggtaaaggtccgaaccgacccgtaggccctcccggtcccccgttaccggg

SEQ ID NO: 74851 - DNA, 616 bp, Homo sapiens
  misc_feature: GYAE6OF01CRZR2.49.20.B09.1.454.CMB.1.raw
  modified_base (214)..(214): a, c, t, g, unknown or other
  misc_feature (214)..(214): n is a, c, g, or t
  modified_base (371)..(371): a, c, t, g, unknown or other
  misc_feature (371)..(371): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggccctcctatgagctgacacagtcaccctcggtgtctgtgtcctcaggacagacggccaggatcacctgctntggcatgcattgaccaaaacatatgcttaactggtaccagcagacggccaggccaggcccctgtcttggtgtatttataaagtactttgagtacggccctacgacgggacccctggacgcgtattcctcgtcggctccagtctcgacgggacaacgngtccaccgttgaccatcagtggacgtccggacagaggacgaggcgtgacgtattacgtcgtacacgtccgacgaagacgaagcgaaggtcggactagtttagtcggttacgtacgttcgggaccggtacggggtaccttaaccgggccgttagggtaacccccggttccgttacgggtacctaaccgggaccccccggttaaagggtccccggttacccgcccccccgttaccggggttaccccg

SEQ ID NO: 74852 - DNA, 550 bp, Homo sapiens
  misc_feature: GYAE6OF01E0G7A.49.20.B09.1.454.CMB.1.raw
  modified_base (355)..(355): a, c, t, g, unknown or other
  misc_feature (355)..(355): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagagccaggccaggcccctgtcttggtgatttataaagtactttgagacggccctcagggacccctgagcgattctctggctccgagctcgagggacaacngtcaccttgaccatcagtggacgtccggcaggaggacgaggctgaactattactgtcgagtccgcagacagcgagtgactagttatgtacgtacgttcgggcggaagggtaccgtacggccgtacggtacccggtccgttaacgggtccaacgtaccccggaacggtcgtcccggtccccccgtcggggtacccc

SEQ ID NO: 74853 - DNA, 628 bp, Homo sapiens
  misc_feature: GYAE6OF01COLRB.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggcaggatcacctgctctggcatgcattgaccaaaacatatgcttactggtaccagcaggacgccaggccacggcccctgtcgttggtgtaatttataaagtctttgagacggccctcgacgggacccctgacgcgtattcctcgtcggcctccgacgctcgaacgggtaacaacgtacgtcctaccgttacgacctatcgagtcggacgtccggacgaggacggacgaggctagaacttagttacgtgtacgtaacgtcccgacgaacgtacgacgacgtaggtacgggtacttaaggttcttacggttaccgtacggttccgggacgggtacgggtaccgtaccggcgttacgggtaacccgttcccggtaaggcccgtaaccggtaccccgtaaggtaccccgtacccggtccccccggttcggtaccccg

SEQ ID NO: 74854 - DNA, 529 bp, Homo sapiens
  misc_feature: GYAE6OF01DOVYM.49.20.B09.1.454.CMB.1.raw
  modified_base (282)..(282): a, c, t, g, unknown or other
  misc_feature (282)..(282): n is a, c, g, or t
  modified_base (423)..(423): a, c, t, g, unknown or other
  misc_feature (423)..(423): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccagcccctgtcttggtntatttataaagtactttgagtacggccctcgacgggacccctgacgcgtattctctggctccagctcgaggacaacagtcacttgaccatcgagtggacgtccgacagaggacgaggctgactattactgtcacgtccganagacacgcgagtggctagttattcggtacgttagtcgggcggtaggacgtacgctaggacccgtcgtacggtcacgtacccgaagccgtccgccccgtcggtaccc

SEQ ID NO: 74855 - DNA, 595 bp, Homo sapiens
  misc_feature: GYAE6OF01A2ROL.49.20.B09.1.454.CMB.1.raw
  modified_base (234)..(234): a, c, t, g, unknown or other
  misc_feature (234)..(234): n is a, c, g, or t
  modified_base (245)..(245): a, c, t, g, unknown or other
  misc_feature (245)..(245): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagacggccaggactcacctgctcgtggcatgcattgaccaaaaanatatgcttacnggtaccagcagacggccaggccacggcccctgtcttggtntatttaanaaagtactttgagaggtccctgacggaccctgagcgtattcgtctggctcagctcgagggacaacgcgtcaccttagactatcaggtcggacgtccggacaggacggacgacggctagacttacgttacgtcgtacgacgtccgacgaacgtactaggactacgggtgtactagtttacgtgttacgtaggttccgggacgggtacgggtaacctacggtacgttacggacccgttaccggttacggtacccgaacggacccgtaacgggtcccgtccccggtccccccgttcgggttaccc

SEQ ID NO: 74856 - DNA, 655 bp, Homo sapiens
  misc_feature: GYAE6OF01CFGUE.49.20.B09.1.454.CMB.1.raw
  modified_base (176)..(176): a, c, t, g, unknown or other
  misc_feature (176)..(176): n is a, c, g, or t
  modified_base (218)..(218): a, c, t, g, unknown or other
  misc_feature (218)..(218): n is a, c, g, or t
  modified_base (443)..(443): a, c, t, g, unknown or other
  misc_feature (443)..(443): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacggcctcctatgagctgacacagtccaccctggtntctgtcgtcctgaggacagacggccaggactcacctgctcgnggcgatgactattcgaaaccaaaaactatagtgtacttacgtacgaaccgagaccgaaggacggaccgacgggaccgaccggtcccccttggttacgtttaggtagttaaatttaataaagtacgtttaggaggaccgtcccgacgacgggtaccctgtaacgcgtactttcgcgtcggctacgagtccgacgaacggaacaacgacgtacctacgtacgaactntacgagtggacgccggcaaggcggacgagtctaggtacttaacgtacgtcgtacgtaacggtccgagaacgacaacggactaggttacggattaacggttagttggttacgtacgggtaggacgggtacgtaccgttacggacgttacgacccgttaccggtagaccgtaaacccgggccgaacggtcccgtccgtccccgtggtaaccccg

SEQ ID NO: 74857 - DNA, 751 bp, Homo sapiens
  misc_feature: GYAE6OF01B46L3.49.20.B09.1.454.CMB.1.raw
  modified_base (218)..(218): a, c, t, g, unknown or other
  misc_feature (218)..(218): n is a, c, g, or t
  modified_base (312)..(312): a, c, t, g, unknown or other
  misc_feature (312)..(312): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacggcctcctatgagctgacacagtcaccctcggtgtctgtgtcctcgaggacaggacggccaggactcactgctcgnggcatgctattcgaaccaaaaacattatcgtacttacgtcggtaccagcgaggacggccacggccacggcccctgtcgttggtagtaatttaanaaagtcgtttagaaggaccggtccctacgacggaccccgtgacggcgtactttctacgtcggcctcgacgtcgtacggaacgggaaccaaacgtacgtaccctaaccgttcgaaacctacgtaccgaacggtcgggtaaccgggtaccccgggaacgaacgggaacggggaacggacggtaccgttacgtaacctttaacgtttaacgtcggttaccgaaccgggttccgacgaaaccggacgaaggtacccgtaagggtcgggtacgttaacggtttacgttacgggttacggttaacgggttccgggggaccggggttaaacggggacccgttaaacggccggttaccgggtaaccccggttccggttaacgggtaccggaacccggtaaccccggtaacggtcccgttccccggtccccccggttccgggttaccc

SEQ ID NO: 74858 - DNA, 655 bp, Homo sapiens
  misc_feature: GYAE6OF01D5XHA.49.20.B09.1.454.CMB.1.raw
  modified_base (283)..(283): a, c, t, g, unknown or other
  misc_feature (283)..(283): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtcttggtnatttaataaagtctttgagacggccctcgacgggacccctgacgcgtattctcgtggctccagctcgaagggacaacgtacgtacctaaccgttcgaacctagtcgaggttcgggaccggtcccgggaccgaagggaacgggaacggagggtacgtacgtaaccttagttaaccgtgtaccgtacggtcccgacgtaacgaacgaacggacgtaggtcggtacgtaagtttacgttggttacggttacggttccggggacgggtacgggtaacccgttacggtaccgtacggtacccggttccgttaacgggtacccgaaccggtaccccgaacgggtcccttccccggtcccccccgtcgggttaaccccg

SEQ ID NO: 74859 - DNA, 631 bp, Homo sapiens
  misc_feature: GYAE6OF01DCXTH.49.20.B09.1.454.CMB.1.raw
  modified_base (173)..(173): a, c, t, g, unknown or other
  misc_feature (173)..(173): n is a, c, g, or t
  modified_base (242)..(242): a, c, t, g, unknown or other
  misc_feature (242)..(242): n is a, c, g, or t
  modified_base (488)..(488): a, c, t, g, unknown or other
  misc_feature (488)..(488): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctctatgagctgacacagtcaccctcggtntctgtgtcctcaggacagacggcctaggatccacctgctctggcgatgcattcgaaccaaaaactatangtacttacgtggtaccagacagacggccaggccacggtcccctgtcttggtagtatttaagtaaagtactttaggagacggtccctacgacgggacccctgacgcgtattctcgtcggcttcagtctacgaagggacctaacgacgttcctaacttcgaacctagtacgaaggttacggaccgtaccgggacgaacgggacggtacgtaggtactagtaacttacgttaactgtaccgagtccganacgacagcgaggtgacgtagttactgtacgtagttcgggcggtaacgggtactaccggtacgtaccggtaccggttacgtacgggtcccgaaccggtacccgtaacgggtcccttaacccgggtcccccgttcgggtaacccg

SEQ ID NO: 74860 - DNA, 747 bp, Homo sapiens
  misc_feature: GYAE6OF01A1T2B.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagacggccaggatcacctgctctggcgatgcattcgaccaaaactatatgcttactggtaccagcagagccaggccacggcccctgtcttggtgtatttaataaagtactttgagacggtccctagacgggacccctgacgcgtattcctcgtggcctaccgacgctacgaagggaaccaacgtacgtcctaaccgttacgaaccctagtaccgagggttcggaaccggttcccgggaccgaagggtaacgggaacggacgggtaccgtaggtaaccttaagtttaccgtcggttaccgacgggttacccgacgtaacggtaccgaacggtaccgtaacgggttcgggtaaccgtttaagggttttaacgttacgggttaccgggtttaacggttcccgggggtaacggggtaaccggggttaaaccggttaaccgggtaccgttaccgggttaaccccggttacccggttaaaccgggtcccgtaaaccgggtacccccggtaaacggggtccccgtttaccccgggtccccccccggtttccggggttaacccccg

SEQ ID NO: 74861 - DNA, 585 bp, Homo sapiens
  misc_feature: GYAE6OF01B6MW8.49.20.B09.1.454.CMB.1.raw
  modified_base (465)..(465): a, c, t, g, unknown or other
  misc_feature (465)..(465): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctcggtgtctgtgtcctcaggacagacggccaggatcacctgctctggcgatgcattgaccaaaaacatatgcttaactggtaccagcagagccaggccacggcccctgtcttggtgtatttaataaagtactttagagtacggccctacgacgggacccctgagcgtattctctgctcagctacgaacgggaacaacgagtacctaccgttcgaacctatacgaggtcggacgtccgggacgaaggacggaacgaggtctacgtaacttattacgtcgtacgacgtccgacagacngacgtaggtgtacgtagtttatggttacgtacggttcgggacgggaggtaccgtacggcgttacggacccggttcgtacggccgtacgacccgaggccctcccggccccgttcggtaccc

SEQ ID NO: 74862 - DNA, 641 bp, Homo sapiens
  misc_feature: GYAE6OF01BC4IR.49.20.B09.1.454.CMB.1.raw
  modified_base (176)..(176): a, c, t, g, unknown or other
  misc_feature (176)..(176): n is a, c, g, or t
  modified_base (206)..(206): a, c, t, g, unknown or other
  misc_feature (206)..(206): n is a, c, g, or t
  modified_base (215)..(215): a, c, t, g, unknown or other
  misc_feature (215)..(215): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtcaccctcggtntctgtgtcctcaggacagacggccaggacncacctgctntggctatgctattcgaaccaaaaacaattatcgtaccttactcggtaaccagcgaggacggccaggccacggcccctgttcgttggtagtaatttaataaacggtactttaggagtacggtccctacgacgggacccctggacgtccgtacttcgtcgtcggcctccgacgtctcgaacgggaacaactacgtcctaccgttacgaacctagtccgaggtcggtacgtccggaccgaaggtaacgggacggaggcctagtactaacttcgtacgtcacggtcccgacacgtacgacgtcgtaggtcggacgttaggtttagtcggtagttacggtcggggacgggtacggtaccgttcggcgtcggaccccggttcgtacggtacgaccgacccggaggtcccgtccgtcccccggtcgtaccccg

SEQ ID NO: 74863 - DNA, 618 bp, Homo sapiens
  misc_feature: GYAE6OF01A1O0K.49.20.B09.1.454.CMB.1.raw
  modified_base (175)..(175): a, c, t, g, unknown or other
  misc_feature (175)..(175): n is a, c, g, or t
  modified_base (186)..(186): a, c, t, g, unknown or other
  misc_feature (186)..(186): n is a, c, g, or t
  modified_base (286)..(286): a, c, t, g, unknown or other
  misc_feature (286)..(286): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctcggtntctgtgtcctnaggacagacggccaggatcacctgctctggcatgcattgaccaaaacatatgcttacgtggtaccagcagacggccaggccacggcccctgtcgttggtntatttaataaagtctttgagacggccctgacggaccctgagcgatttccgtctggcctccgagctacgagggaaccaacgacgtcaccttacgaccataccgagtcggacggtccggaccgaggacggacggaaggcgtagacttagttacctgtcgacgtccgtacgaacgtacgagtacgaggtcgtaccgttaagttcgttaggtacgttaggtccggggaccggaggggtaccttacggccgttacgggaccccggtttccgtacgggtaccgaacccggtacccgaaacgggtcccgttaccccgtccccccgggttccggtacccg

SEQ ID NO: 74864 - DNA, 643 bp, Homo sapiens
  misc_feature: GYAE6OF01D2MX0.49.20.B09.1.454.CMB.1.raw
  modified_base (236)..(236): a, c, t, g, unknown or other
  misc_feature (236)..(236): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagacggccaggatcacctgctcgtggcgatgctattcgaccaaaaanatatgtacttacgtcggtaccagcagacggccaggccacggcccctgtcgttggtagtatttaataaagtctttaggagtacggccctagaccgggaccctggacgcgtacttctcgtggcctcgagtctacgaacgggacaactacgtccacctttagaccctatacgaggtcggacgtccggacgaaggacggacgaggtactagtaacttattagttgactaatacaaacacgaacacgtaagtttacggtaacttagttacgttacgttacggaacgttcggaaccgtaaccgtaacggtacccgtaccggttccggttagggacctaaccggaccccgtaaaccggaccccctaaaccccgtacgtttaccgtaccctaacccgttccggtttaaccccccg

SEQ ID NO: 74865 - DNA, 551 bp, Homo sapiens
  misc_feature: GYAE6OF01C8BRJ.49.20.B09.1.454.CMB.1.raw
  modified_base (374)..(374): a, c, t, g, unknown or other
  misc_feature (374)..(374): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagacggccaggccacggcccctgttcttgggtagtatttaataaaagtctttagagacggccctcgacgggacccctgacgcgtattctcgtcggctccagtctcgaacgggacaaacgngtaccacttacgaccatcgaggtggacgtccggacaggacggacgaggctagacttattacgtgtacacggtccgcagacagacaggtgctagttatggttcgtagtcgggacggagggactacggctaggacccgtcgtacgtcgacgcccgaagtcctccgccccgttggtaccc

SEQ ID NO: 74866 - DNA, 626 bp, Homo sapiens
  misc_feature: GYAE6OF01ADR5M.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctcggtgtctgtgtcctcgaggacagacggccaggatccacctgctcgtggcgatgactattacgaccaaaaacattaatcgtcttacaggtaaccagacaggacggaccacggccgacggtcccctgttcgttgggtacgtaatttataaagtacgtttagacgacggccctacggacggaccccgtgacggtctattctcgtgcctccacgtcgtacgacggaactaacgtcgtacctactcgaccactcgaggtcggacgtccggacgaggacggaacgaggtctacggtacttacgttacgtacgtcgaccgtccgacgacgaacgacgacgaggtacgtacgtagttagtcgtacgttacggtcggcgggtaacggtacgtacgggtccgtacgtacggtcgtaacggtaccgacgtacccgtacggccgtccccgcccgttcggttaccccg

SEQ ID NO: 74867 - DNA, 692 bp, Homo sapiens
  misc_feature: GYAE6OF01ETLIL.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctggtgtctgtgtcctcaggacacgaccggccaggactccacctgctcgtggcgatcgactattacgaaccaaaaactatagtacgtccttaacgtacggtaccagacgacggacggaccgacggacccgtaccggtcccccttaggttccgtttagggtacgttaacttttaaagtaaacgttcgtttaggacggtaccggtcccctacggaccgggtaccccttgaacggtcgtacgttccgtcggtcggaccttaccgagtcctacggaacgggaacctaacgtacgtacctaccgttacgaacctagtacgtacggtcggtaccgtccggacgaaggacggacggacggtacgtacgtaacgtttgtaccgttcggtaccgtaccgtccgacgtacgaacgacgacggtagtgtacgttagttagtcgttacggtagtcgggagtacggtactacggtcctaggcccgttcggtaggtacaccggtaccgtcggaccctccccggtcccgtcggtacccg

SEQ ID NO: 74868 - DNA, 580 bp, Homo sapiens
  misc_feature: GYAE6OF01DQ94M.49.20.B09.1.454.CMB.1.raw
  modified_base (372)..(372): a, c, t, g, unknown or other
  misc_feature (372)..(372): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtagtaatttaataaagtactttggagacggccctacgacgggtacccctgacgcgtattctcgtcggcctccagctcgaagggaacaacngtaccaccttgacctatcaggtaggacgtccggcgaaggaggacgagctacgtacttattactgtcacgtccgacagacagcaggtgactagttatcgtcgttacgttccgggacgggtacgggtacgtaccggtccgtacggacccgttcggtacgggtccacggtaccccgaagggcccttcccggtccccccgttcgggtacccc

SEQ ID NO: 74869 - DNA, 614 bp, Homo sapiens
  misc_feature: GYAE6OF01AQ2PS.49.20.B09.1.454.CMB.1.raw
  modified_base (185)..(185): a, c, t, g, unknown or other
  misc_feature (185)..(185): n is a, c, g, or t
  modified_base (241)..(241): a, c, t, g, unknown or other
  misc_feature (241)..(241): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctnaggacaggacggccaggactcacctgctcgtggcgatgcctattcgaaccaaaaanatatcgtcttacgtcgtaccagcaagacggccgaggccacggcccctgtcttggtgtatttagtaaagtcgtttgagacggtccctcgaacgggacccctgacgcgtacttctcgtcggctccgagtctacgagggacaacgtacgtaccaccgttacgacctagtacgaggtacggaccgtaccggaccgagggtacggacggaggtacgtagaacgttattacgtcgttacgacggtccgacgacgacgagtcgaggtcggtactaggttcgtgtacgttacggttcgggacgggtacgggtacctacggtcgtacggacccggttctacggtcacggacccgtaggtcccgtcccgtccccgtcgtcccg

SEQ ID NO: 74870 - DNA, 683 bp, Homo sapiens
  misc_feature: GYAE6OF01CVJ1T.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccacccgtcggtgtctgtcgtcctcgaggacagaccggccaggactcacctgctcgtggcgatgctattcgaaccaaaaactatatgtacttacgtcggtaccagacgaggacggccgacggcctaccggtccccgtgttcgttgggtattaatttaagtaaacgttcgtttaggacggtaccggtcccctacggaccgggtacccctggacgtcgtacttcctcgtcgcctccgagctacggacggaacaacgtacgtcctaaccttcgaacctagtcgtacggtcggaccggtccggacgaagggtacggacgtaggtacctagtaccttagttaccgtcgtaccgtacggtccgactaacggacgtagaccgtaggtcgacgttaacggttagttcggttacggtacggttaccggggacgggtaccggtactaccgggtcgttaccggacccgttaccggtacggtacccgacggtaccccgtaggtccccgtacccggtcccccgttcgtacccg

SEQ ID NO: 74871 - DNA, 709 bp, Homo sapiens
  misc_feature: GYAE6OF01CIKEY.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcgaggacaggacggccaggactcacctgcctcgtggcgatgctattcgaccaaaaacatagtgtacttacgtacggtaccagacgagacggaccacggccgacggtccccgtggtcgtttggtagtaatttaagtaaacggtactttaggaacggtacggtccctacgaccgggtacccctgacgtcgtacgtttcctcgtacggtcctaccgacgtcctacggacggaaccaacgtacgtcctaccgttacgtacctacgtacgaggttacgggaccggttacccgggacgtaacgggacggaccggtacggtcgtacgtaaccgttacgttacgtcgtccgtaacggtcccgagaacgacgacgacgtacggtacggtacgttaggttacgttacggtacgttacggttcgggtacgggtaacgggtaaccgtacggtccgtaccggttacccggttacggttaccggtacgaccggtacccgtaacgggtcccgttacccggtcccccgttcggtaccccg

SEQ ID NO: 74872 - DNA, 553 bp, Homo sapiens
  misc_feature: GYAE6OF01DGW96.49.20.B09.1.454.CMB.1.raw
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (364)..(364): a, c, t, g, unknown or other
  misc_feature (364)..(364): n is a, c, g, or t
  modified_base (422)..(422): a, c, t, g, unknown or other
  misc_feature (422)..(422): n is a, c, g, or t
  modified_base (543)..(543): a, c, t, g, unknown or other
  misc_feature (543)..(543): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctcgtggcgatgctattcgaaccaaaaacatatgacttacgtggtaccagcaagacggccaggccaggcccctgtcttggtntaatttanaaagtctttgagacgccctgacgggacccctgagctattctcgtgctccagctacgaggacaacngtcaccttgaccagtcagtgacgtcaggacaggaggacgagctgacttattatcgtanaactacaagacgtaacaccgtagtttacgtacttagtcgttcgttacggaatcgacgtaaccgtagtcccgaccgtcgtggtaccacggacccgtaaacgccccctaaacctcctcgtccnccgttacccg

SEQ ID NO: 74873 - DNA, 532 bp, Homo sapiens
  misc_feature: GYAE6OF01DRGPB.49.20.B09.1.454.CMB.1.raw
  modified_base (185)..(185): a, c, t, g, unknown or other
  misc_feature (185)..(185): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (359)..(359): a, c, t, g, unknown or other
  misc_feature (359)..(359): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctnaggacagacggccaggatcacctgctctggcgatgctattgaccaaaaacaatntgcttacnggtaccagcagagccagccaggcccctgtcttggtgatttaagtaaagactttgagaggccctacgacgggacccctgacgcgattctctggctccagctcgagggacaacngtcaccttgacctatcagtaggacgtaccggcaggaggacgaggctacgactattacgtgtacacgtccgacagacagctagtgtacgtagttagtgtcgtagttcggacggaggacgtacgctggaccggttccgtaggtcacggtccgaacggctccgccccgtggtaccg

SEQ ID NO: 74874 - DNA, 551 bp, Homo sapiens
  misc_feature: GYAE6OF01BFS2U.49.20.B09.1.454.CMB.1.raw
  modified_base (425)..(425): a, c, t, g, unknown or other
  misc_feature (425)..(425): n is a, c, g, or t
  modified_base (431)..(431): a, c, t, g, unknown or other
  misc_feature (431)..(431): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaaacatatgcttactggtaccagcagagccagccaggcccctgtcttggtgatttataaagactttgagaggccctcgagggacccctgacgcgtattcctcgtggctccagctcgaacgggacaacagtcaccgttgaccatcagtggacgtccggacaggaggacgaggctagactagttactgtcacgtcgnacgacngcaggtgctagttatgtacgtagttcggcgggtagggacctacggccgttaggacccggtccgttacgggtaccaacggtaccccgaacggtccgtcccggtccccccgttggtaccccg

SEQ ID NO: 74875 - DNA, 668 bp, Homo sapiens
  misc_feature: GYAE6OF01D8PE8.49.20.B09.1.454.CMB.1.raw
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtntctgtgtcctnaggacagacggccaggactcactgctcgtggcatgactattacgaaccaaaaatatagtgtacttacgtggtaccagcaaggacggccaggccgacggtcccctggttcgttggtagtaatttaagtaaaagtacgtttaggacgtaccgggtccccttacggaaccgggtacccctggacggtcgtactttccgtcgtcggcctaccgacgtccgtacgaacgggaacctaaccgtacgttaccctaaccgtttacgaacctacgtcgaaggtcgggacgtcccggaccgtaagggacggacggacgggtctacgtaacttacgttacgtcgtaccgacgtcgacgtaacgacgagactaggcgtacgtaagtttgtcggttacgttaggtaccgggagggtacggacttacggccgttacggacccgtcgtacggtcaaccggtacccgtacggtccctacccggtccccgtggtaccccg

SEQ ID NO: 74876 - DNA, 755 bp, Homo sapiens
  misc_feature: GYAE6OF01D11W8.49.20.B09.1.454.CMB.1.raw
  modified_base (238)..(238): a, c, t, g, unknown or other
  misc_feature (238)..(238): n is a, c, g, or t
tcagagtcgagagacacgaccggtgctcgatttagtgtagtgtgaagggggctgtgggtccaggaggcagaactctgggtgtctcaccatggcctggatcctctacttctcccctcctcactctctgcacaggctctgaggcctcctatgagctgacacagtcaccctcggtgtctgtgtcctcaggacagacggccaggactcacctgctcgtggcgatgcattgaccaaaacatangtcttactgtaccagcagaggccaggccacggcccctgtcttggtgatttaataaagtctttaggagtacggccctacgacgggacccctgacgcgtattctcgtacggccttccgagtcctacggaacgggaaccaacgtacggttacctaacccgtttaggaacccctaagttaccgtaacgggttacggggtaaccgggttccccggggaaccggtaaacgggggaaaaccggggaaccgggtaacggggtacccgtttaacggttaaaccgtttaaacgttttaccggtacggtttacccgtaaccggttccccggacgtaaacgggaaccaacgggtaccggtaacgggttcgggtaccgttaaaggtttaacgtttcgggttacggtttacgggttcccggggaacggggtaaacggggtaccgttaaccggtcgtacggtacccggttaccgttaacggtaccgaccggtacccgaacggtcccgtcccggtcccccgttccggtacccg

SEQ ID NO: 74877 - DNA, 702 bp, Homo sapiens
  misc_feature: GYAE6OF01EB750.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagacggccaggccacggcccctgtcgttggtgtaatttaataaagtctttggagacgggcccctcgacggggacccctggacgcgtattccgtcgtggcctccgagctacgaacgggaccaaagcgtacctaaccgttgaaccctagtacgaggtcggacggtcccgggaccgaagggacggaacggacggcgttacgtaacttacgttacgtcgtaccgacgttacccggacaacgtaacgaggtacgtaagggttcggtaaccgttaaggtttacgttaggttaccggtttaacggttccggggaaccggggtaaggggtaaccccgttaccgggtccggttaccgggtaacccccggttccggttaaccggggttacccaaccgggtacccccggtaaacgggtcccgttaccccggtcccccccggttcggggttaacccccg

SEQ ID NO: 74878 - DNA, 609 bp, Homo sapiens
  misc_feature: GYAE6OF01EXETS.49.20.B09.1.454.CMB.1.raw
  modified_base (232)..(232): a, c, t, g, unknown or other
  misc_feature (232)..(232): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggcaggatcacctgctctggcatgcattgaccaaaaanatatgcttactggtaccagcagagccaggccacgcccctgtcttggtgtatttataaagctttagagacggccctcgacgggacccctgacgcgtattctctcggtctccgagctacgagggtaacaacgtacgtctaccgttacgaaccctagtaccgaggtacgggtacggtcccgggaccgaagggtaacgggacggagggtctacgtaacttacgttacgtcggtactaacggtccgacgagaacgacgtacgaggtcggtacgtaagtttagtcgttacggttagttcgggacgggagggtaccgtacggccgtacgcccgttcgtacggtacgacggacccgaacggcctcccggtccccgtggttacccg

SEQ ID NO: 74879 - DNA, 730 bp, Homo sapiens
  misc_feature: GYAE6OF01B7J7K.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtccacccgtcggtgtctgtcgtcctcgaggacaggaccggccaggactcacctgctcgtggcgatgctattcgaaccaaaaactagtatgtaccttacgtacggtaccagcgaaggacggaccacgggccgaccggtccccgttggttccgtttagggtattaagtttaaacgtaaaagttacgtttggaacggtaccgtcccgtacgaaccggggtacccctggacgtcgtacttccgtcgtcggtcctaccgacgtcgtaccggaaacgggaacaaaccgtacgtacccgtaaccgttaccaaccgtacgttacgacggttgggaaccggtcccggaccgaaaggggtaccgggaaccggtaagggaccttacgtaaccttagtttaccggtcgtaccgacggtcccgacgaacgaacgcggaccgtaggtcgtacttagttacgtcggtacggttacggtccgggaacggtaccgggtactaccggtcgtacccggtaccggttcggtaccggtaacgtaccggtacccgacgtcccgtacccccgcccgttccggtaccccg

SEQ ID NO: 74880 - DNA, 712 bp, Homo sapiens
  misc_feature: GYAE6OF01CLFGN.49.20.B09.1.454.CMB.1.raw
  modified_base (248)..(248): a, c, t, g, unknown or other
  misc_feature (248)..(248): n is a, c, g, or t
  modified_base (512)..(512): a, c, t, g, unknown or other
  misc_feature (512)..(512): n is a, c, g, or t
tcagagtcgagagacacgaccggtgctcgatttagtgtagtgtgaagggggctgtgggtccaggaggcagaactctgggtgtctcaccatggcctggactccctctacttcctcccctcctcactctctgcacaggctctgaggcctcctatgagctgacacagtccacccgtcggtgtctgtgtccctgagggacagaccggcaggactcacctgctcgtggcatgacattcgaccaaaaacattancgtcctttaacgcggtaccaggaccgagacggccacggccgaccgggtccccttggttacgtttggtagttaattttaagtaaaagttcgtttaggaacggaccggtccctacggaaccggggtacccctggagtaccgatttccacggttggacctcccgagtccgtacgaacgggtaacaaaccgtgtacctaacttcgacctatccgtaggtcgggtaacgtccgggacaggacggtacggagtctacggacttaacgtcncggttacaccggtcgacgtaacgacgacgacgtacggtacgggattaacggtttacgttcggtacgggtttaacggttccggggaccggggtaacggttaccgtaccggtccgttacgggacccggttacccggtagggtaccccgaccggggtacccgtaaccggacccgtttaccccgcccccggtttcggtaccccg

SEQ ID NO: 74881 - DNA, 572 bp, Homo sapiens
  misc_feature: GYAE6OF01A75SL.49.20.B09.1.454.CMB.1.raw
  modified_base (186)..(186): a, c, t, g, unknown or other
  misc_feature (186)..(186): n is a, c, g, or t
  modified_base (236)..(236): a, c, t, g, unknown or other
  misc_feature (236)..(236): n is a, c, g, or t
  modified_base (248)..(248): a, c, t, g, unknown or other
  misc_feature (248)..(248): n is a, c, g, or t
  modified_base (389)..(389): a, c, t, g, unknown or other
  misc_feature (389)..(389): n is a, c, g, or t
  modified_base (469)..(469): a, c, t, g, unknown or other
  misc_feature (469)..(469): n is a, c, g, or t
  modified_base (551)..(551): a, c, t, g, unknown or other
  misc_feature (551)..(551): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggatcacctgctcgtggcgatgcagttgaccaaaanattatgcttacncggtaaccagacagaggccaggccacggcccctgtcttggtgtatttaagtaaagtactttggagacggtccctcgacggtacccctggacgtcgattctccgtagcctcgagctcgaggaccaacgagtccacttgaccngtacgagtcggacgtccggcacggaggacgaggtctacggacttagttcagtacacgccgacagacacgtacaggtcggntagttacgttgtcgtacgtcggacgggacggtacctacggcctcggtacccggttcaacgggtccacggaccctacggaccncccggtaccccgtcggtaccc

SEQ ID NO: 74882 - DNA, 874 bp, Homo sapiens
  misc_feature: GYAE6OF01CL140.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacagactctgacggccctcctatgagctgacacagtccacccgtcggtgtctggtcgtcctcgaggacaggaccggcaggactccacctgctcgtggcatgactattacgaaccaaaactattactgtactttacgtacggtacccaggacaggacggaccgacggccgacggtccccttggttccgtttgggttagtaaacgttttaagtaaaacggttactttagggaacggtacggtaccccgtaccggaccggggtaccccctggacggtaccgtacttccgtcgtcggcctaccgagccgtacggacggaacgaacgtcgtacctaccgttacgaacctacgttacgaggtacgggaccggtacccgggaccgtaagggaacgggacggtacgggtaccttaggtaacctttaacggttaccgttacggtaccgtaaccgggttacccgaaccggaaccgtaaccggaacgggtaccgttaacgggttaccggggtaaccgtttaacgggtttttaaacggttcggggtttaacccggtttaaaccggggtttaccgggggggttaaccccggggtaaacggggggtttaacccgtaacccgggggtttccgttaacccccggggttaacccggtttaccccgggttacgggtaacccccggtaaccgggtaacccccggtaacggggttacccccgttcccccgggttaccccccgggtttaccggttaccccccgg

SEQ ID NO: 74883 - DNA, 640 bp, Homo sapiens
  misc_feature: GYAE6OF01AYE92.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacaatatgcttactggtaccagcagagccaggccaggcccctgtcttggtgtatttaagtaaagtactttaggacggacggccctcgacgggaccccctgacgcgtattcctcgtcggtcctcccgacgtctacgacgggaaccaacacgtccaaccgtttcgaacccactacgagtcggacgtccggaccgaggacggacggaggcgtcgtacttacttacgtcgttacaccggtccgacacggaccgagccgtaggtcgggtacgtagtttagttcggttacgttacggttcgggacgggtacgggtaacgttaccggccgttaccgggtacccggttcccggtacgggtaccgaccggtaccccggtaacgggtcccgtcccggtccccccgttcgggtaccccg

SEQ ID NO: 74884 - DNA, 616 bp, Homo sapiens
  misc_feature: GYAE6OF01DG8NJ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacaggacggccaggactccacctgctctggcgatgctattcgaaccaaaaacatatgcttactggtaccagcagacggccaggccacggtcccctgtcgttggtagtatttaataaagtactttgagacggcctcgacgggacccctgacgctattctctgcctcgagctacagggacaactacgtacaccttgaccagtcgaggtcggacgtccggacaaggacggacgaggctacgtacttaatttaacgtcgtacgacggttcccgacgtacgacacgacgaaggtcgggacgtaggtttagttggtacgttacggttcgggacggggtacgggtacgtaccggtcgtagggtacccggttccggttaacgggtccaaccggtcccgaacggtccgtacccggttcccccgtcggttaaccccg

SEQ ID NO: 74885 - DNA, 927 bp, Homo sapiens
  misc_feature: GYAE6OF01AV8Y9.49.20.B09.1.454.CMB.1.raw
tcagagtcgagagacacgaccggtgctcgatttagtgtagtgtgaaggggcgtgtgggtccgaggaggcgagaactctgggtgtctcaccatggcctggatccctctacttctcccctcctcactctctgcacaggctctgaggcctcctatgagctgacacagtccaccctcggtgtctgtcgtcctcaggacaggacggcaggatccacctgctcgtggcgatgcattcgacccaaaaatattagtcgcctttaacgtacggttaacccaggaccaaggaacggcccgaaacgggacccgaaccgggtccccccgttaggttacccgttttacggggtacggttaaacgtttttaaacgtaaaaacgggttacgttttaacgggtaacggtaaccgggttaccccccgtttagggaaacccggggttacccccccggtttaaggaaccgggtaacccggtttaaccgtttacccggttacccggtttcggggtacccgtttaccccgtaacggttcccgtttaacccgggaaaaccggggggttaacccaaaacccgttaaccggggtttaccccttaaaccccggtttaacgggtaaccccctaaggtttaccccggaagggtttaaccggggtaacccgggttaacccggggtaccccgtaaacggggtaacgggggaacccgggaacgggtaaccggttacgtaaacccggttttaacctttaacgggttacgtttacccggtaacgggttacccgttacgaaacggtaccgaaccgtaggtaacggtaccggacgtttaacggtttcgtacgttacggttaggtccgggacgggttaacggacgttaccggcgttaggaccccggttacgacggttaccgacgggaccctaacggccgtaccccgttccccgtggtacccg

SEQ ID NO: 74886 - DNA, 637 bp, Homo sapiens
  misc_feature: GYAE6OF01CO7U6.49.20.B09.1.454.CMB.1.raw
  modified_base (221)..(221): a, c, t, g, unknown or other
  misc_feature (221)..(221): n is a, c, g, or t
tcagagtcgagagacacgaccggtgctcgatttagtgtagtgtgaaggggctgtgggtccaggaggcagaactctgggtgtctcaccatggcctggatccctctacttctcccctcctcactctctgcacaggctctgaggcctcctatgagctgacacagcccaccctcggtgtctgtgtccctgaggacagacggccagtactccgacctgctctgganatgctattcgaccaaagcaatatcgtcttactggtaccagcaagacgccaggccacggccctgtctgatctatttaataagtactttgagtacggcctacgacggaccctgagtcgtattcgtcgtacggcctaccgacgtctacgagaccgaacgtaaacgtagtaccgtacggttacgaaccctagttacgaacggttacgggaaccggttcccggggacaacggggacggacggaacggtcgtaacgtaacgttacgtttaccgtcgtacgtaacgtcgtaacgttacgaacgtaacgtaggtaacggtcggtaccttacgttcgttagttcggtacggttcgggacggtaacgggacaggtccgtacggtacccgtcggtaccgacgaccggccgtaggcccgttaccccgg

SEQ ID NO: 74887 - DNA, 784 bp, Homo sapiens
  misc_feature: GYAE6OF01CW46H.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggccctctatgagctgacacagtccaccctcggtgtctgtcgtcctcgaggacagaccggccaggctcacctgctcgtggcatgctattcgaacccaaaaactatactgtactttacgtacggtacccagaccgaggacggaccgacggacccaccggtcccccgttggttccgtttaggggttattaaattttaacgtaaaaggttaccttttagggaaccggtaccggtcccccttacggaacccggggtaccccctaggacggtcgtactttccgtcgtcggccctacccgacggtctaaccggaacgggtaaccaaccgtacgttaccctaccgtttacgaaccctagtaccgtacggttacgggaccgggttacccggacgaacgggacgggtaaccgacggttaccgtacggtaacttaacgttaccgtacggtcgtaaccggttccgaccgtaacggcaaggacgtagggtcggtacttaaggtttacgttcgggttaccgttaggggttacccgggaacggggtaaccgggtaccgtaccgggtaccgttcccggtaaacccgggttccgtaagggttacccgacccggtacccggtaacggttccccggaccccgttccccgggtcgttacccg

SEQ ID NO: 74888 - DNA, 535 bp, Homo sapiens
  misc_feature: GYAE6OF01CY0IG.49.20.B09.1.454.CMB.1.raw
  modified_base (365)..(365): a, c, t, g, unknown or other
  misc_feature (365)..(365): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggccctcctatgagctgacacagtcaccctcggtgtctgtgtcctcaggacagacggccaggatcacctgctctggcgatgcattgaccaaaaacatatgcttactggtaccagcagagccaggccaggcccctgtcttggtgatttagtaaagtctttaggagacggccctacgacgggacccctgagccgtattcctcgtggctccagctcgagggacaacngtcaccttgaccatcagtggacgtccggccaggacggacgaggctagactattactgtcagtcgcagacagcagtgactagttatgtacgtagttcgggcggtaggactacgcgtaggacccgttcgtaggtacacggacccgaaggtccctccgcccccgtggtacccg

SEQ ID NO: 74889 - DNA, 493 bp, Homo sapiens
  misc_feature: GYAE6OF01CDFRZ.49.20.B09.1.454.CMB.1.raw
  modified_base (234)..(234): a, c, t, g, unknown or other
  misc_feature (234)..(234): n is a, c, g, or t
  modified_base (276)..(276): a, c, t, g, unknown or other
  misc_feature (276)..(276): n is a, c, g, or t
  modified_base (282)..(282): a, c, t, g, unknown or other
  misc_feature (282)..(282): n is a, c, g, or t
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaanatatgcttactggtacagcagagcagcaggccctgtctggtnatttanaaagctttgagacgcctcagggacccctgacgcgattctctggctcagctcgaggacaacagtcacttgaccatcagtgngtcgcagaggacgaggctgactattactgtcagtccgnagacagcagtgcagtatgtacgtgtcgggcggaggactacgctcgaccgtccgtaggtcaccgtccgaacggctaccgccccgtggttacccg

SEQ ID NO: 74890 - DNA, 582 bp, Homo sapiens
  misc_feature: GYAE6OF01DGBGU.49.20.B09.1.454.CMB.1.raw
  modified_base (232)..(232): a, c, t, g, unknown or other
  misc_feature (232)..(232): n is a, c, g, or t
  modified_base (282)..(282): a, c, t, g, unknown or other
  misc_feature (282)..(282): n is a, c, g, or t
  modified_base (363)..(363): a, c, t, g, unknown or other
  misc_feature (363)..(363): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgagcctctatgagctgacacagtcaccctcggtgtctgtgtcctcaggacagacggccaggatcacctgctctggcatgcattcgaccaaaaanatatgcttactggtaccagcagaggccaggccaggcccctgttcttggtnatttataaagtctttgagacggcccttcgacgggtacccctgacgcgtattcctctggctccagctacgacgggacaacgngtaccaccttgacctatcagtcggacgtccggcaaggaggacgaggtctaggtacttattacgtgtcgtacgtccgacagacacgcgaggtggactagtttagtgttacgttacgttccggggacggacgggtaccgtaccggtcgtacggtacccggttacgtacgggtccaaccgggtacccgaacgggccttaccccggcccccggttggtacccc

SEQ ID NO: 74891 - DNA, 760 bp, Homo sapiens
  misc_feature: GYAE6OF01CSKS3.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctcctgagcctctatgagctgacacagtccacccgtggtgtctgttcgtcctcgaggacaggaccgccaggactccacctgccttcgtggactatgacttagttacgaacccaaaaagtattagacgtacctttacgtaggtacccagtaccgaaggacggaccaacgggacccgtaacggtcccccgttaggttccgtttacgggtaacttaagttttaacgtaaacggttccttttaggaacggtaccggtccccttaacggaccgggtaccccctagggaaccgtccgttatttccgtcgtacggtcctccgaagtccgtaggacgggaaccacgtacgtactaccttacgaccctatcgtaggtacggtacggtaccggacgaggacgggacgtaacggtacgtagtaaccttagttaaccgttcgtaccgtaccggtaccgaccgaagtaaccgacgtaacgtaggtacgtacgttaaggtttacgtacggttacgttaccggttacgggacgggtaaggtaccgtaaccggtcgttacggtaaccccggttacttaaccgggtaccgaaccggtacccggaaccggtcccgtaccggtccccccgttcggttaccccg

SEQ ID NO: 74892 - DNA, 727 bp, Homo sapiens
  misc_feature: GYAE6OF01EQ9IO.49.20.B09.1.454.CMB.1.raw
tcagagtcgagagacacgaccggtgctcgatttagtgtagtgtgaagggggctgtgggtccaggaggcagaactctgggtgtctcaccatggcctggatcctctacttctcccctcctcactctctgcacaggctctgaggcctctatgagctgacacagtcaccctcggtgtctgtgtcctcaggacagacggccaggatcacctgctctggcgatgctattgaccaaaaacatatgcttactggtaccagcagaggccaggccacggcccctgtcgttggtgattttaataaagtcttttaggacgacggccctacgacggggtacccctggacggcgtacttctcgtcggccttccgacgcgttacgaacgggtaaccgaaactacggttacctacctttacggaaccctaactcgtaacggtgggaaccggtccgggaccaaggggaacggtaacgggacggtacgttacggaactttaagtttaccgttcgtaaccgtacgtacccggacctaaggaaccgacggtaaccgagggtacgggtccgtaaggtttacgttgggttaccggtttagggttccggggtaacggggtaacggggtaccgtttaaccgggacggttacgggtaaccccggtttcccggtaacggggttcccgaaccgggtacccccggtaaacgggtcccgtttaaccccgggtccccccggttaccgggttaccccg

SEQ ID NO: 74893 - DNA, 564 bp, Homo sapiens
  misc_feature: GYAE6OF01DFO6B.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggccctcctatgagctgacacagtcaccctcggtgtctgtgtcctcaggacagacggccaggatcacctgctctggcgatgcattgaccaaaaacatatgcttactggtaccagcagagcaggccagcccctgtcttggtgattataaagtcttagagacgcctcgacggacccctgacgcgattctctggctaccagctcgaagggaacaacacgtccaccgtttagacccacgtcaggtcggtacggtcccggaccgaaggaacggaggaacggtctagaacttagttactgtacaggtcccacagaacaggacctaggtcggactagttagtcggtcgttagttcgggcggagggtaccacggtcctggaaccgttccgtaggtcacggacccgtaaggccgtccgcccccgtgtacccg

SEQ ID NO: 74894 - DNA, 737 bp, Homo sapiens
  misc_feature: GYAE6OF01DYLT0.49.20.B09.1.454.CMB.1.raw
  modified_base (177)..(177): a, c, t, g, unknown or other
  misc_feature (177)..(177): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctagacacacgtccaccctggtntctgtcgtcctgaggacagacggcagactccactgctcgtggcgtatgctatacgaaccaaaaacgtatatcgtacttacgtacggtacgagacgacggacggaccgacggaccgacggtccccttggttcgtttaggtattaaacgttttaaagtaaaacggtttcgtttagggaacggtccggtaccccgttacgggaacccgggtaccccttggaacggtaccttacgtttccgtcggttacgtccctaccggacgtaccgtaggaaacggtaacctaacgtcgtaccctaccgtacgtacctagtacggacgggttacggaccggttacccgggacggtaagggaacggtaacggtacggtaccgtaagtaaccgtttaacgttcggtaccggtttaccggaacccggttccgaacgggacgtaacgtacggtacggtacgggttacgtacgttaggttacgttcggttacggtacggtcggacgggtacgtaccgtccggtgtacccggtacgcccgtgaaccgcgaccgttcgccgtcccgtccgtcggtaccc

SEQ ID NO: 74895 - DNA, 571 bp, Homo sapiens
  misc_feature: GYAE6OF01D51G9.49.20.B09.1.454.CMB.1.raw
  modified_base (237)..(237): a, c, t, g, unknown or other
  misc_feature (237)..(237): n is a, c, g, or t
  modified_base (296)..(296): a, c, t, g, unknown or other
  misc_feature (296)..(296): n is a, c, g, or t
  modified_base (487)..(487): a, c, t, g, unknown or other
  misc_feature (487)..(487): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatccacctgctcgtggcatgctattgaccaaaaanatatgcttactggtaccagcagaggccaggccacggcccctgttcttggtgtatttaanaaagtctttgagacggccctcgaacgggaccctgacgcgtacttctcgtggcctccgagtctacgaagggaccaacagtcctaccttagaaccctagtcgaggtacggaccgtccggaccgaaggacggacggacgctacgtacttacgttactgtcgacgtccgaccagaccagctaggtcgatacgttntgtcgtacgttcggacggtaggactaggcgtacgaccgttcgacggtaccacgtccgaacgcccgtaccgtccccgtgtacccg

SEQ ID NO: 74896 - DNA, 739 bp, Homo sapiens
  misc_feature: GYAE6OF01D2DR9.49.20.B09.1.454.CMB.1.raw
  modified_base (238)..(238): a, c, t, g, unknown or other
  misc_feature (238)..(238): n is a, c, g, or t
  modified_base (458)..(458): a, c, t, g, unknown or other
  misc_feature (458)..(458): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtcacccgtcggtgtctgtcgtcctcaggacagacggccaggatcacctgctcgtggcatgctagttgaccaaaanatatcgtacttactaggtaccagcaaggacggaccgaacggccacggtccccctggttccgttggtacgtatttaagtaaagtacgtttgaggcggtccctacgacgggtacccctgacgtcgtattccgtcgtcgctaccgagtccgtacgaacgggaacctaacggtaccactagttcggactagtcgaggtgacgtccgaggacgaggacggacggnggtactaggtaaccttagtttacgttagtacctaaattaccgaaaccgtaacgtaacccgtaaccgtttaggtttaacggtttaacctttaaggttccggtttaacccggtttacgggtaaaccgttcggtaaccccggtaaaccgtaaaccgggttacccgtaccccgggtttaccggttacgggggtaaacccgtaaccggtaaacccccggaaacccggtaacccccgtaacccccgttaaaccgttcccggttaccgttaaaccccgtttccccccg

SEQ ID NO: 74897 - DNA, 923 bp, Homo sapiens
  misc_feature: GYAE6OF01BPHQK.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctctatgagctgacacagtccaccctcggtgtctgtgtcctcgaggacaggacggccaggatcacctgctcgtggcgatgctattcgaaccaaaaactattagtgtaccttacgtacggttaaccagcgaaggacggaccgaacgggcccaaccgggtcccccttggttaccgtttcgggtaggtaaatttttaaacgaaaacggttacgttttagggaacggtaccgggtaccccgttacgggtaaacccggggtacccccgtttagggaacgttaaccggtacttttaccgttaccggttcgggtcccttacccggaacggtccgttaaccgggaaaacggggtaacctaaacccggtaacggtttacccgaaacccggttttacggaaacccgttaagttacccggtaacggggtttaaccgggggtaacccggtttacccccggggggaacccgtaaacgggggaaacggggtaaacccgggtaacggggtaaccgttaccgggttaaaacctttacgttttaaacccggtcggtttaccgtaacccgggttcccggaaccgtaacggtaaccggtaaccgtacggaacgggttacggtaccgttaaagggttttccgtagggttaccggttaacgggttaccggggtaaccgggtaacgggtaaccgttaccggtaccgttaccgggtaaccgttacccgggtacggttaaccggaaccccggtacccggtaacgggtaccccttacccgggtccccccggttggttaacccccg

SEQ ID NO: 74898 - DNA, 715 bp, Homo sapiens
  misc_feature: GYAE6OF01BQ8SN.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtcgtcctcgaggacagacggccaggactcacctgctcgtggcgatgctattcgaaccaaaaactatatgtacttacgtcggtaccagcgaagacggaccacggccgacggtccccttggttcgttggtagttaatttaaagtaaaacgttacgtttaggaaggtaccggtccccgtacggaacccgggtaccccgtaggacgacgttacttccgtcgtcggcctaccgagtccgtacgaacgggaaccaacgtacgtacctaccgttacgaacctgtacgacggtggacgttacgtcgacgtaggacggacggacggtcgtagtaacttaacgttacgtacgtaccgtacgtaccgagaacgtaacgacgtacgtagggtacggtaccgttaaggtttaacgtcgggtttacggttaacggttaccggggacgggtaacgggttaccgtacggttaccggtacccgggttaccggtaccggttaacggccggtaaccgacccggtaacggtccctccccggtccccgggttaccg

SEQ ID NO: 74899 - DNA, 597 bp, Homo sapiens
  misc_feature: GYAE6OF01CAI1V.49.20.B09.1.454.CMB.1.raw
  modified_base (237)..(237): a, c, t, g, unknown or other
  misc_feature (237)..(237): n is a, c, g, or t
  modified_base (297)..(297): a, c, t, g, unknown or other
  misc_feature (297)..(297): n is a, c, g, or t
  modified_base (558)..(558): a, c, t, g, unknown or other
  misc_feature (558)..(558): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaacatangtcttacgtggtaccagcaggacggccaggccacggtccccctgtcgttggtgtatttanaaagtcttgagcggtccctgacgggcccctgacgcgtattcgtcgtcggctcgagctcgacggacaacgcgtcctaccttgacctagtcgaggtcgggaccgtcccggacgaaggaggaccggaggcctagtacttagttactcgtcgacggtccgacgagacaggtacgcggtagtaccgttagttgttacggttagttaacggttcggggacgggtacgggaccgttacggccgttaggacccggttcgtacggtaccncggaaccccgtaggacctccccggtccccgtcggttccc

SEQ ID NO: 74900 - DNA, 760 bp, Homo sapiens
  misc_feature: GYAE6OF01B9O0T.49.20.B09.1.454.CMB.1.raw
  modified_base (563)..(563): a, c, t, g, unknown or other
  misc_feature (563)..(563): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtcgtcctcaggacagacggccaggatcacctgctcgtggcgatgactattacgaaccaaaaactataatcgtacttaacgtcggtaaccagacaggacggaccgacggcccacggcccccttggttacgtttgggtagttaaattttaagtaaaacgtacgtttaggaacggacggtccctacggaccgggacccctgacgtacgtactttccgtcgttcggctaccgacggctacgaagggaacctaaacgtacgtaccgtaccgtttacgaccctaagttacgagggttacgggacggttaccccgggacgaaaggggacgggaaccggtaggtacctagttaaccgttaagttaaccgtcggtaaccgtaccggttacccgngaaacggaaccgagtaccgtagggtagtaccgttaaggtttcgttaacggtacggtttacggtacgggggacgggtaaaccgggtaactaccgggtccgttaaccgggtaaccccgtttacgggttaacggtacccggacccggtaaccccggtaaacggggtccctacccggggtaccccccgtcgggttaacccc

SEQ ID NO: 74901 - DNA, 791 bp, Homo sapiens
  misc_feature: GYAE6OF01A9H7F.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctggacggcctcctatgagctgacacacgcccacccgtcggtgtcacgtcgtccccaggacacggacggaccaggactaccgacctcgtctccgtaggaacgtctcggactagttacgaccctaaaaccgtattacgtcgtactttagttcggtaaccagacgaaggaaccgggccgggtaccgacggtccccgttggttcggttggtagtattaggtaacgtaaagacctaggtaggacggtaacgggcccctaggaacgggtacctccggagtacgtccgtacgttcgtcgtcgtaccgtaccggaggtaccggaacgggtacctaacgggtaccacggttaacgtccggtaacctgttacggaggttacgggtaacgtaccggtacgggacggaacgggtacgggaacggacggtacgtaacgttaacgtttaatttacgggttaaccaagttaacgtaaccaaccggtaaacgacctaaccggtttaggtttaaccggttaaccttacgtttacggtttccgtaaacggttaccgtgggaaaccccgtaaacggggttacccgttacccgtccgggttacggtacgggtaccaacccggtaaccccgaccgttaacccccgaaccctgtacccttccgacccgtttcccg

SEQ ID NO: 74902 - DNA, 737 bp, Homo sapiens
  misc_feature: GYAE6OF01BOPCE.49.20.B09.1.454.CMB.1.raw
tcagagtcgagagacacgaccggtgctcgatttagtgtagtgtgaagggggctgtggatccaggaggcagaactctgggtgtctcaccatggcctggatccctctacttctccccctcctcactctctgcacaggctctgaggcctcctatgagctgacacagtccaccctcggtgtctgtgtcctgaggacagaccggccaggatcacctgctgtggcgatcgctattcgaaccaaaaacatatgcttacgtcggtaaccagcagacggcgacggccacggcccctgtcgttggtagtatttaagtaaacgtactttagacggtacggtccccgtacggaccgggtacccctaggacgtcgtacttcgtacgtcggccttaccgagtcctacggaacgggaaccaaccgtacgtaccgtaaccttacggaacctacgtaccgtaggtacgggaccggtcccgggaaccgtaagggacggtaacggacgggtactacgtaacgttaacgttaccgtcggtaccgtacggtacccgacgaacggaccaacggtaccgtacgggttacggtaccgttaggtttaacgtacgggttacgtttaacggggttcgggtaacgggggtaacgggtaccgtaaccggtaccggttacccgggtacccggtttacccgtaacgggtacccgtacccggaaccccggtaaagggtccccgtccccggtaccccccggttacccggg

SEQ ID NO: 74903 - DNA, 724 bp, Homo sapiens
  misc_feature: GYAE6OF01CO48Y.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtgtctgtcgtcctcgaggacaggacggccgaggactcacctgctcgtggcgatgctattcgaaccaaaaacatatgtccttaacgtcggtaaccagacgaaggaccggaccaacggcccgaccggtccccttggttccgttggtagttaatttaagtaaacggttactttaggacggtaccggtccctacgaaccgggtacccctggacgtacgtattccgtcgtcgcctccagtctacggaacggactaaacgtcgtacctaccgttcgaacctacgtacggtacggttaccggggaccgtcccggggaaccgaaggggtaccggaaccgggtacgtacgttaacgtacttaacgttaccgtacgtaccgtaccggtcccgacgaaacggtcgaacgcgtagggtaccgagttagttacgttggttacggttcggtaccgggcgggtaacggtcgtaaccggtccggttacggtaccccgttacggtacggtacccgtaccggaacccggtcggtacccgttccccgtccccgggttacgtacccccg

SEQ ID NO: 74904 - DNA, 612 bp, Homo sapiens
  misc_feature: GYAE6OF01DHAFI.49.20.B09.1.454.CMB.1.raw
  modified_base (595)..(595): a, c, t, g, unknown or other
  misc_feature (595)..(595): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtccaccctcggtgtctgtgtcctcaggacagacggccaaggatcacctgctctggcgatgcattgaaccaaaaatatatcgcttacgtggtaccagacgagacggccaaggcccacggccccttggttcgtttggtagtaattttaagaaaacgtcgtttaggacgacggtcccctagaacgggtacccctggaacgcgtaacttctcgtcggcctaccagctacgaacgggtaacaaacgtcgtacctaccgttgaaccctatcgaaggtggaccggtccgccgaaggtacggaacgaggctacgaacttagttactcgtacacgtccgactagacgtaacgcgtaaggtggtacgtagttacgtgtacggttagtcgggcggtaggtacctcggctacggtccgtacgtacgtcgacgtccgaaggtccnccgtccccgtcggtacc

SEQ ID NO: 74905 - DNA, 908 bp, Homo sapiens
  misc_feature: GYAE6OF01BL2ZT.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctcggtgtctgtgtcctcgaggacagacggccaggatcacctgctcgtggcatgactattcgaccaaaaatatatgtccttacgtacggtaccagaccgaaggacggaccgacggaccccgacggtcccccttaggttccgtttgggttacgttaagttttaaacgtaaacggttaccgttttaggaaccggtacgggtaccccgttacggtaacccgggtaacccccgttgggaaacgtccgttaacgtttcccgttacggtcgggtcccttaccgacggtccgtaccggaacgggtaacctaaaccggtacgttaacccgtaacccgtttacggaaacccttacgttaccggtacgggttacggggtaacccggtaccccgggtaaccggtaacgggaacgggtaaccggtacgggtacccgtttaacggtaaccgtttaacgttttaaccggtacggttacccggtaaccggttaccccggaacgtaaccggtaacggtaaccggaccgttaacggggtacggtaccggtttaaggtttacggttacgggttaccgggtttaacgggttaccgggggaccggggttaaaccggggtaacccgttaacccggggtaccggttacccgggttaacccccggttccggtttaacccgggtaccggtaaacccccgggtacccgggtaaacccggtccccggttacccccgggttacccccggttccccgggttaaccccg

SEQ ID NO: 74906 - DNA, 507 bp, Homo sapiens
  misc_feature: GYAE6OF01E3M1D.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccaggcccctgtcttggtgatttataaagactttgagaggccctcagggacccctgagcgattctctggctccagctcgagggacaacagtcacttgaccatcagtggagtccggcagaggacgaggctgactattactgtcagtccgcagacagcagtggcagttatgtcgtattcgggcggagggactacgctagacccgtcctaggtccacgtcccgaaggcctcggcccccgtggtccc

SEQ ID NO: 74907 - DNA, 554 bp, Homo sapiens
  misc_feature: GYAE6OF01ETS3G.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatcgcttactggtaccagcagaggccaggccacggcccctgtcttggtgtattttagtaaagtactttaggagacggccctacgacgggaccctggacgcgattctcgtcggctccagctcgaggacaacgagtctacctcgacctatcgagtggtacggtccggccaaggaggacggaggctagtactattactcgtacgacgtcccgacagacgagacgtgtggactagttatgtacgtagttcgggaggtacgggactacgcgtagtaccgtccgtaggtacacgtacccgacgccgtcggccccctcggtcccg

SEQ ID NO: 74908 - DNA, 545 bp, Homo sapiens
  misc_feature: GYAE6OF01EXRG1.49.20.B09.1.454.CMB.1.raw
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccaggcccctgtcttggtgatttanaaagactttgagaggccctnacgggacccctgacgcgattctcgtggctccagctcgaagggacaacagtcaccttgaccatcagtggagtccgcagaggacgaggctagactagttactgtcacggtccgcagacagacgagtcggactaggtttatcggttacgttagttcgggcggtaacgggtacttacggcgttacggaccggttccgtacggtcacggtcccgaaggcctcccggccccccgtcgtacccg

SEQ ID NO: 74909 - DNA, 661 bp, Homo sapiens
  misc_feature: GYAE6OF01C4KDC.49.20.B09.1.454.CMB.1.raw
  modified_base (184)..(184): a, c, t, g, unknown or other
  misc_feature (184)..(184): n is a, c, g, or t
  modified_base (232)..(232): a, c, t, g, unknown or other
  misc_feature (232)..(232): n is a, c, g, or t
  modified_base (237)..(237): a, c, t, g, unknown or other
  misc_feature (237)..(237): n is a, c, g, or t
  modified_base (493)..(493): a, c, t, g, unknown or other
  misc_feature (493)..(493): n is a, c, g, or t
tcagagtcgagagacacgaccggtgctcgatttagtgtagtgtgaaggggctgtgggtccaggaggcagaactcgtgggtgtctcaccatggctggatcctctacttcctcccctcctcactctctgcacaggctctgacggcctcctatgagctgacacagtcaccgtcggtgtctgtgtccncaggacagacgcagatcgactgctctggcatcgctatagaaccaaaanagtangtactacgtaggacagcagacgccgacggcgacggccctgtcttaggtgtaatttaataaagtacttgaagaccggccacgacggccctgacgcgtaatcgtcgtcgcgtcagtccgacgacggaacaaacggactacccgtaacgttacgaacgtacgttacgaggttacggtacgggtacccgggaaccgaagggaacgggaaccgtagggtaccgtaagtaacccttaagttacgtcgttacgacgtcccganaaccgaagacggtacacggtacgtacgtaaggttacgttacgggtacgttaacggggttcggacgggggtaaccgtaaccgtacggtaccgtacgggtaccggtaccggttaggacctaaccggacccgttaacggaccgttacccggcccccgttcgggttaccccg

SEQ ID NO: 74910 - DNA, 622 bp, Homo sapiens
  misc_feature: GYAE6OF01A8RWA.49.20.B09.1.454.CMB.1.raw
  modified_base (291)..(291): a, c, t, g, unknown or other
  misc_feature (291)..(291): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgtatttanaaagtctttgagacggccctcgacgggacccctgacgtcgattcctctggctccgagctacgaagggacaacgagtcctaccgttagaccctagtacaggtggacggtcccggaccgaagggacggaacggacgggacgttacgaacttagtttacgtacgtaccgacggtcccgacgaacgacgacgcgaggtcggactaagtttacgtacggttacgttaacggttcggggacggaacgggtaccgtaaccggcgttacggaccccggttcgtaacgggtccgaaccggtacccgtaacggtcccgtccgtccccccgttcggtacccg

SEQ ID NO: 74911 - DNA, 686 bp, Homo sapiens
  misc_feature: GYAE6OF01DM8U9.49.20.B09.1.454.CMB.1.raw
  modified_base (217)..(217): a, c, t, g, unknown or other
  misc_feature (217)..(217): n is a, c, g, or t
  modified_base (233)..(233): a, c, t, g, unknown or other
  misc_feature (233)..(233): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacagctctgagcctctatgagctgacacagtcaccctcggtgtctgtgtcctcaggacagacggccaggatcacctgctctggcgangcattcgaccaaaaanatatgtacttacgtggtaccagcagacgccgacggccacgcccgtgtcgttaggtataatttaagtaaagtacgtttaggagtacgccctacgacgggtacccctggacgctactttcgtcgtcggtcctaccacggtctacgaacgggacctaaacgacgttacctaaccgttacgaaccctaagttacgtacgggtacgggtaccggtaccgggacccgtaaaggggacgggacggaaggtacctaggtaaccttatttacgtcgtaacgacgttaccgagacgtaacgagacgtaggtcggtagttacgttatcggttacggtacggttaccgggacgggacgggttaacgtaccggtacgttacccggtaacccggttccggtaaacggttacgaacccggtacccgaaacgggtccccgttacccgtcccccggttcggttaaccccg

SEQ ID NO: 74912 - DNA, 655 bp, Homo sapiens
  misc_feature: GYAE6OF01A149Z.49.20.B09.1.454.CMB.1.raw
  modified_base (554)..(554): a, c, t, g, unknown or other
  misc_feature (554)..(554): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgacggcctcctatgagctagacacagtccacccgtcggtgtctgtcgtcctcgaggacaggaccggccaggactccacctgctcgtggacagtcgactacttacgaacccaaaaatattagtcgtaccttacgtacggtaaccagcgacggacgaccgacggccgaccggtccccttggttcgttaggtattaagttttaacgtaaacgttacgtttacggacggtaccggtacccgtacggacccggtacccgtaggacgtacgttacttccgtcgtcggtacctaccgacgtaccgtacggaacggaaccaacgtaccgtccttaaccgtacgactaactcggacgtcggaccgtccgacgaaggaccggagtacgctagtactagttacgtcgtacgacgtcgacgagacngacgtgtgtagttagtgtagtacgtacggtggaccggtaggcctaggtccgtacgaccgtcgtacgcgaccgaccggactacccgtccctccgtcgtaccg

SEQ ID NO: 74913 - DNA, 673 bp, Homo sapiens
  misc_feature: GYAE6OF01BKEWK.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcgaggacagacggccaaggatcacctgctctggcatgctattgaccaaaaacatatcgacttacgtcggtaacagacagacggccacgggccacggtcccctgtcgttggtagtaatttaagtaaacgtcgtttaggacgacggtccctacgaacgggacccctagacgacgtacttcgtcgtcggcctcgacgtctacgaacgggaaccaacgtacgtacctaaccgttacgaaccctacgtacggtacggttacggggtacggtaccccggaaccggtaagggaaccgggtaacgggacgggtaccgtaacgggtaaacctttaacggtttactaccgggtacgtaccggttcccgacgtaacgacgacggtcgtaggcggtacgtagttaacgtgttacggttagacgggtacggaggtacccgtacgcggttacgaccgttcggtagtccgaaccgtcgacgaccgtccgaccccgttgtacccg

SEQ ID NO: 74914 - DNA, 705 bp, Homo sapiens
  misc_feature: GYAE6OF01DLG9H.49.20.B09.1.454.CMB.1.raw
  modified_base (175)..(175): a, c, t, g, unknown or other
  misc_feature (175)..(175): n is a, c, g, or t
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
  modified_base (374)..(374): a, c, t, g, unknown or other
  misc_feature (374)..(374): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtntctgtgtcctcaggacagacggccaggatcacctgctcgtggcatgcattcgaaccaaaaanatangcttactggtaccagcaaggacggccaggccacggccctgtcgttggtntaatttaataaagtactttggagacggtccctagacgggtaacccctgaacgcgattctcgtcggctcagctacgagggacacngtccactgacatcgagtcggcgtaccggccgaaggacggacggaacggtctacgtaacttaagtttaccgtgtaccgaccggttaccgacaacggacgtaacgacgtaacgggtcggtacgtaacggtttacgttacggtttacggtacggtttaaccggggaccgggggtaacggggttaaccgtaaccgggtacccggttaccgggtaaccccggtttacccgggttaaaaccgggttccccggtaaaacccgggtacccccgggttaaaacggggtcccccggtttaacccccggtcccccccgggttttacccgggttaacccccgg

SEQ ID NO: 74915 - DNA, 745 bp, Homo sapiens
  misc_feature: GYAE6OF01C9FBJ.49.20.B09.1.454.CMB.1.raw
  modified_base (396)..(396): a, c, t, g, unknown or other
  misc_feature (396)..(396): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtcgtcctcgaggacagacggccaggactcactgctcgtggcatgctattacgaccaaaaactattatgtacttacgtacggtaccagcaaggacggccaggaccaccggtcccccttggtcgtttgggtattaatttaagtaaaacggtactttggaacgtacggtccctacgaccgggtacccctggacgcgtacttccgtcgtcggtcctaccngtcctacggaacgggaacctaaacgtacgttacccgtaaccttacgaaaccctacgttcgaacgggttacgggaccggttaccccgggaaccgaaggggaacggggtaaccggtaacgggtaccgttaccggttaaccttacgtttaaccgtcgtaccgtaccggttcccgaacgaacggaacgtacggtacgtagggtacggtacgttaacggtttgttacggttacggtttacggtacggggacgggtaacgggtaccgtaccggtacggtaccggtacccggttcgtaccgggtccgaacccgtacccggtaggtccccgtcccgtccccccggttggttaccccc

SEQ ID NO: 74916 - DNA, 682 bp, Homo sapiens
  misc_feature: GYAE6OF01C0SHR.49.20.B09.1.454.CMB.1.raw
  modified_base (242)..(242): a, c, t, g, unknown or other
  misc_feature (242)..(242): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacacgtcaccctcggtgtctgtgtcctcaggacagacggccaggactcacctgctcgtggcgatgctattacgaaccaaaaanaatatgtaccttacgtacggtaaccagacgaaggacggccgacggccgacggtccccttggttcgttgggtagtaattttaaagaaaacgtcgtttaggaacggtaaccggtcccgtacgaaccggggtaccccctaggaacggccgtaactttccgtcgttcggccttaccgacgtcctacggaacgggaacaacgtacgtacctaccttacgaaccagtacgacggtacggaccggtaccggacgaacgggaacggacggacggtaccgtacggtaacttaacgtttacgtcgtactacggtcccgagaacgacgagtacgaggtcggtactaagttgtcgttacgttacggtacgggagggaacggtctaccggtcgtacggtaccgtccggtacggccgtaacgcccgtaagcccgtccgtccccgtgttaccccg

SEQ ID NO: 74917 - DNA, 679 bp, Homo sapiens
  misc_feature: GYAE6OF01DFXNU.49.20.B09.1.454.CMB.1.raw
  modified_base (258)..(258): a, c, t, g, unknown or other
  misc_feature (258)..(258): n is a, c, g, or t
tcagagtcgagagacacgaccggtgctcgatttagtgtagtgtgaagggggctggtgggtccaggaggcagaactctgggtgtctcaccatggcctggatccctctacttcctccccctcctcactctctgcacgaggctctgaggcctctatgagctgacacagtccacccgtcggtgtctgtcgtcctcgaggacaggaccggccaggactccaccgtgcctcgtaggcgatgctagttcgaacccaaaaatattntagtaccttacgtcggttaaccagacaaggacggaccgaggacccacggtccccgtggttccgtttgggttagtaagtttaaagttaaaacggtactttggacggtacggtccctagaccgggaacccctgaacgcgtattcgtcgtcggtcctaccgacgtcgtacggtaacgggaacctaacgacgtacaacccgttgacctatcgagtcggacgtccgacgaggacggacgagctgactagttaccgtgtaccgacgtccgacagtacgaacgacgacggtaggtcctaaggttactcggttacggttacgttccggggaggtaaaccgggtcgtacccggtacgtaccggtacccggtcgttaagggtcccaccggtacccgaacggtccgtaccccggtccccgttccggtacccg

SEQ ID NO: 74918 - DNA, 701 bp, Homo sapiens
  misc_feature: GYAE6OF01C8BP1.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcgaggacaggaccggccgaaggactccacctgccttcgtggcgatcgactagttacgaaccaaaaactatatgtactttacgtacggtaccagacgaaggacggccgaacggccacggtcccctggttcgttaggtagtaatttaagtaaacgtactttaggacgtacggccctacgacgggacccctggacgtcgtacttcgtcgtcggctaccgacgtctacggaaggaaccaaacgtcgtacctacgttacgaccctaagtcgaaggtcggaccggttacccggacgaagggaacgggacggacgggtacgtacgtaacttaattaccgtcgttacgtacgttacccgacgaacgacgacgacgtacggttcggtacttaacggttagttcggttacggtacggttaccggggacggtaaaccgggttacttaccggtacggtacccgttacggttacggtaccgaccggtacccgaacggtccctacccggtccccgtcgttccctacccg

SEQ ID NO: 74919 - DNA, 838 bp, Homo sapiens
  misc_feature: GYAE6OF01ANW03.49.20.B09.1.454.CMB.1.raw
  modified_base (185)..(185): a, c, t, g, unknown or other
  misc_feature (185)..(185): n is a, c, g, or t
  modified_base (246)..(246): a, c, t, g, unknown or other
  misc_feature (246)..(246): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctnaggacaggaccggccaggatccacctgcctcgtggcgtatgaccattcggaacccaaaaanaattatgtcttaacgtggtaaccgagacgaaggacggaccgaggtacccaccggtccccttggttaccgtttgggtagtaacttttaaagtaaaacggttcgtttaaggacggtaccggtacccctacggaacccggggaccccttggaacgtacgtaactttccgtcgtaccggtacctaccgacggtaccgtaccgggaacgggtaacctaaaccggtacggttacccaaacccgtttcggaaacccgttaacgttaccggaaccgggttcgggtaaacccggggttacccgggacccgtaaacggggtaaacggggtaaccgggtaaccggggtaccgtttaacggtaacccgtttaaacggttttaacccgggttacgttaccccggtaacggttacccggcgaaacgttaacgaaccggtacgtaacgggtacggttaacgttaagtttacgttacggtacggtttacgggttacgggaccgggtagggtaaccgtacggtccggttaaccggtcccggtaccggttaggtacccgaaccggtacccgtaacgggtcccgttcccggacccccgttcggttaacccg

SEQ ID NO: 74920 - DNA, 689 bp, Homo sapiens
  misc_feature: GYAE6OF01C6EU8.49.20.B09.1.454.CMB.1.raw
  modified_base (416)..(416): a, c, t, g, unknown or other
  misc_feature (416)..(416): n is a, c, g, or t
  modified_base (546)..(546): a, c, t, g, unknown or other
  misc_feature (546)..(546): n is a, c, g, or t
tcagagtcgagagacacgaccggtgctcgatttagtgtagtgtgaagggggctgtgggtccaggaggcagaactctgggtgtctcaccatggcctggactccctctacttcctccccctcctcactctctgcacaggctctgacggcctcctatgagtctgacacagtccacccgtggtgtctgtcgtcctacgacggacagaccggccaggactccactgctcgtggcgatcgaccagttacgaaccaaaaatatatacgtacttacgtacggtaccgacgacgaacggacggaccacggaccgaccggtccccgttggttacgttggttagttaactttaaattaaagtacttaggaacgaccgtcccgtacgaccggacccctaggacgtcgtacttcgtcgtcgcctaccgngtacgtacgacggaacaacgtacgacctacgtacgaactacgtacgacggtcggacggtaccgacgaagggacggacgtacggactacggtacttaacgttcgtacgactacgtccgagaacgacgacgngacggtcgtacttaggttagtacggttacgttaccgtagggaccggtacgggtaccgtacggtaccgttacggacccggttgaacccggtcgaacccggacccggttacgaccccggttcccgaccccggttcggttaccccg

SEQ ID NO: 74921 - DNA, 785 bp, Homo sapiens
  misc_feature: GYAE6OF01DT6MB.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtgtctgtcgtcctcgaggacaggacggccaggactcacctgcctcgtggcgatgcctattcgaaccaaaaacatatgtacttactggtaccagcaaggacggccaggcccgacggtccccctggttcgttggtagtaactttaagtaaacgtcgtttaggacggtacggtccccttacggaccgggtaccccctggacggtaccgtactttcctcggttcgggccttacccgacggtcctacggaacgggaacctaaaccgtacgttacccgtaacccgtttaccggaaaccctaacgttacccgtaaggggttaccggggtacccggttaccccggggaccgaaaggggaacgggaccggtaacggtcgtacgttaacttacgttacgtagtccgtaccggtccgacgaacgacgacgcggtaaggttacggtaccttaaggtttacgtaccggtttacggttaacggtttcccggggaaccgggtacgggtacccggttaacggtcccggttaacccgggtaccggtttcccggtaacgggtacccgacccgggtaacccggaaaccgggtccccttacccggtcccccccggttcggttaacccccg

SEQ ID NO: 74922 - DNA, 704 bp, Homo sapiens
  misc_feature: GYAE6OF01B0LMS.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctggaggcctcctatgagctgacacagtccacccgtcggtgtctgtgtcctgaggacaggaccggccaggactcacctgctcgtggcgatgctagttcgaaccaaaaactaatagtcgtacttacgtacggtaaccacgcgaaggacggccgaacggccgacggtcccccttggttcgtttaggttagtaattttaagtaaaaggttaccgttttggaacggaccggtacccctacggaaccggggtacccctggaacggcgtactttcgtcgtcgtcctaccgagtcctacggaacggaaccaacgtcgtacctacgttcgaaccgtagtacgtaggtcgggacgtccggacgaggacggaaggacgtcgtacgtacttacgtacgtcgtacgacgttccgactacgacgagccgtagtcggtacttaagttcgtcggttacgttagggtccgggacgggtaacggtaccgttacggccgtaccgggtacccgtccgtaaccggtaccgtacccggtaacccgtaaccgggtcccgtccccggtccccccggttcggttacccccg

SEQ ID NO: 74923 - DNA, 719 bp, Homo sapiens
  misc_feature: GYAE6OF01CBYFR.49.20.B09.1.454.CMB.1.raw
tcagagtcgagagacacgaccggtgctcgatttagtgtagtgtgaagggggctgtgggtccaggaggcagaactctgggtgtctcaccatggcctggactccctctacttcctcccctcctcactctctgcacgaggctctgacggccctactatgagctgacacagtccacccgtggtgtctgtcgtcctcgaggacaggaccggcaggtactcactgctcgtaggcgtatcgactattacgaaacctaaaatattagtcgtactttacgtacggtacacgacgaaggacggaccgacggccgaccggtccccttggttcgttgggttagttaagttttaagtaaacgttacgtttacgaacggtaccggtacccgtacggaccgggtacccgtaggacggtacttacgttccgtcgtcggacctcgacgtccgtacggaacggaactaccgtactacccgtacgttaccgaactacgtacggtacggtacgggtacggtccccgggaacgagggaacggacggacggtacgttacggaactttacgtacgtacggtaccgtacggtacccgagtaccgaacgacgtacggtagtcgggtacttaaggttcgtacgtacggttacgcggggtaacggtcggactacggtccgtaccgggacgtcggtacggtacccgtacggaacccgtacgtaccccgtacgtccccgttggtaccc

SEQ ID NO: 74924 - DNA, 745 bp, Homo sapiens
  misc_feature: GYAE6OF01CJNPQ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcgaggacagacggccaggatccacctgcctcgtggcgatcgctagttcgaaccaaaaactatagtcgtctttaacgtcggtaaccagacgaaggacggccgacggccgacggtccccctgtcgtttgggtagttaatttaataaacgtacgtttaggaggtaccgggtccctacggaccgggacccgtaggacgtcgtacttccgtacgtcggtcctaccacgtctcgacgaccgaacaacgtacgtaccgtaccgttacgacctacgtacggtaggtcgggaccgggtaccgggacgaagggacgggtaaccggagggtaccgtaacgtaaccgtttaacgttaccggtacgttaccgtaacgtctaccgtacgaagtacgtagggttaggtcggttaccgttacgttaccggttggttaccgggttacggtccggggaacggggtaccgggaacccgtacggtaccggttacccggtaacccggttcccggtaacggttaccgacccggtaccccgggtaaccggtccccgttccccgggtccccccgtttacccggg

SEQ ID NO: 74925 - DNA, 732 bp, Homo sapiens
  misc_feature: GYAE6OF01A3VUG.49.20.B09.1.454.CMB.1.raw
tcagagtcgagagacacgaccggtgctcgatttagtgtagtgtgaaggggctgtgggtccaggaggcagaactctgggtgtctcaccatggcctggatccctctacttcctccccctcctcactctctgcacaggctctgacgcctcctatgagctagacacagtccaccctcggtgtctgtgtcctcgaggacagacggccaggatcacctgctctggcatgctattcgaaccaaaaactataatcgtcttacgtcggtaaccaggacaggaacggcccgaacggcccgaccggtcccccttggttccgtttgggttataagttttaaagtaaaacggtacgttttaggaacggtaccggtacccccgttaggaacccggggttaaccccctggaacgtaccggttactttcccgtcgtcgggtccttacccgacggtacccgtacggaaacgggtaaccaaccgtacgttacccgtaccgtttacgaaccgtaacgtcgaagggttcgggtacgtacccgggaaccggaaggacgggaacgtacgggtactagaacgtttaacttcggtacgtctacgtccgacgtacgacgagtacgtagtagtcgtagtacgttgttaccgtagtcgggacggtacggtactaccgggtcgttacccggacgttccggttaacggccaacccggtaccgtacggttcccctcccggtacccccggttcgggtaacccg

SEQ ID NO: 74926 - DNA, 760 bp, Homo sapiens
  misc_feature: GYAE6OF01A1S24.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagacggccaggatcacctgctctggcgatgctattgaccaaaaacatatcgcttacgtggtaccagcgaaggacggccaggcccacggccccctgttcgttcggtagtaattttaagtaaaacgttaccgttttaggaacggtaccgggtcccccttacggaaccggggtacccccctagggaaccggtccgtaacgtttccgttccggtcggggtacccttacccgacggtcccttaccggaaacgggaaccgtaaaccgtacgtacccgtaacccgtttacgaaccctaacgtaccgtaagggttaccgggaacggttcccggggacccgtaagggaaccgggaaccggtagggtcccgttaggtaaccttacgtttaaccgtcgtaccgtaccggttacccgacgtaacgaccgagaccgtaggtacggtacgttagttaacgtcggtaccgttacgttcggggacggacggggtacgtaccggtcggttacccggaccggtccgtagggtcccaaccgggtacccggtaacggtcccttccccggtcccccggttacggttaccccg

SEQ ID NO: 74927 - DNA, 689 bp, Homo sapiens
  misc_feature: GYAE6OF01B0TSR.49.20.B09.1.454.CMB.1.raw
  modified_base (177)..(177): a, c, t, g, unknown or other
  misc_feature (177)..(177): n is a, c, g, or t
  modified_base (519)..(519): a, c, t, g, unknown or other
  misc_feature (519)..(519): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggccctcctatgagctgacacagtccaccctcggtntctgtgtcctcaggacagacggccaggactcacctgctctggcgatgctattcgaccaaaaacatatcgtacttacgtacggtaccagcgaaggacggccgaacggtacccgaccggtcccccttggttccgtttaggggtacgttaattttaaacgtaaaacgttaccgttttaggaacggtaccggtccccttaacggacggggtaccccttagaacggtccgtaactttcgtaccgtcggtccttacccgacgtccgtacggaaacggggtacctaaacgtacggtacctaccgtttacgaccgtagtcgaggtcggacggtccgacgaagtcggacgnggctagtactattacgtcgtacacgtccgacgacgtacgagacgtacggtggtacgtagtttacgtcggttacgtacggttcggggacggtacgggtacctacggtccgtacggtaccgttccggtaacgtccgaccgacccgtaggccctacccgccccgttcgtcccg

SEQ ID NO: 74928 - DNA, 753 bp, Homo sapiens
  misc_feature: GYAE6OF01E5NXX.49.20.B09.1.454.CMB.1.raw
  modified_base (587)..(587): a, c, t, g, unknown or other
  misc_feature (587)..(587): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtccaccctggtgtctgtcgtcctcgaggacagaccggccaggactccacctgctcgtggcgatgctattcgaaccaaaacatatcgtacttacgtacggtaccagacgacggacggccgacggccgaccggtccccgttggttccgttgggtacgttaaattttaaagtaaaacggttaccgttttagggaacggtacccggtaccccgttaccggaacccgggtacccccgtagggacgtccggttactttccgttccgttcgggcccttaccggacgtccgtaacggaacgggaacctaacgtacgtaccctaccgttacgaacctactaccggtaggtccgggtaacggtcccggaacgaacggggtacggaacgggtacgtcgtaacgtacttaacttcgtcgtaccgccggtccgaacncggaacgcgtacgtagtcgggtacgttaagttacgtcgggttacgttacgggtacgggaccgggtacggtaaccgttccggtacggtacccggtacccggttcggtaccgtaacccggtacggacccccgtaggtccccgtccccggtccccgttccggttacccc

SEQ ID NO: 74929 - DNA, 727 bp, Homo sapiens
  misc_feature: GYAE6OF01EV6XE.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctcgtggcgatgcattgaccaaaaacatatgcttactgtaccagcagaggccaggccacggcccctgttcgttggtgtatttaagtaaagtactttgacgacggccctacacgggacccctgacgcgtattctctggctcacgctacgaacgggaccaacgtacgtacctaccttacgaaccctagtaccgtaggtacgggtacccggtccccgggaccgaacggggaacgggaaccgggagggtacgttaacggtaaccgttttaacgtttaaccgttcgtaccgtaaccgttacccgaaccgaacggtaacgaacggacccgtaagggtcgggtaaccttaagggttttagttcggttacggtttaccggttacgggggaccggggtaacggggtaaccgttaccgggtccgttacccggtaaccccggttcccgttaacgggtacccgacccgggtaaccccggtaaaccgggtccccgttacccccgggtcccccccggttcgggttaaccccc

SEQ ID NO: 74930 - DNA, 676 bp, Homo sapiens
  misc_feature: GYAE6OF01BH5ME.49.20.B09.1.454.CMB.1.raw
  modified_base (244)..(244): a, c, t, g, unknown or other
  misc_feature (244)..(244): n is a, c, g, or t
  modified_base (372)..(372): a, c, t, g, unknown or other
  misc_feature (372)..(372): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaacatatgcttacnggtaccagcagaggccaggccaggcccctgtcttggtcgatttagtaaagtactttgagacggtccctacgacgggtacccctggacgcgtattccgtctcggcctcgacgctacgagggtacaaacnggtaccaccgtttgaccctaattccgaggtcgggtacggtcccggaccgtaggacgggaaccggaggtaccgtggtaaccttagtttaaccgtcggttaccgtacggttcccgacgaacggacgtaacggtaccaaggttcggggacttacggtttaagttcggttacggttaggtttacccggggagggtaacggggtaaccgttaacgggtcccgttacccgggtaaccggttcccgtaaggggttcccaaacgggtcccccgtaaacgggcccttcccgggtccccccgttagggttcccc

SEQ ID NO: 74931 - DNA, 670 bp, Homo sapiens
  misc_feature: GYAE6OF01C053A.49.20.B09.1.454.CMB.1.raw
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (482)..(482): a, c, t, g, unknown or other
  misc_feature (482)..(482): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctctatgagctgacacagtccaccctggtgtctgtgtcctcaggacagacggccaggatcacctgctctggcatgctattgaccaaaaanattangacttactggtaccagcagagccagccacgtccctgtcttggatattataaaagctttgaagtacggccctagacgggtacccctggtagcgtatttccgtactcggccttcgaagtcctacgaacgggacaaacgtacgtacctaaccgtttagaaaccctagttacgaagtggacggttcccggaccaagggacgaacgacggctacggtacttagttaactcgtactaccggtacccgganaacgaacaacggtacgtaacggtacgggtacctaagtttacgttacggttaccggtaacgggttccgggtacccgggtaacggggtaactaaccggtacgttaccggtacccggtttaacccggtagggttaacccaacggtacccgaaaagggtccccgtaaccggtccccccggtcggttaccccg

SEQ ID NO: 74932 - DNA, 707 bp, Homo sapiens
  misc_feature: GYAE6OF01ASF7M.49.20.B09.1.454.CMB.1.raw
  modified_base (186)..(186): a, c, t, g, unknown or other
  misc_feature (186)..(186): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacaggacggccaggatcacctgctctggcgatgcattcgaccaaaaacatagtcgacttactggtaccagcaggacggccacggccacggtccccctgttccgtttgggtagtaatttaataaaacgtacgtttaggacggacgggccccttacggaccgggaccccttggaacggtcgtacgtttccgtcgtcggtcccttaccgaggtcctacggaacggggaacctaaaccgtacggttaccctaacccgtttacgaacccagttaccgagggtcgggaacggtcccgggaccgaagggacgggaacgaggcctaggtacttacgttaccgtgtacctacggtccccgagaacgtacgacggacgtacggtgggacgttaaggtttgtacggttacggtttaggttccggggagggtaaccgggtacctaccggtcgtacgggaacccgtttccggtacggtccgaaccggtaccccgtaagggcccttccccggtcccccggttcggtaacccg

SEQ ID NO: 74933 - DNA, 565 bp, Homo sapiens
  misc_feature: GYAE6OF01BLD1T.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccaggcccctgtcttggtgtatttataaagtactttgagaggccctgacgggacccctgacgcgtattctctggctcgagctcgagggacaacgagtccacttgaccatacagtgagtccgcaggaggacgagctacgactattacgtgtcacgtccgagtacgacaagcaggtggtacgtagtttagtggttcggtaaggttccgggacgggtacgggtaactacggtcttacggacccgttaccgtaggtacccgacggtaccccgtaagggtccgtccggtcccccgttcgggtaccc

SEQ ID NO: 74934 - DNA, 720 bp, Homo sapiens
  misc_feature: GYAE6OF01EJINT.49.20.B09.1.454.CMB.1.raw
  modified_base (240)..(240): a, c, t, g, unknown or other
  misc_feature (240)..(240): n is a, c, g, or t
  modified_base (244)..(244): a, c, t, g, unknown or other
  misc_feature (244)..(244): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctggaggcctcctatgagctgacacagtccacccgtggtgtctgtcgtcctgaggacagcggccaggactcacctgctcgtggcatgctatcgaaccaaaanaatntgtacttacgtacggtaaccagacaggacggccacggccacggtcccctagttcttaggtattatttaataagtgtacgtttggaggtcggacccctaggaccggtacccctggacgtccgtacttccgtcgtcggccttaccgacgtaccgttaccggaacgggtaacctaaacggtaccgtttacccgaaccgtttacggaacccctaagttaccgtagggttaccgggtaccggttacccggaaccggaaagggtaaccgggaacgggtacggtccgtaacgtaactttaaccgttacgttacggtaccgtacgtacccgacaacggtaccgacggtaacgtagggttcgacgttagttacgtgggtttaccgtaggtaccggggccgaagggttaccgtaccggacgttaccggtcccgttacggtacggtaccgaccgtaacccggagtcccgtcccgtccccgttaccgg

SEQ ID NO: 74935 - DNA, 646 bp, Homo sapiens
  misc_feature: GYAE6OF01A9C2T.49.20.B09.1.454.CMB.1.raw
  modified_base (237)..(237): a, c, t, g, unknown or other
  misc_feature (237)..(237): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcgaggacagacggccaggatcacctgctctggcatgctattcgaccaaaanatatgcttactggtaccagacagagccaggccacggcccctgtcttggtgtatttagaaagtctttgagacggccctcgacgggacccctgacgtcgtattctcgtgctccgagctcgaggtacaactacgtctacctgacctatcaggtggacgtccgcgaggacggacgaggctgtaactacgttacgtcgtaccgtacgtcccgacgtaacggacctacggcgtacgggtcggtacttaaggttttacgtccggttacggttacggtttacccggggacgggtaacggggtacccgttaacgggtccgttacgggtaccccggtttcccggtacgggttacccgaacccgggtaccccgaacggggtccccttacccgggtcccccccgttacgggtttacccccg

SEQ ID NO: 74936 - DNA, 830 bp, Homo sapiens
  misc_feature: GYAE6OF01CQZ4J.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacaggacggccaggactcacctgctctggcgatgctattcgaaccaaaaactatatgtcttacgtacggtaaccagaccgaggacggaccacggtcccaccggtcccccttggttcgtttgggtattaatttaagtaaacggttactttaggacggtacggtccccgtacggaaccggggtacccctaggacggtaccgtactttccgtcgtcggtcctcccgaacggtcctacggaacgggaacctaaaccgacggtttaccctaacccgtttacggaaccctaacgttaccggtaacgggtttacggggacccggttaccccgggaaccggaaacgggaacggggtaaccgggtaacggggtacctttaacccgggtaaccttttaaacggttttacccggtacggttacccgttaccgggttaccccggaagtaaaccggacgtaacggtaccggtaagggttccgggtaacgtttacggtttacgttacgggtttaccggttaaccggggtttaccggggaaccggggttaaacggggttaccgtaaccggttccggtaacggtaacccggtttcccgtagggtacccgacgtaccccggtaacggtccctacccccgggtcccgttccggttacccc

SEQ ID NO: 74937 - DNA, 539 bp, Homo sapiens
  misc_feature: GYAE6OF01DYTM7.49.20.B09.1.454.CMB.1.raw
  modified_base (298)..(298): a, c, t, g, unknown or other
  misc_feature (298)..(298): n is a, c, g, or t
  modified_base (366)..(366): a, c, t, g, unknown or other
  misc_feature (366)..(366): n is a, c, g, or t
  modified_base (376)..(376): a, c, t, g, unknown or other
  misc_feature (376)..(376): n is a, c, g, or t
  modified_base (424)..(424): a, c, t, g, unknown or other
  misc_feature (424)..(424): n is a, c, g, or t
  modified_base (455)..(455): a, c, t, g, unknown or other
  misc_feature (455)..(455): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtcgtcctcgaggacaggacggccaggactcacctgctcgtggcgatgctattcgaccaaaaacatatgtcttactggtaccagcagagccaggccaggcccctgtcttggtgatttanaaagtctttgagacggccctgacgggacccctgacgcgtattctcgtggctcgagctagaggacaacngtcaccgttnaccatcgagtggacgtccggacaggacgacgaagctagtactattacngtcacgtcgacagacagctaggtgctagttntggtcgtagttcggacggaggtactacgctacggaccgttcgtaggtcacggacccgaacggtccgtaccgccccgtggtaccc

SEQ ID NO: 74938 - DNA, 731 bp, Homo sapiens
  misc_feature: GYAE6OF01DGMRX.49.20.B09.1.454.CMB.1.raw
  modified_base (203)..(203): a, c, t, g, unknown or other
  misc_feature (203)..(203): n is a, c, g, or t
  modified_base (558)..(558): a, c, t, g, unknown or other
  misc_feature (558)..(558): n is a, c, g, or t
  modified_base (709)..(709): a, c, t, g, unknown or other
  misc_feature (709)..(709): n is a, c, g, or t
tcagagtcgagagacacgaccggtgctcgatttagtgtagtgtgaagggggctgtgggtccaggaggcagaactctgggtgtctcaccatggcctgaatccctctacttctccccctcctcactctctgcacaggctctgaggcctcctatgagctgacacagtccaccctcggtgtctgtgtcctcaggacagacgccaggntcacctgctcgtggcatgctattcgaaccaaaaactatatcgtactttaacgtacggtacccagaccaacggacggccgacgggccacggtccccttggttcgtttgggttagttaattttaaagtaaaacggttacgttttaggacggtaaccggtccccgtacgtaaccggggaccccctaggaacggtccgtaacgtttccgtaccgttcgggtacccttacccgagccgttacggaaacggggtaccaaaactcggttaccaacctttacggacctaagtcgagggtacggaccggtcccggaccgaagggacggaacggaacggtacgtacgtaacgtttaacttaccgngttaccgaccggttccgaacgaagtaacgacggtaccgaaggttcggtacttaacggtttgttacgttacgggttgttacccggggagggaccgggtactacggccggttacgtacccggttaccggtacggacaccggcccaaggtcccncccggtccccgtcggtaccccg

SEQ ID NO: 74939 - DNA, 718 bp, Homo sapiens
  misc_feature: GYAE6OF01AJMRF.49.20.B09.1.454.CMB.1.raw
  modified_base (563)..(563): a, c, t, g, unknown or other
  misc_feature (563)..(563): n is a, c, g, or t
  modified_base (581)..(581): a, c, t, g, unknown or other
  misc_feature (581)..(581): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctggacggtcctcctatggagctgacacagtccaccgtcggtgtctgtcgtcctgacggacacggaccggccaggactccactgctcgtggcatcgactagtcgaaccaaaatatagtcgtacttacgcgtacagcaggacgccgacggccgaccggtccccgttgttccggttagggttagtttaaatttaacgtaaacgttcgtttaggaaccggtaccggtacccctacgggaacccgggtaccccgtaggtacgtcgttaacgttccgtacggtccggttccaccgagtacccgtaacggaacgaaccgtaacgtaccgtacctaccgttacgacctacgtacgggaggtcggacccggtaccggaacggtaacgggaccgggtaacgtacggtcgtaacgttaacgttacgtttaccggngtaccgtccgaccggtanacggaacgtcgaacggtcggagttacgtgttacgtcgtacggtacggtcgggaggtaccgtacgtccggtacggtcccggtacgttccggactacggacccgtaccggcgtaaccccgtccgtacccgtcgtacccg

SEQ ID NO: 74940 - DNA, 799 bp, Homo sapiens
  misc_feature: GYAE6OF01E2JML.49.20.B09.1.454.CMB.1.raw
  modified_base (180)..(180): a, c, t, g, unknown or other
  misc_feature (180)..(180): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgacggcctcctatgagctagacacacgtccacccgtggtntcctgtcgtcctcgaggacaggaccggccaggactccacctgccttcgtggcgtatcgactattacgaacctaaaaatattatacgtacttaacgtacggtaacccagtacaacggtaacgccgtaggtaccgacccggtccccttaggttccttagaacttacttaagttttaaaacgaaacgtttccgtttaggaacggtacggtaccctacgggtaacccgggtacccctaggacgtaccgttacgtttccgtacgtacggtcccttacgacgtccctacgaacgacccgtaaacaaccgtacgtacccgtaagtttccgaaccttagtacgtagggttacgggtaccggtaccgggtaacgaaagggacgggtaaccgggacggttacgtacgtaaactttaccggttaacgtcgttacgtaacgtccaaggttaccaaacggttcgaaacggtttcgggaccgttacttaaccggtttcggttaacgttacggttacgggttacccggggacggtaaaaccgggccgtaagtccccgggttacgtaacccccggtttggaacccggtaccgtaacccggaacccgggtaaccgttccgtccccccgttacccgg

SEQ ID NO: 74941 - DNA, 548 bp, Homo sapiens
  misc_feature: GYAE6OF01DP1ZR.49.20.B09.1.454.CMB.1.raw
  modified_base (347)..(347): a, c, t, g, unknown or other
  misc_feature (347)..(347): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattgaccaaaaacatatgtacttactggtaccagcagagccaggccaggcccctgtcgttggtgtatttataaagtcgtttagagacggccctacgacgggacccctgacgcgtattctctggctcngctcgaggacaacagtcacgttgacctatcgagtcggacgtaccggcaggacggacgaggtctacgtactattaccgtgtctacggtccgacgagacagcgagtcggtctagttataggtcgtagtccgggcggtagggactacggcgtaggaccgtccgaggtcaacggtcccgaacggcctacccgccccgtcggtacc

SEQ ID NO: 74942 - DNA, 698 bp, Homo sapiens
  misc_feature: GYAE6OF01AYS58.49.20.B09.1.454.CMB.1.raw
  modified_base (175)..(175): a, c, t, g, unknown or other
  misc_feature (175)..(175): n is a, c, g, or t
  modified_base (524)..(524): a, c, t, g, unknown or other
  misc_feature (524)..(524): n is a, c, g, or t
  modified_base (548)..(548): a, c, t, g, unknown or other
  misc_feature (548)..(548): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgtcggcctcctatgagctgacacagtcaccctggtntctgtcgtcctgacggacaggaccggccgaaggactccaccgttgctcgtggactagtgacctagttacgaacctaaaaactagttacgtcgtaccttacgtacggtaaccacgtacgaaggtaccggaccgacggacccgtaaccgtccccgttgttaccgtttaggtacgttaatttaacggtaaaacgttcgtttaggaacggtccggtacccgtaacggaccggtacccgtggacggtcttacgttcgccgtcggacctcgacgtcgacgtaaggaactacacggtacctaacgtgactacgtacgtcggtcggaaccgtcgacggaggtacggcgagtacgtanacgttatacgtcgaacgcgtacgnaagacgtgacgtaggtagtattacgttacgtacggtacgttaggtccgggtaacggtacggtaacgtcccgttcgggtaaccgttccggttaacggaccgtccgaacccggtaacggacccgttcccggacccgttcccgtcgtaacccg

SEQ ID NO: 74943 - DNA, 706 bp, Homo sapiens
  misc_feature: GYAE6OF01BZXZ9.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtcaccctggtgtctgtcgtcctcaggacagaccggccaggactcacctgctcgtggcgatgcatcgaaccaaaaacatatgacttacgtgtaaccagcaggacggccacggccacggtcccctaggtcgttaggtagtaatttaagtaaacgtcgtttaggacggtacggccctacggaaccgggtaccccgtggacgtcgttattccgtcgtcggccttaccgacgtctacggaacgggtaaccaaacgtacgttaccctaaccttacgacctagtacgacggtcggtacgggtaccggacgaaggacggacggacggtactacggtaactttacgttacgtcgtaccgtaccggcgtacgaagacgacgtacggacggtcggtacgttagttacgtggttacgttcggttaccggggacggtacgggaaccgttaccggtacgttacccggtacccgggtttacccggtacgggtacccaacccgggtaccccggtaaacggttcccccgtccccgggtcccccggttccggttaccccg

SEQ ID NO: 74944 - DNA, 679 bp, Homo sapiens
  misc_feature: GYAE6OF01EMCZH.49.20.B09.1.454.CMB.1.raw
  modified_base (242)..(242): a, c, t, g, unknown or other
  misc_feature (242)..(242): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgacggcctctatgagctgacacagtccacccgtggtgtctgtcgtcctcgaggacaggaccggccaggatcacctgcctctggacatgctatcgaaccaaaaanatatgtacttaactcggtaccagacaggacggaccgacggccacggtccccgtgttcgttgggtataatttaagtaaagtccgtttaggacgtacggtccctacgacgggtacccctagacgtcgtattcctacgtcggcctcgagtccgtacgaacgggaactaacgtacgtcctaacgttcgaacctatacggtacggttacgggaccgttccggggaccgaaggggtaacggacgggtaggacgttaacgtactttaacgttaccgttgtaccgacggtacccgacgacgaactggacgtaggtcggtactagtttacgtcggtacgtacggttacgggacgggtacggaccgtacggtcgttacggacccggttcgtaaccggtgaaccccggtaccgaacggttcccgtaccccggttccccgtcggtaccc

SEQ ID NO: 74945 - DNA, 777 bp, Homo sapiens
  misc_feature: GYAE6OF01C342R.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacggcctcctatgagctgacacgacgtccacccgttcggtgtctgtcgtccctcgaggaccgagaccggaccaggactccaccgtgcgtcgtcggcgatgacgtattaccgaaccaaaaactattacgtcgtacctttacgtaggaccgagcgaaaggcggtacccacggcccgaccggtccccttggttaccgtttagggtatttaaagttttaactaaacggttacgtttacggacgtaaccggtcccgttaacggaacccggggtacccctaggaacggtacgttcgtttcctcggtacgtccctacgacgtccgtaacggaaacgggaacctaacgtacgttacccgaccgtttacgacctagtacgacggtaccggtacggtacccgacgtaacgggaccggtaacggtacgtaccgtaggttaacctttacgttaacgtgtacccggaggttacccgataaaccggctacgggacttacggggaacgtacgttagttacgtttaggtaccggtttaaggtccggggacggtaacggtacccgtacggtccggaaccggttcccggtagttaacccggcgtaaaccgtcccgggaacccgtccggttaccccgcccggttacggttaccccg

SEQ ID NO: 74946 - DNA, 714 bp, Homo sapiens
  misc_feature: GYAE6OF01DJGIP.49.20.B09.1.454.CMB.1.raw
  modified_base (355)..(355): a, c, t, g, unknown or other
  misc_feature (355)..(355): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtcgtcctcgaggacaggacggccaggactcacctgctctggcgatgcattcgaaccaaaaacattatgacttacgtaggtaccagcaaggacggccacggccgacggcccctgtcgttggtagtatttataaagtctttagagacggtccctacgacggaccctgacgtcgtattcncgttcggcctcgacgctcgaacgggaccaacgacgtacctaccgttagacctactcgacgtacggacggtaccggaccgaacgggaacgggacggacggacgtacgtaacttaacgttacgttagtaccccccccccgtaaggtacccgacgaacggacgaacggtacgtaacggtcggtacgttaaggtttacgttaacggttcggttaacggtttaccggggtaccggggtaaccggggtaacgttaaccgggtaccggttaccgggttaacccggttccggttaaccggttaccggaacccggtacccggtaaccgggtacccgttacccggtccccccggttccgggttaccccg

SEQ ID NO: 74947 - DNA, 806 bp, Homo sapiens
  misc_feature: GYAE6OF01D2ORQ.49.20.B09.1.454.CMB.1.raw
  modified_base (83)..(83): a, c, t, g, unknown or other
  misc_feature (83)..(83): n is a, c, g, or t
  modified_base (180)..(180): a, c, t, g, unknown or other
  misc_feature (180)..(180): n is a, c, g, or t
  modified_base (264)..(264): a, c, t, g, unknown or other
  misc_feature (264)..(264): n is a, c, g, or t
tcagagtcgagagacacgaccggtgctcgatttagtgtagtgtgaagggggcttggtgggtccaggaggcagaactctgggtntctcaccatggcctggatccctctacttctcccctcctcactctctgacacaggctcgtgaggcctctatggagctgacacagtccacccgttggtntctgtcgtccctcgacggacacggacggccaggactccacctgcctcgtggaccgtatcgacctattacgaccctaaaaaagtnttagtcgtacttaacgtacgggtaacccaggccgtaaggaacggccaggggccccaacgggtcccccttaggttaccgtttagggtagttaacgttttaaagtaaaacggttccgtttaggacggacggttccccttaacggtaaccggggtaacccccttgggaaccggtcgtaacttccgtacgtcggtacctccggagttccgtacggaaacggggtaacctaaacggcggttaccctaaccgttcggaaccctaagttccgtaacggtacggtaccggttacccggacggaagggtacgggaacggtaacgggtacgtacggtaacgtttaagtttacgttacggttacgttaacgtacgtacgttaccgaaggtaacgtaggttaacggtgggtaccttacgtttcgtacggtttacgtacggttccggggtacggacgggtaccgaacggtcccggtaggtacccggttccggtaacggttccgaacccggtacccggtaacggttccggtccccggttccccggtcgggtacccc

SEQ ID NO: 74948 - DNA, 760 bp, Homo sapiens
  misc_feature: GYAE6OF01BRLSC.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtccaccctcggtgtctgtgtcctcaggacagacggccaggatccacctgctcgtggcgatgacattacgaaaccaaaaacataatcgtactttacgtacggtaccagacaaggacggccgacggcccgtaccggcccccgttaggttccggttttggtacggttaattttaaaacgttaaaacggttacgttttaggaacgggtaccgggtacccctaccggaaccgggtacccctagggaacgtacgttaacgtttcctcggtacgggtccttaccggacgtaccgttcggaaacgggaacctaacgtacgtaccctaaccgtttcgaaacccgtattaccggtagggtaccggtaccggtacccgggaccgaacgggacgggaaccggtagggtcccgttagtaaccgttagtttaaccgttgtaaccgtacggtacccgtacgacggaacgtacgacgtaggtacgtagttaacgtttgtaccggttacggtacgttccgggacggtaccgggtaccgtacgtacgtaccgtaccggttaccgacggtaccgaccgaccgtaacggccctaccccgtcccggtccggttacccg

SEQ ID NO: 74949 - DNA, 791 bp, Homo sapiens
  misc_feature: GYAE6OF01DJIR3.49.20.B09.1.454.CMB.1.raw
  modified_base (132)..(132): a, c, t, g, unknown or other
  misc_feature (132)..(132): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcanggctcgtgacggcctctatgagctgacacagtccaccgtcggtgtctgtcgtcctcgaggaccgagaccggcctaggactccaccgtgccttcgtagggcctagtcgacctaagttacgaaaaccctaaaaaagtaattcgtacggttacctttaacggtacggtaacccagacgaacggaccggaccgtacggacccgtaccggtcccctttaggttcgtttaggttaagttaaaatttaacggtaaaaagttccgttaggacggtaaccgttcccgacgttaacccgggaccctggacgtacgttacttccgtcggtcggtcctacaggtaccctaacggaaacggaaacctaacggtaccgtttaccaaccgtttcgaaacctcgttaacgacggtaccgggtacggtacccggacggaaacgggacggtaacggaacggtacgtacgtaacttacgtacgtacgtacgtaccgtaccgacggtaacgtaacggaacgtaccggtaaggtacggttaccgttaaaggtttcgttacggtttacggttacggttacgggtacgggaccggttaaccgtacggaccgttacggttacccgtacggtacgtaccgaacccgacggtaaccgtcccggttccctcccggtccggtacccg

SEQ ID NO: 74950 - DNA, 717 bp, Homo sapiens
  misc_feature: GYAE6OF01CM6JD.49.20.B09.1.454.CMB.1.raw
  modified_base (241)..(241): a, c, t, g, unknown or other
  misc_feature (241)..(241): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtccaccctcggtgtctgtgtcctcgaggacaggacggccaggatccacctgctcgtggcgatgctattcgaccaaaanatatgcttaactggtaccagacgagacggccaggccacggtcccctggttcttggtagtaatttaataaagtactttggaaggacggccctacgaacgggacccctggacggacgtatttccgtcgtggcctccaacgtcctacgaacgggaactaaaccgaggtacccgtaaccctttcgaaacctacgttccgaacgggtagggtaccgggtaccccgggaccgaaaggggaacggggaaccggtaagggtaccgtaggacgtttaaactttacgtcgtaccgtaccggtaccccgacgaacggacgaacgaccgacggtacgggtacttaacgtttagttcgtacggttaacgttccggggtaccgggaaacgggtaccgtaccggtccgtaccggtaaccccgggtttcgtaaccgggtctaccgggaccccggtaacggtcccgttcccggccccccggttggtacccccg

SEQ ID NO: 74951 - DNA, 665 bp, Homo sapiens
  misc_feature: GYAE6OF01AWZOO.49.20.B09.1.454.CMB.1.raw
  modified_base (82)..(82): a, c, t, g, unknown or other
  misc_feature (82)..(82): n is a, c, g, or t
  modified_base (133)..(133): a, c, t, g, unknown or other
  misc_feature (133)..(133): n is a, c, g, or t
  modified_base (175)..(175): a, c, t, g, unknown or other
  misc_feature (175)..(175): n is a, c, g, or t
  modified_base (186)..(186): a, c, t, g, unknown or other
  misc_feature (186)..(186): n is a, c, g, or t
  modified_base (245)..(245): a, c, t, g, unknown or other
  misc_feature (245)..(245): n is a, c, g, or t
  modified_base (294)..(294): a, c, t, g, unknown or other
  misc_feature (294)..(294): n is a, c, g, or t
  modified_base (334)..(334): a, c, t, g, unknown or other
  misc_feature (334)..(334): n is a, c, g, or t
  modified_base (399)..(399): a, c, t, g, unknown or other
  misc_feature (399)..(399): n is a, c, g, or t
  modified_base (482)..(482): a, c, t, g, unknown or other
  misc_feature (482)..(482): n is a, c, g, or t
tcagagtcgagagacacgaccggtgctcgatttagtgtagtgtgaagggggcgtgtgggtccaggaggcagaactctgggtntctcaccatggcctggatccctctacttctccccctctcactctctgcacnggctctgaggcctcctatgagctgacacagtccaccctggtntctgtgtcctnaggaccaggaccgccaggactccacctgcctctgggcgatgcctattcgacctaaaaanatatgcttacgtgtaccagcagagccaggccacggtccctgttcttggngtattataagtctttgagcgtcctacgacgggacccctgngtctattccgtagtcggcctccgagcctacgacggaaccaacgtacgtacctaccttgaacctancgtaacggtcggtaccgtccggtacacggaggacggtacggacttacgactttaacgttacgtcgtaccgtcggttccccganaacggtaccgacgtacgtaagggttaccgtacgttaacgtttattccgggttaacgtccgggtttacggggaccggtacgggtaaaccgttcccggtacggttaccggacccggttcggtttaccggacccgtaccggacccctaacggtcccgtccccggtcccccgttccggtaacccccg

SEQ ID NO: 74952 - DNA, 723 bp, Homo sapiens
  misc_feature: GYAE6OF01B2TF1.49.20.B09.1.454.CMB.1.raw
tcagagtcgagagacacgaccggtgctcgatttagtgtagtgtgaagggggctgtgggtccaggaggcagaactcgtgggtgtctcaccatggcctggactccctctacttcctcccctcctcactctctgcacgaggctctggacgcctctatgagctagacactacgtaccacccgtggttgtcgtgtcgtcctagacggacaggaccggcaaggactccactgtctcgtggcgatcgactagtacgaaaccaaaatattacgtcgtacgttaacgtacggtaacagacgacggacggacgacgccgaccgtccctggttcgttggtagttaatttaagtaacgtacgttaggacggtaccgtaccgtacggaaccggacccgtaggaacgtcgtactttcgtacgtacgacctacgacgtacgtacggaacggaactacgtacgtacctaacttcgaacctagtacgtaggtacgggaccggtaccgacggaagacgggacgtacgtacggttactaacgttacgttacgttacgaccggtaacgtcggaactaggaccgaagcggttaacggtcgtaacgttaaggtttccgtaggttaccggtaacggtccgggaacgggtacggttaaccgaaccggtccgtaacccgttacccggtcggttacgacccgttaaccgaccggacggttcccctacccggtaccccggtgttaccccg

SEQ ID NO: 74953 - DNA, 643 bp, Homo sapiens
  misc_feature: GYAE6OF01BV9OU.49.20.B09.1.454.CMB.1.raw
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggactcacctgctctggcgatgcattcgaaccaaaacatatgtcttaacgtcggtaaccagcgaaggacggaccgaggccacgggtccccttggttcgtttggtagttaatttaagtaaagtcgtttaggaaggaccggtcccgtacgaccgggacccctaggacgcgtattcctcgtcggcctaccgacgtccgtacggaacgggtaaccaacgtacgtaccctaccgttacgaacctacgtcgtagggtcgggaccggtacccggacgaaggacggacgacggctagacttattacgcgtcgacgtccgacgagacgngacgnggtagtacgtagttacgtggtacgtgttcgggacggtacgggtacgtacggtcgtacggacccggttcgtacggaccaccgtacccggtacgtccgtcccggtccccgtccggttaccg

SEQ ID NO: 74954 - DNA, 766 bp, Homo sapiens
  misc_feature: GYAE6OF01C8GEK.49.20.B09.1.454.CMB.1.raw
  modified_base (598)..(598): a, c, t, g, unknown or other
  misc_feature (598)..(598): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacagctctgaggcctcctatgagctgacacagtccacccgtggtgtctgtcgtcctcgaggacaggaccggccaggactccaccgtgccttcgtcggcgtagtcgacctacttacgaacccaaaaaactattagttacgtaccttacgtacggtacccagaccgaaggacggaccgacggccgaccggtccccgtggttcgttagggtagttaaactttaagttaaaacgtcgtttaggacggtaccggtccccgtacggaaccggtaccccgtgacggaccgttattccgtcgtcggtcctaccgcgtaccgtaccggaacggactaaaccgtacggtaccctaacccgtttgaaccctacgttacgaggttaccgggaccggtcccggaccgacgggaacggaccggaacggtaccgtagtaaccgttacgttacgtacgtaccgtaccggtccgaacgacgtaanacgacgtacggtacggtacttaggttagttcggttacgttacgggttaccgggtacgggtaaccgggtacgtaccggtccgtaccggttacccggttcggttaccgggtaccgacccgggtacccgaacccggtcccgttaccccggtcccccggttccggttccccg

SEQ ID NO: 74955 - DNA, 571 bp, Homo sapiens
  misc_feature: GYAE6OF01B67ZI.49.20.B09.1.454.CMB.1.raw
  modified_base (81)..(81): a, c, t, g, unknown or other
  misc_feature (81)..(81): n is a, c, g, or t
  modified_base (132)..(132): a, c, t, g, unknown or other
  misc_feature (132)..(132): n is a, c, g, or t
  modified_base (175)..(175): a, c, t, g, unknown or other
  misc_feature (175)..(175): n is a, c, g, or t
  modified_base (251)..(251): a, c, t, g, unknown or other
  misc_feature (251)..(251): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (353)..(353): a, c, t, g, unknown or other
  misc_feature (353)..(353): n is a, c, g, or t
  modified_base (450)..(450): a, c, t, g, unknown or other
  misc_feature (450)..(450): n is a, c, g, or t
  modified_base (462)..(462): a, c, t, g, unknown or other
  misc_feature (462)..(462): n is a, c, g, or t
tcagagtcgagagacacgaccggtgctcgatttagtgtagtgtgaagggggctgtgggtccaggaggcagaactctgggtntctcaccatggcctggactccctctacttcctcccctctcactctctgcanaggctctgaggcctctatgagctgacactgtccacccgtggtntcctgtcgtcctagaggacagccggccaggtactcaccgtgcctcgtgggctatgactattacgaccaaaaaagtntagtgacttacgnggtaccagcagacgccagcctacggccctgtcttggntatttagaaagtcttgacgaggcccctagacggaccctgagcgtattctcgnggtctaccagctcgaacgggacaacgagttccacgttacgaacctatccgtaggtggacgtccggacaggacgtacgaggtctacgtactacttagngtcagcccgtanacgacgtgcgtagtcgagtaagttcgtagttccgtaaggttcggaccgggaggtactaccgtgtccgtacggtacgtacgctaccgccgaagcctccgcccctggtacc

SEQ ID NO: 74956 - DNA, 709 bp, Homo sapiens
  misc_feature: GYAE6OF01CZQ9D.49.20.B09.1.454.CMB.1.raw
  modified_base (143)..(143): a, c, t, g, unknown or other
  misc_feature (143)..(143): n is a, c, g, or t
  modified_base (411)..(411): a, c, t, g, unknown or other
  misc_feature (411)..(411): n is a, c, g, or t
tcagagtcgagagacacgaccggtgctcgatttagtgtagtgtgaagggggctgtgggtccaggaggcagaactctgggtgtctcaccatggcctgactccctctacttcctcccctcctcacttctctgacacaggcttcgngacggccctctagtgagtctgaacactacgtcctacccgttggtgtccttgtcgtccgagagacgagaccggcgaggactccacgtcgccgttgacgggtactagtcggactacgttacgaaaaaccaaaaatagttctacgttacctttaacgcggtaaccacgacgtaggacggaccgtacggacccgccggtccctggtttacgttcggtaaatttaactttaagaaagttccgtgacggaccgtcacggtacggacctaggacncgttactccgcgtctccgtcaggtcggtacgacggaactaacgtccgtactaccgtgaaacctggtaaccgtggtacggtacggaccgtacggaacgtacggacgaggtaccgtactacgttacgtacgtacgtaccgacggtacgaacgacgtacgagttacgaggtacgttacgtaacgttgtaacggtggttaccgggtacgggaccggtacgaccggtacgtccgtaccggtaccgtacggtaccgacggacccgtcggtaaccgtcccgtacccggtacccgtcgtaaccccg

SEQ ID NO: 74957 - DNA, 808 bp, Homo sapiens
  misc_feature: GYAE6OF01AJNTG.49.20.B09.1.454.CMB.1.raw
  modified_base (176)..(176): a, c, t, g, unknown or other
  misc_feature (176)..(176): n is a, c, g, or t
  modified_base (244)..(244): a, c, t, g, unknown or other
  misc_feature (244)..(244): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcacgtctctgcacaggctctgaggccctcctatgagctgacacagtcaccctggtntctgtgtcctcaggacagacggccaggatccacctgctcgtggcgatcgactagttcgaaccaaaaanattagtcggcctttaaccggtggtaacccaggtaccgaaggacggtcccacgggccccaccggtccccctggttccttgggttcgtaattttaacgtaaaagttcgttttacggaacggaccggtcccctacggaaccggggtaccccctaggacggccgtatttccgtacgtcggccctacccgaggtccgtacgacgggtactaaccgtacggtaccctaccgtttaccgaaccctacgtaccgtacggttacgggaaccggttccccggggaccaagggggtacccgggaaacgggtaccgggtacccttaacgggtaacgtttaaccgttttaaccgtccgggttacgaaccggttccccgacgaacggtaacgacggaccggtaggttcgggtaaccgttaaggtttacgttcgggttaccgttacggttccgggggacgggtaaccgggtaccgtaaccgggttccgtacccgggttacccggttcccggttaacggtcccgaaccggtaaccccgggacggtccccgttccccggtccccccggttggttacccccg

SEQ ID NO: 74958 - DNA, 576 bp, Homo sapiens
  misc_feature: GYAE6OF01BHS70.49.20.B09.1.454.CMB.1.raw
  modified_base (289)..(289): a, c, t, g, unknown or other
  misc_feature (289)..(289): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagacggccaggatcacctgctctggcgatgcattgaccaaaaacatatgcttactggtaccagcagacggccaggccaggcccctgtcttggtgatttanaaagtctttgagacggtcccttcgacgggacccctggacgcgtattctcgtggcctcagctcgacgggacaacacgtctaaccttgaacctatcgtaagtcggacgtccggacaggacggacgaggtctagactattactgtacacgtcgacagacgagaccgtagtcggtacgtagtttagttcggtacgttacggttcgggcgggtacggggtaccgtacggccttcgggaccgttccgtaggtcccgacgtcccgaaggccctcccggtccccgtcggtacccg

SEQ ID NO: 74959 - DNA, 609 bp, Homo sapiens
  misc_feature: GYAE6OF01BXYTF.49.20.B09.1.454.CMB.1.raw
  modified_base (186)..(186): a, c, t, g, unknown or other
  misc_feature (186)..(186): n is a, c, g, or t
  modified_base (287)..(287): a, c, t, g, unknown or other
  misc_feature (287)..(287): n is a, c, g, or t
  modified_base (295)..(295): a, c, t, g, unknown or other
  misc_feature (295)..(295): n is a, c, g, or t
  modified_base (367)..(367): a, c, t, g, unknown or other
  misc_feature (367)..(367): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggatcacctgctctggcgatgccattcgaccaaaaacatatgcttactggtaccagcagaggccaggccacggcccctgtcttggtntatttaanaaagtctttaggagacggccctcgacgggacccctgacgcgtattctcgtggctccgagctcgaaggacaanagtccacttgaccatcgagtggacgtccggacgaagggacggaacggacggctacgaacttattacgtgtctacgtccgacacgacgtagcaggtcggtactaggtttacgttggttacggttacggttcgggacgggtaacgggtaccgtacggtcgttaccggtacccggttccgttaacgggtcccaaccggtaccccgaacgggtcccgttcccggtcccccccgttcgggtaccccg

SEQ ID NO: 74960 - DNA, 768 bp, Homo sapiens
  misc_feature: GYAE6OF01A677D.49.20.B09.1.454.CMB.1.raw
  modified_base (429)..(429): a, c, t, g, unknown or other
  misc_feature (429)..(429): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgacgcctcctatgagctgacacagtccacccgttggtgtctgtgtcctcgaggacaggacggccgaggactccacctcgcttcgtaggccgagtgactacgtttacgaaaccctaaaaaactattacgtacgttcctttaaccgttaccgggtaaccaagaccgaagggaccggacccgaacgggccccgtaccggtcccccttggttcggtttagggtagtaagttagtaaacgtaaacggacgtacgtagggaacggaccggtccgtacggaacgggtaccttccgnggaccgtcgtttacgttccgtacgcggtccgtaccggtcgggtaaccggaccggggtaaaccgtaacgggtaccgtaaccgtttagtccgggtaaccgtacgttacggtacggttaaccgggacggtaaccgggacggtaacgggagggaacgggacgggtacggcgttaaccgtagtttaacgtttagttactaacgtaataaccgaacgtaacgtaactacgtttaagttacgttacttacgttacgttaccggtaacgtacgtcggacccgtaacgacggtaccgtaccgtccggttacgacacccggaccaccgaccccgacctgtaccgtcccg

SEQ ID NO: 74961 - DNA, 699 bp, Homo sapiens
  misc_feature: GYAE6OF01BA9XO.49.20.B09.1.454.CMB.1.raw
  modified_base (177)..(177): a, c, t, g, unknown or other
  misc_feature (177)..(177): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacagctctgaggcctctatgagctgacacagtcaccctggtgtctgtntcctcaggacagacggccaggatcacctgctcgtggcgatgactagttcgaaccaaaaactatagtcgctttaacgtaggtaccagacgagacggccacggacctccggccccttggttcgttacgggtattaactttaagtaaaacgttacgtttggaaggtaccggtaccccgtacggtaaccgggtacccccgttaggaacgtccgttaactttccgtacgtcggtaccctacgacggtcctacggaacgggtaaccaaagtacccgtacctacccgttagaaccctagtacgtaggtcggtacgtccggacgtaggacggacggtacggacgtacgtacttacgttactacgtacacgtacccgagtaacgacgacgtacgacgggtacgactttaggttacttcgggtacgttcgggttaccggacgggtacgggtacctaaccggtcgtacgtacccggtaccgttaggccgaaccggacccgtacggtaccctccccggtcccgtccggtacccg

SEQ ID NO: 74962 - DNA, 818 bp, Homo sapiens
  misc_feature: GYAE6OF01BL0F0.49.20.B09.1.454.CMB.1.raw
  modified_base (104)..(104): a, c, t, g, unknown or other
  misc_feature (104)..(104): n is a, c, g, or t
  modified_base (153)..(153): a, c, t, g, unknown or other
  misc_feature (153)..(153): n is a, c, g, or t
tcagagtcgagagacacgaccggtgctcgatttagtgtagtgtgaagggggctgtgggtccaggaggcagaactctgggtgtctcaccatggcctggatccctntacttctcccctcctcactctctgcaaaggctctgaggcctcctatganctgacacagtccaccctggtgtctgtcgtcctcgaggacagacggccaggacttccacctgcctgttggcgtatcgctattcggaacccaaaaagtatatcgtaccttacgtcggttaccagtcgaaggacggccgaaggcccgtacggccccgttgttacgtttgggttacgtaagttttaaacgtaaacggttaccgttttaggacggtaccggtaccccgtacggaccgggtacccccgtaggtaggaccgttacgttccgtccgttcgggtccttacccgaggtaccgtacggaaccggaaaccaacggtacggttaccctaaccgttttacgaccctacgttaccggtaagggttacgggtacccgtaacccgggccggtaaacgggaacgggtaccggtacgggacccggtttagtaaaccgtttacggtttaaccgtcgttacccggtaacggttaccccggacgtaacggaccgtcggacgtacggggttacggtcggttaaggtttaacctcggggttaccgttacgggttaccggggagggtaccgggtccgaaccggttcgtccgggtaacccgttccgggttaaccggaccgtaaccggcccgtaacgggtcccgtacccggtttcccccgggtacgttcccgttaccccggg

SEQ ID NO: 74963 - DNA, 527 bp, Homo sapiens
  misc_feature: GYAE6OF01DOFPE.49.20.B09.1.454.CMB.1.raw
  modified_base (290)..(290): a, c, t, g, unknown or other
  misc_feature (290)..(290): n is a, c, g, or t
  modified_base (360)..(360): a, c, t, g, unknown or other
  misc_feature (360)..(360): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgatttanaaaagactttgagacggccctcgaacgggacccctgacgcgtattctctggctccagctcgagggacaanacgtcacttgaccatcgagtggacgtccggacaggacggacgagctagactaattactgtacacgtccgcagacagacaggtcgactagtttatcgttcgtaagttcgggaggacgggactacggctggacccgtcgtacgcacgccaaggcctcgcccctggtacc

SEQ ID NO: 74964 - DNA, 715 bp, Homo sapiens
  misc_feature: GYAE6OF01BDPIU.49.20.B09.1.454.CMB.1.raw
  modified_base (178)..(178): a, c, t, g, unknown or other
  misc_feature (178)..(178): n is a, c, g, or t
tcagagtcgagagacacgaccggtgctcgatttagtgtagtgtgaagggggctgtgggtccaggaggcagaactctgggtgtctcaccatggcctggactccctctacttcctccccctcctcactctctgcacaggctctgacggcctcctatgagctgacacagtccaccctggtntctgtcgtcctcgaggacacggaccggccaggtactccaccgtgctccgtaggcgtatcggctaagttaccgaaaccaaaaactatagttcgtaccgttaacgttcggaaccagacgaggaccggaccgaacggccgaccggtccccttggttcgtttagggtacgttaatttaacgtaaagttcgtttaggaaccggtaccggtaccctacgggtaacccggtaccccgtaggtaccggtacgtacgtttcctccggtcggtccctaccgaacgaccgtacggaacggaacctaacgtacgtccctaaccgttaccgaactacgtcgtaggtacggtacccggtaccgggaacgtacgggaacgggacgtacggtacgtacgtaactacgttaacgtgtaccgacgccgagacgacgtacgaggtacgagtaccttagggttactggtacggttacggccgggtaggcgtaccggtcgccgtacggtcctacgaggtccgaccgtacccgagtacccgtcccaccgttcggtaccc

SEQ ID NO: 74965 - DNA, 824 bp, Homo sapiens
  misc_feature: GYAE6OF01C22EZ.49.20.B09.1.454.CMB.1.raw
  modified_base (178)..(178): a, c, t, g, unknown or other
  misc_feature (178)..(178): n is a, c, g, or t
tcagagtcgagagacacgaccggtgctcgatttagtgtagtgtgaagggggctggtgggtccaggaggcagaactctgggtgtctcaccatggcctggatccctctacttctccccctcctcactctctgcacaggctctggaggcctcctatgagctagacacagtccaccctggtntctgtcgtcctcgaggacaggaccggccaggactccacctgcctagtggacgtaatcgctaagttcggaaccaaaaaactattagtcgtacctttacgtacggtaacccagtacaaggaacggcccgaaggtaccccgacggtccccccttggtttacggtttacggtagttaatttttaaacgtaaaacggttacgtttaggaacggtaaccggtccccgtacggaaccgggtacccccgtaggtacggacgttacttccgtcgttcgggtcccttaccgacgtccgtacggaacgggtaacaaccgtcgtacccgtaccgttaccggtaccaacgttaccgtacgggtacgggtacccggtacccggaccggtaacgggaaccgggtaacgggtacggtaccgtacggttaactttacgtttaccgtcgtacccgtaccggtcgacgtaacgtcgaacggtaccgtacggtggtaccgttaacgtttagttaccgggtttacgtaccgggttcgggtaccgggtaaccgggttacgaacgggtcccgttacgggtaaccccggtttccgggtaacggtccccggaacccggtaacccggtaaccggtcccgttaccccggtcccccggttcgtttaacccccgg

SEQ ID NO: 74966 - DNA, 771 bp, Homo sapiens
  misc_feature: GYAE6OF01C5ACJ.49.20.B09.1.454.CMB.1.raw
  modified_base (174)..(174): a, c, t, g, unknown or other
  misc_feature (174)..(174): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtcaccctggtntctgtgtcctgaggacagacggccaggactccaccgtgctcgtggcgtatcgctaagtttcgaacccaaaaactattaatcgtacttaaccgtggtaccagacaggacgccacggccgacggtcccctgttcttaggtgtaactttaagtaaacgtacgtttggaacgtaccggtcccgtaccgacgggtacccccgtggtacgtccgtactttccgtaccggttcggtccctaccgacgtcgtaccgaagggaaccaacgtacgtacctaccgttacgacctacgtcgtaggtaggtacgtaccggacgaaggacggacgacggtctaggacttattacgtcgtacgacggtaccgacaacggtacgacggacgtaggtacggtacttacggtttacgttaccggtttcgttaacgggttcccggggtaacggggtacccgggtaaaccgttacccgggttaacccgttacccgggtaacccgggtttaccccggttaaccggggttaccccgaaacccgggtacccccggttaaaccgggttcccccgtttacccccgggtaaccccccccgggttccgggtttaaacccccccg

SEQ ID NO: 74967 - DNA, 879 bp, Homo sapiens
  misc_feature: GYAE6OF01AB3JT.49.20.B09.1.454.CMB.1.raw
tcagagtcgagagacacgaccggtgctcgatttagtgtagtgtgaagggggtcgtggtgggtccaggaggcagaacctcgtgggtgtctcgaccagtggcctggactccctcgtacttctcccctctcactctctgcacaggctctgaggcctcctagtgagctgacacagtcacctcggtgtctgtgtcctgagacagacggccaggatcacctgctcgtaggcgatcgcattcgaaccaaaaactatatcgaccttacgacgggtaaccagcgaggacggccacgggacccgaacggtcccccttgttaccgtttagggtagttaaactttaagtaaaacgtaccgttttaggaaacgggtcgggtacccgttacggaccggggtaacccccgttggaacggtaccgtacgtttcctaccggttgggacccttacccgaacggtccgttaaccggacgtaaccggaaaccaaccgtaacggttacccgtaaccggtttacgacccgtaagtaccggtagggtaccgggttaccgggtaccgggggactaaacgggaccgggaacggtaacgggttccgtaacggttaaccgttaaactttccgggtactttacccgtaacggtacctaacgttaaccgaacggtaaccggtagggttaaccgggttacgggtaccctttaaccggtttacgttacgggttaacccggttacgggtttacccgggggaaccggggttaacccggggtaaacccgttaaacgggttcccgtaaacccggggttcccgtttaaccccgggttacgggttaaccccggaacccggttacccccggaaacggttcccccgttaacccccgggtccccccggtttaacccggg

SEQ ID NO: 74968 - DNA, 702 bp, Homo sapiens
  misc_feature: GYAE6OF01EPNX4.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctggtgtctgtcgtcctcaggacagaccggccaggatccacctggggctcgtggcatcgctattcgaaccaaaactaatatcgtacttacgtcggtaaccagcaaggacggccgacggccgaccggtcccctggttcgttggtacgtaattttaagtaaacggtcgtttacggaacggaccggtaccctacggaccgggtaccctaggtacgtacgtacttccgtcgtcggacctaccgtacgtaccgtacggaacgggaaccaactacgtacctaccgttaccgactatcgtaacggtcggaccggtccggacgtaagggacgggacgacggtacgtacgtaaccttagttacgtacgtccgtaacggtcgacacgacgagaccgtaggtcgtagttacgttctggtaccgtgggttaccgggacggtacgggtacccttcggtccgttacggtacccccggttcgtacgggtaacccgacccggtacccggaaccggtcccccttccccgggtccccgttccgggttacccc

SEQ ID NO: 74969 - DNA, 722 bp, Homo sapiens
  misc_feature: GYAE6OF01CRORQ.49.20.B09.1.454.CMB.1.raw
  modified_base (226)..(226): a, c, t, g, unknown or other
  misc_feature (226)..(226): n is a, c, g, or t
tcagagtcgagagacacgaccggtgctcgatttagtgtagtgtgaagggggctggtgggtccaggaggcagaactctgggtgtctcaccatggcctggatccctctacttcctccccctctcactctctgcacgaggctctgacggcctctatggagctgacacacgtccacccgtcggtgtctggtctcctacgaggcaaggcggccaggactcacctgccttgnggacatgactagttacgaaaccaaaaatatatcgtactttaacgtaggaccagacgaaggacggacctacgggcctacggcccttggttcgttaggttgtaagtttattaaaggtctttaggacggtaccgtcctacggaccgggtaccctgacgtacgtatttccgtcgtggaccttcggaactccgtacggaacggtaaccgtaaacgtcgtaccgtaaccgttacgaaccctaagttcgaacgggttacgggaccgggttcccggggaaccgaaaggggacggaacgggtaaccggttaccgtaaggttaaccttaacggttttaaaccgttcggacggttaacccggtcccgacgaaaccgcggtaagacgtggacggttacgtagttacgtcggtacgttggttaccggaacgggtcgaccgtacggtcgtaccggtactcgttaacggcgaccggtacccgacggtccgttaccccgccgtaccggtacc

SEQ ID NO: 74970 - DNA, 653 bp, Homo sapiens
  misc_feature: GYAE6OF01CNUEE.49.20.B09.1.454.CMB.1.raw
  modified_base (288)..(288): a, c, t, g, unknown or other
  misc_feature (288)..(288): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggactcacctgctctggcgatgctattcgaccaaaacatatgtcttactggtaccagcagacgccaggccacggcccctgtcgttggtntaatttataaagtctttgagacgccctcgacggaccctgacgcgtattctcgtggcctaccgagtccgtacgaacgggaacctaacgacgttactacccgttacggacctaatccgtaaggtacgggacgtcccgggaccgaagggaacgggtacggacggtaccgttacgtaaccgtttaacttccggtcgttaccgacgttaccggactaacggacgtacgaccgtaagggtcggacttaggttatcggttcgtaacggttcgggacgggacggttacgaccggtcgtaccggtacccggttccgtagggtacccaccggtaccccgtaagggtcccttccccggaccccgttcgggtacccc

SEQ ID NO: 74971 - DNA, 700 bp, Homo sapiens
  misc_feature: GYAE6OF01CRL9I.49.20.B09.1.454.CMB.1.raw
  modified_base (240)..(240): a, c, t, g, unknown or other
  misc_feature (240)..(240): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctcggtgtctggtcgtcctcaggacagacggccaggatcactgctcgtggcatgcctattcgaaccaaaaanatatgtactttacgtaggtaccagcgaggacggaccgacggcccacggtcccccgttggttccgtttgggttagttaacttttaagtaaaacggttacctttggaacggtacggccccgttacggacgggtaccccgtggaacgtcgtacttcctcgtacggtcctaccgtacgtcgtacgacggaacaaccgtacgtacctacgttaccgactacttacgagtacggacggtaccggcgaaggacggacggacgtacgtacgtacttaacgttagtacgtcgtacgtccgacaacgacaacggtactaggtacgggtattacggttagtcggttacgttacgggttccgggacggggtacgtacgtaacggtaccgttagtaccccggttcgtaacgggttcccgaacggtaccccggtaaggccccgttaaccgggtccccccgttagggttaccccg

SEQ ID NO: 74972 - DNA, 918 bp, Homo sapiens
  misc_feature: GYAE6OF01ARIO8.49.20.B09.1.454.CMB.1.raw
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtcctgtcgtcctnaggacnggaccgcaggactccactgctcgtggcatgacctattaccgaacctaaaaacattactacgtaccttacgtacggttaaccacggacgtaacggacggacccgaccggacccggaccggtacccccgttggttccggtttagggttaacgttaattttaaagtaaacggttacgtttaggaccggtaccggtacccctacggaacccgggtaccccgtaggaccgtccgttaagtttccctacggttcggtacccgtaccgtacggtccgtaacggaaccgggtaaacctaaccgttaccggtaccctaaaccgttacgaaacccgttacggtaaccggtacggggttaaccgggtacccggtacccgggaacgtaacgggggtaaacccgggtacgggtaacggtcgtttaacccgggtaaactttacccgggttttagtaccggtacccggtaaacgggtcccgtaaggtaaaccgaacccgggtagaacccggttaggggttacgtaaccggtttaagtttaccgggttgggttaaccgttaacgggggttaacccggggaggggggtaacccttaaccgggtaccggttaccgggttaaacccggtttaacccccgggtacgggtttaaacccgggacccgaaaccccggggtacccccgttaaaccggggtcccccttttaccccccggccccccggggttttttaacccggtaaccccg

SEQ ID NO: 74973 - DNA, 652 bp, Homo sapiens
  misc_feature: GYAE6OF01CWOGE.49.20.B09.1.454.CMB.1.raw
  modified_base (155)..(155): a, c, t, g, unknown or other
  misc_feature (155)..(155): n is a, c, g, or t
  modified_base (373)..(373): a, c, t, g, unknown or other
  misc_feature (373)..(373): n is a, c, g, or t
  modified_base (510)..(510): a, c, t, g, unknown or other
  misc_feature (510)..(510): n is a, c, g, or t
  modified_base (525)..(525): a, c, t, g, unknown or other
  misc_feature (525)..(525): n is a, c, g, or t
  modified_base (612)..(612): a, c, t, g, unknown or other
  misc_feature (612)..(612): n is a, c, g, or t
tcagagtcgagagacacgaccggtgctcgatttagtgtagtgtgaagggggctgtgggtccaggaggcagaactctgggtgtctcaccatggcctggactccctctacttcctcccctcctcactctctcgcacaggctctagacggcctcctangagctagacacacgtcctaccgtcggtgtctagtcgtcctacgaggaccaggacggaccaggactcacctgctcgcggacgatcgactactacgaaaccaaaaacatatcgtacttacgtacgaccagacgaggacgcgacgccacggccttgtcgtagtattaagttaagaacgttcgtagacggtcgaccgtacgacggtacctaggacgtacgtnttccgcgtcgcctacgacgtccgacggaacggaactacgctacctacgtacaactactacggaggtacggccgtaccgacgaggacggtacggacgacttaagacgtttaatcgtacgtacgctaccgagaacacgnggactagggtacgtnttaaggttcttagggtacgttacggaacgggggtacgaacgttcgacggtcgtaacccggtccggtaaacgtacgggaccgaacccnccgggtaacccgttcccgccccggttaccgtcggttaccc

SEQ ID NO: 74974 - DNA, 679 bp, Homo sapiens
  misc_feature: GYAE6OF01EMOXJ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggatcacctgctctggcgatgcattcgaccaaaaacatatcgtacttacgtggtaccagcgagacggccacggccacggcccctgtcgttggtagtatttaagtaaagtactttaggagacggccctcgacggtacccctggacgctacttctacgtcggcctaccgacgccgtacgaagggtaaccaacgtacgtaccctaccgttacgaacctacgtacgtaggtacgggtaccggtcccgggtaccgaagggaacgggaacggacggtcgtaacggtacttaagtttacgtacggttacctaccggtccgacgtaacgaacgacgacgagggtcggtaccgttaggtttacgttcggttaccggttacggttaccggggacgggtaacggtaccgttaccggcgttacggtacccggttacgtaccggtacgaccgtacccgtacggtcccgtcccggtccccgttcggtacccg

SEQ ID NO: 74975 - DNA, 594 bp, Homo sapiens
  misc_feature: GYAE6OF01DEBZK.49.20.B09.1.454.CMB.1.raw
  modified_base (246)..(246): a, c, t, g, unknown or other
  misc_feature (246)..(246): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (464)..(464): a, c, t, g, unknown or other
  misc_feature (464)..(464): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtgtctgtcgtcctcgaggacaggaccggccgaggactccacctgctcgtggcatgctatcgaccaaaaacnttatgtcttacgtggaccagcagacggccacggccacggcccctggtcttggtatatttaanaagtnttgaggtcgtccctgacggccctgagcgtactctcgtcgctccgagtcgtacgacggtacaagtcgtcctacgttcgacctatacgaggtcggacgtccggtacgaggaggacggacggtcgtagtactagtactacgtcgtacgtccganacgacgagtccgaggtcgtacgtagttacgtcggttacgtacggttcggacgggtacggtaccgtaccggtcgtacgtacccggttcgtacgtccgacgtccggaacgtccgtcccgtccccgtgtcccg

SEQ ID NO: 74976 - DNA, 691 bp, Homo sapiens
  misc_feature: GYAE6OF01ENT2W.49.20.B09.1.454.CMB.1.raw
  modified_base (239)..(239): a, c, t, g, unknown or other
  misc_feature (239)..(239): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtgtctgtgtcctcgaggacaggacgccaggactcacctgctcgtggcatgactatcgaccaaaaanatatcgtacttacgtacggtaccagcgaggacgccgacggtccgacggtccccgttagttcgttagggttaggttaacttttaaagtaaaacggttacgtttggaacgtaccggcccttacggacgggaccccgttgaacgtcgtactttccgtctcgggtactccgaacgccgtacggaagggaaccaacgtacggtacctaccttcggaacctacgttacgtacggtacggtaccggtaccggaccgtaacgggacgggtaaccgagggtacctaggtaccgttaagtttaccgtagtccgtacgtccgaacgaacgacgtaacgacgtaggtcggaattagttcgttacggttcgtaggttaccggagggtacggaccttacggctacgggtacctccggtacgtcgaacccggtcccgtacggaccctccggtccccgtgggtacccc

SEQ ID NO: 74977 - DNA, 781 bp, Homo sapiens
  misc_feature: GYAE6OF01BKBUS.49.20.B09.1.454.CMB.1.raw
tcagagtcgagagacacgaccggtgctcgatttagtgtagtgtgaagggggctgtggggtccaggaggcagaactctgggtgtctcaccatggcctggatcctctacttctcccctcctcactctctgcacaggctctgaggcctctatgagctgacacagtcacccgtggtgtctgtcgtcctcgaggacacggacggccgaggactccaccgtgtcgttcgtgggacgtatcgactaagttacgaaacctaaaaataagttagtcgtacttacgtacggtaaccgagacgaggacggaccgacggccgtacggtccccgttggttacgtttagggtacttaacgttttaaacgtaaaacggttacggtttacgggaacggtaccgggtcccgtaaccgaaccggggtacccctaggacggtaccgttacgttccgtcgttacgggtacctaaccgtcggtaccctacggaaacggtaacctaaacgtaccgtaccgtaccgttacgacccgtaagtacgtacgggtacggtaacccgtaccggaaacggtaagggtaacggaacgggtacggtacgtacggttaacttacttacgtcgtacgaccgtacgataaccgaacgcgtacgtacgggtacgtacgttaacggttcgtacggttacgttaacgggtcggggacggttacgtaaccggttacgtaccggttacgtaaccgggtcgtaccggaccgtaccggaaccgttcggaacccgttcccgttaacccggttccgtaaccccg

SEQ ID NO: 74978 - DNA, 736 bp, Homo sapiens
  misc_feature: GYAE6OF01C259K.49.20.B09.1.454.CMB.1.raw
  modified_base (81)..(81): a, c, t, g, unknown or other
  misc_feature (81)..(81): n is a, c, g, or t
  modified_base (152)..(152): a, c, t, g, unknown or other
  misc_feature (152)..(152): n is a, c, g, or t
  modified_base (596)..(596): a, c, t, g, unknown or other
  misc_feature (596)..(596): n is a, c, g, or t
tcagagtcgagagacacgaccggtgctcgatttagtgtagtgtgaagggggctgtgggtccaggaggcagaactctgggtntctcaccatggcctggatccctctacttcctcccctctcactctctgcacgagctgtggacgtcctactangacgcacgacacacgtccacccgtgtctctgtcgtcctagacgacaacggaccgacgtagtactaccgaccgtgtcgttcggacggaactaggttcgacttaaacgtaaccgaaaaaccaaaagtattcgtacttaccgttacgtacggacagacgaaggacgaccgacgacgaccgtccttgttacggtagtacttaattaaagtaacttcgttagaacgtaccgtacccgtaacgaacccgggtacctaggacggtaccttacgtccgtacggtccgtacgtaaccgcgtacggacgaaacggaacctaacgtcgtaccctacggtaacctacgtagtacgtacggttacggaccggaaccggacgaaagggcgaacggtacgtaacgtttaacgtaacgttacgtacgttacgacgtacggtaccaacgaacgttacgaancggtagtacgtacgttaatcgttacgttacgtacgggtccgggaacgtacgtaccgtaccgtcggtaacctaccggttacggaacttacccggaacgtaccgtaacccggtccctaaccccgggtccctagggttacccc

SEQ ID NO: 74979 - DNA, 531 bp, Homo sapiens
  misc_feature: GYAE6OF01AU6AM.49.20.B09.1.454.CMB.1.raw
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (444)..(444): a, c, t, g, unknown or other
  misc_feature (444)..(444): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttataaagactttgagaggccctcgacgggacccctgagcgtattctctggctccagctcgagggacaacgntccaccttgacctatcgagtggagtccggcaggaggacgnggctgactattacngtcacgtcgnagacngctaggtcganagtttntcggtcgtagttcgggcggtaggacctacggcgtgaccggtcctagggtccacggtccccgaaggtcctccggccccctgggtaccc

SEQ ID NO: 74980 - DNA, 580 bp, Homo sapiens
  misc_feature: GYAE6OF01D0OPT.49.20.B09.1.454.CMB.1.raw
  modified_base (235)..(235): a, c, t, g, unknown or other
  misc_feature (235)..(235): n is a, c, g, or t
  modified_base (365)..(365): a, c, t, g, unknown or other
  misc_feature (365)..(365): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcacaggctctgaggcctcctatgagctgacacagtcaccctcggtgtctgtgtcctcaggacaggacggccaggatcacctgctctggcgatgcattgaccaaaaanatatgcttactggtaccagcagaggccaggccagcccctgtcgttggtgatttataaagtctttggagcgggtccctgacgggtacccctgacgcgtattctcgtggctcgagctacgaagggacaacgngtcacttgaccatcagtggacgtccggctaaggaggacgaggctcgactattactgtcgtacgtccgcagacaacgcgaagtcggtactaggtttagtcgttaccgttagttccgggtcgggtaacgggaccttaacggcgttacggacccggttaccgtaacgggtcgtaaccggcccgtaaacggccctacccggtcccccgtggtaaccccg

SEQ ID NO: 74981 - DNA, 641 bp, Homo sapiens
  misc_feature: GYAE6OF01AX7OG.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaacatatgcttactggtaccagcaggacggccaggccacggccccctgtcgttggtgtatttaagtaaagtactttggaggacggtccctacgacgggacccctagagcgtattctcgtcggcctcgacgctacgaagggaccaacgtacggtacctaccgttcgacctatcgaggtcggtacgtccggaccgaggacggacggaggcgtacgaaccttagttacgtcgttacgtaaccggtcccgactaacggacacggaccgtagggtacggtacttaaggttacgttggttacggttacggttccgggacgggtacggtaaccgtacggtcgttaccggtacccggttcgtacgggtaccaccggtacccgtaacgggtcccttccccggcccccgtcgggttacccc

SEQ ID NO: 74982 - DNA, 699 bp, Homo sapiens
  misc_feature: GYAE6OF01EN2MO.49.20.B09.1.454.CMB.1.raw
tcagagtcgagagacacgaccggtgctcgatttagtgtagtgtgaagggggctgtgggtccaggaggcagaactctgggtgtctcaacatggcctggactcctctacttctcccctctcactctctgcacaggctctgacggccttcctatgagctacgacacgtagtccacccgttcggtcgtctcgttcgtcctagacggacaggaccggccgaggactaccaccgttgcctcgtgggacgatcgctacgttcgaaaccaaaatatacgtcgtaccttacgacggtaccagcgaaggacggtacgacggccgacggtccttggttcgttaggtagttaaatttaaagtaacgttacgtttacggaacggtaccggtcccgtacggaacccgggtacccgtagaacggtaccgttactttccgtacgtcgtacctcgacggtcctacggaacggaaacacgtacgttactaccgttaacgactacgttacgaggtacggaccgtccggacgagggaacgcgagtacgtacgtacttacttacgtcgtaccgtacggtaccgagaacgacggacgcgtaacggtcgttaagttacggttactcgggttaccgttcgggtacgggacggtacggtactcggtcgtacggtaccgtcgtaccggtacaccgttcggacgtccggtccccgtcgcggttacc

SEQ ID NO: 74983 - DNA, 825 bp, Homo sapiens
  misc_feature: GYAE6OF01DPMBV.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctcgtgaggcctctatgagctgacacagtccaccctggtgtctgtcgtcctgaggacaggaccggccgaaggctcctaccgtgcctcgtgggcatgctagttacgaacctaaaaactaattacgtgtaccgtttacgtacgggtaacccgaaggaccgaacggacggacccgaacgggccccgtaccgggtcccccgttggtttccggtttagggtaacgttaaacttttaaagttaaaacggttacgttttacgggaacggtaccggtccccgttacggaaccgggtacccctaggacggtcgtactttcgtacgtcggtcctaccgagtaccgtacggaaacgggacctaaaccgtcgttacccgtaccgttacaaccgtacgttacggtacggttacggccgggttaaccggaccggtaagggacgggacgtaccggggtaacttcggtaacctttagttaccggttcgtaccgtaaccgggtcccgaacgtaaccgggaaccgaaggtaccgtacgggttagtaccggttaagtttacggttacggttacggttaacgggttaccgggaacgggtaccggtaaccggtaaccgttccggtaccggtaacccggttccggtaccggtacgtaacccgggtacccgtaaccgggtccctcccgggttacccccgttgggtaaccccg

SEQ ID NO: 74984 - DNA, 722 bp, Homo sapiens
  misc_feature: GYAE6OF01CRL1Y.49.20.B09.1.454.CMB.1.raw
tcagagtcgagagacacgaccggtgctcgatttagtgtagtgtgaaggggctgtgggtccaggaggcagaactctgggtgtctcaccatggcctggatccctctacttcctccccctcctcactctctgcacaggctctgaggccctcctatgagctgacacagtccaccctcggtgtctgtgtcctcgaggacaggacggccaggactcacctgctctggcatcgctattacgaccaaaatatatgtctttaaccgtcggttaaccacgacgaaggacggaccgacggacccgaccggtcccccttggttccgtttaggggtacgttaaagttttaaacgttaaaacgttaccggtttaggtaaccggtaacgggtcccccgttaaccggtaacccgggggtaccccctgggaaccggtaccgttacgtttccgtccgtacgggtcctacccggagtacccgtcgaacgggtaaccaacgtcggtacctacccttggaacctgtacgtaggtcgggtacggtacccggacgaagggacggaccggtaaggactacggttactaacggttcgtcgttacgacggtcccacgacgacgagacgaggtcgacgttgttagtcgtacgttaggtcgggacggtaggtacctacggtactcggtaaccggttcgtacggacgttaccgacccggtacggtccctacccggccccgttacgggtccc

SEQ ID NO: 74985 - DNA, 930 bp, Homo sapiens
  misc_feature: GYAE6OF01CEEI9.49.20.B09.1.454.CMB.1.raw
  modified_base (209)..(209): a, c, t, g, unknown or other
  misc_feature (209)..(209): n is a, c, g, or t
  modified_base (687)..(687): a, c, t, g, unknown or other
  misc_feature (687)..(687): n is a, c, g, or t
tcagagtcgagagacacgaccggtgctcgatttagtgtagtgtgaagggggctgtgggtccaggaggcagaactctgggtgtctcaccatggcctggactccctctacttcctcccctcctcactctctgcacaggctctgacggcctcctatgagctgacacagtccacccgtggtgtctgtcgtcctgaggacaggcggccaggacnccacctgcttcgtggacgtagtgactaagtttacgaacccaaaaaataattacgtgttaccttaacggttaggtaacccaggacgaaggacgggacccgaaccggggacccgtacccgggtcccccgtttggttccggttttagggtaacgtttaaagtttttaaaacgtaaaacggtttaccgttttagggaaaccgggtaccccggtaccccgttaccggaaacccggggtacccccgttaggaccgggttaccgttaacgttttccgtaccgttccggccttacccggacgtcctaacgggaaacgggaacctaaaacgtcgtacccgtaacgtttccggaaacctaaggttcggtaacgggtaccgggggtaaccggtaccccgggacggaaacgggaacggggtaaccggacgggttacgttaacgtaacctttaacggtttaaccgtcggttaaccgacccggtaaccccgngaaaaccggtaaccgagggtaccggaacgggttcgggtaaccgtttaacggttttacgggttaccgtttacgggttaaccggtcccggggggtaacgggaaaccggggttaccgtaaccggttaccggttacccgggtaacccccggtttccgttaaacggggtacccgtaaaccggggtaacccccggttaacggtacccccgggtttcccccggtcccccccgggtttcgggttaaccccc

SEQ ID NO: 74986 - DNA, 541 bp, Homo sapiens
  misc_feature: GYAE6OF01CYDZK.49.20.B09.1.454.CMB.1.raw
  modified_base (237)..(237): a, c, t, g, unknown or other
  misc_feature (237)..(237): n is a, c, g, or t
  modified_base (241)..(241): a, c, t, g, unknown or other
  misc_feature (241)..(241): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcgatgcattcgaccaaaaanatangtacttacgtggtaccagcagacgccaggccaggcccctgtcttggtntattanaagtctttagagaggcctgacgggacccctgacgtcgtattcctcgtggccttccgagtcctacgacgaccgaaccactacgtccgacgttcgaccatcgagtggacgtccgggcagggaggacgaggtcgtagacttagttacgtgtactagtacatacagaacgtagtagtgctacgttgtgtcgtagtccggaggagacgagctacggtacgtcgtgcacgacccgagccgtccgtcccgtcg

SEQ ID NO: 74987 - DNA, 823 bp, Homo sapiens
  misc_feature: GYAE6OF01BB4QX.49.20.B09.1.454.CMB.1.raw
tcagagtcgagagacacgaccggtgctcgatttagtgtagtgtgaaggggctgtgggtccaggaggcagaactctgggcgtctcaccatggcctggatccctctacttcctccccctcctcactctctgcacaggctctgaggccctcctatgagctgacacagtccacccgtggtgtctgtcgtcctcgaggaccagaccggccaggtactccgactgccgtcgtgggacgatgctattcgaacccaaaaatataatgtacttaccgtgtaccagcaacggacggccgacgccgaccggtccccgtgttacgttggtactaattttaagaaaacgttcgtttagacgtacgtcccgtacgaccggtacccctaggtaacgtcgtacgttccgtacgtacggccctaccgacgtacctacggaaacggtaccaaccgtacgtacccgtaacccgttacgaaccgtacgttaccgaacggttaccgggacggttacccgggaaccgggtaaacgggtaacgggaaacggtacgggtaccgttaagggttaacctttaacgtttacggtaccgtaaccggttacgggtcccgaacggtaaccgtaccgtaacgtacggttaacggtaccgggtacgtttaaagttggttaaccccggtttgggttaaccggtcccgggggtaaggttaacccgggggtaacccttaccggggtacccgttaccggggttacccccggtttaaggttacccggtaccggttaaaccccggacccggtaacgggttccccccggtaccccgtcccccgggttaggttaacccccccg

SEQ ID NO: 74988 - DNA, 841 bp, Homo sapiens
  misc_feature: GYAE6OF01AFV7J.49.20.B09.1.454.CMB.1.raw
  modified_base (130)..(130): a, c, t, g, unknown or other
  misc_feature (130)..(130): n is a, c, g, or t
  modified_base (177)..(177): a, c, t, g, unknown or other
  misc_feature (177)..(177): n is a, c, g, or t
  modified_base (659)..(659): a, c, t, g, unknown or other
  misc_feature (659)..(659): n is a, c, g, or t
tcagagtcgagagacacgaccggtgctcgatttagtgtagtgtgaagggggctgttggtccaggaggcagaactctgggtgtctcaccatggcctggactccctctacttcctccccctcctcactctcngcacaggctctggaggcctctatgagctgacacagtccaccctggtntctgtctaccgtaaggaccgaggacggaccaaggactccacccgtggccttcgtgggcgattcgactaacttacgaaccccaaaaaataattatcggttaccgtttaaccgttacgggtaaccacggaccgaaggaacgggacccgaccgggaccccgtacccgggtccccctttggttccgtttaggggttagttaacgtttttaaagtaaaaccggttaacgttttacggaaccggtaccggtccccgtacgggtacccgggtacccccgtagggtaccggtacgttacttccgtaccggtcggtacctaccgacgtacgtaaccggacgggaaacctacgtaacgtacctaaccgttacgaaccgtactacggacgggtcgggacccggtacccgggtacggaacgggtacgggacgtagggtaccttaacggtaacttaccgttacgtcgttaccgtaccggccgtaacgagacccgngtaaccgtaggtcggtagttacgtttacggtcggtttacggtacggggttacgggtaccggggtaacgggtacgtacccggtaccggtcccgttaccgggttaaccggtccgggtaccgacccggtacccggtaaccggtaccccggtaccccgttcccccggtcggttcccgttaccccgg

SEQ ID NO: 74989 - DNA, 808 bp, Homo sapiens
  misc_feature: GYAE6OF01EE05D.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctctatgagctgacacagtcaccctggtgtctgtgtcctgaggacaggacggccaggactccacctgctcgtggacgatgactagttacgaaccaaaaactaatactgtaccttacgtacggtaaccagacgacggacggaccgacggccccgtacggtccccgttagttcgtttaggtacgttaagttttaaagttaaacgttacgtttaggaggtacccgggtccccgtacggaacccggggtaccccttagggacgtaccgttacgtttccggtccgtcgggtcccacccgtacggtaccgttacccggaaagggtaacccaacgttaacccgtacccgtaaaccgtttccggaaacctagttaccgtaacgggttaccgggtaccggtacccgggtaccggaaacgggtaacgggaaccgggtacggtacgttacgtaacgttaacgtttaccgtgtaccgtacgttacccgacgaacggacgtacgaggtacgtcgggtacgttagttagttaccggttacggttacggttacggggaccgggtaacgtaccggttaccgtaccggttaccggtacccggttaccggttaccggtaccggtaaacccggtaccggtaaaccggccccggttacccggttcccccgtcgggttaccccg

SEQ ID NO: 74990 - DNA, 805 bp, Homo sapiens
  misc_feature: GYAE6OF01DGXSH.49.20.B09.1.454.CMB.1.raw
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctctatgagctgacacagtccaccgtggtgtctgtcgtctacgaggacaggaccggcaggactaccnctgctgtggctangtactagtaccgaaaccaaaatatgtacgtcttacgtacggtacaggacgaggacggaccgacggccgtaccggtcccttggtttcgtttaggtaacgttaagttttaaaaggtaacgttcgtttacggaaccggtaccggtccctaacgggaacccggtaccgtaggacgtacgttacgttaccgtcggtccggtaccctacggtacgtaccggtacgggaaccgtaacgaacgtaccgtacctaaccgtacgacctacggtacgacgggttacggacccggtacccggacggtaaggaccggtaaacggtcccggtagttaacggttaccctttaaggtttaccgtaccggtacgtacccggacccgtaacgacgtaccgaacggtaacggtcgggttacgtttaacggtttaggttaccggttacggttacgggtttaaccgggccgggggaacgggttaccggtaacccgttccggaccgtttaacccgggtacccttacccgggtacgacccgggtaacccccggaaccgtacccggttaccccgttcccccggaccggtttcccgtaaaccccgg

SEQ ID NO: 74991 - DNA, 703 bp, Homo sapiens
  misc_feature: GYAE6OF01EK016.49.20.B09.1.454.CMB.1.raw
  modified_base (176)..(176): a, c, t, g, unknown or other
  misc_feature (176)..(176): n is a, c, g, or t
  modified_base (188)..(188): a, c, t, g, unknown or other
  misc_feature (188)..(188): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctggaggcctcctatgagctgacacagtccaccctggtntctgtgtcctanaggacagacggcaggactccacctgctctggcatgacattacgaccaaaaacatactgtcttactcggtaccagacagacgccacggccacggtcccctgttcgttggtagtaatttaaagtaaacggtactttagaacggaccggtccctacggaaccgggaccccttaggacggtaccgtacgtttccgttccgttacgggccttacccgagtaccgtacgaaacggggaactaaacccgtagtaccctaaccgttacgaacctaacgtacgtaacggtcgggtaaccggtcccggtaacgaacgggtacggaaccgggacggtacgtaccgtaacgttaacgttacgtacggtaccgacgtacccgacgaacggacaacgcgtaggtacggtacttaggttactggtacgttaggtaccgggacggtaacggcgttacgccgttacggacccgttacggtacgggtaccaacggtcccgaacggtcccgtcccggttccccgtcggtacccc

SEQ ID NO: 74992 - DNA, 750 bp, Homo sapiens
  misc_feature: GYAE6OF01BJXC8.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtcctgtctcagagacgacggaccgacgagtactacctacgtcgtcttcggcggacgtagtcgacttaagtaccgaaaaaccctaaaaataattacgtcttaccgtttacggtaccgaacgacgacgaaggaccgaccggaccgaccggacccgtccgttcgttcggttggtaagtttaatttaaaagtaacgtttacgttaacggacggtacccgtcccgtaacgggaccccggtaccgtaggaccgtcttacgttccgtcggccgtcctacgcgtaccgtaacgggaaccgaaccaacgtacctacccttacgtacaacctacgacggtaggtaccggtacccggaccgaacggaagggacggacggacgtctaacgtactttagttcgtacgtacgtccgtcgaagaacgacgacgacggtacggtacgtaacgtttagttcgttacgggttacgttacggggtaccgggagggtaaccggtaccgtccgggtcgtacccgggttaccgttacgggtaccgaccgtacccggtaacccggtcggtaccccctcccggtcccggttcggtacccc

SEQ ID NO: 74993 - DNA, 531 bp, Homo sapiens
  misc_feature: GYAE6OF01B53XB.49.20.B09.1.454.CMB.1.raw
  modified_base (235)..(235): a, c, t, g, unknown or other
  misc_feature (235)..(235): n is a, c, g, or t
  modified_base (362)..(362): a, c, t, g, unknown or other
  misc_feature (362)..(362): n is a, c, g, or t
  modified_base (415)..(415): a, c, t, g, unknown or other
  misc_feature (415)..(415): n is a, c, g, or t
  modified_base (425)..(425): a, c, t, g, unknown or other
  misc_feature (425)..(425): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattcgaccaaaaanatatgcttactggtaccagcagaggccaggccacggcccctgtcttggtgtatttataaagctttgagaggccctcgacgggcccctggacgtcgattcctcgtggctccagcctcgagggacaacngtcaccttgaccatcagtggacgtccgacaggaggacgaggctgactattacngtcagtccgnagacagcagtgactagttatgtacgtgttcggcggtaggtacctacggtcctggacccgttcgtacggtccacggtacccgaaggccgtccgccccgtcggtaccc

SEQ ID NO: 74994 - DNA, 797 bp, Homo sapiens
  misc_feature: GYAE6OF01C3VUK.49.20.B09.1.454.CMB.1.raw
  modified_base (163)..(163): a, c, t, g, unknown or other
  misc_feature (163)..(163): n is a, c, g, or t
  modified_base (599)..(599): a, c, t, g, unknown or other
  misc_feature (599)..(599): n is a, c, g, or t
tcagagtcgagagacacgaccggtgctcgatttagtgtagtgtgaagggggctgtgggtccaggaggcagaactctgggtgtctcaccatggcctggactccctctaccttcctcccctcctcactctctgcacaggctctgacggtccctctatgacgcgtnacacagtccacccgtggtgtctgtcgtcctagaggactaggaccggctaggactcgacctgactcgtcggacagtcgactatacgaaaccaaaaatatatcgtacttacgtacggtaaccagcgaacggacggaccgtaccggaccgtaccggttccccgtaggtttcgtttaggggtttactttaaagttttaaaggtaaaaccggtttacgttaagggaaccggtaacccggtcccgttaacgggaacccgggtaccgtacggtacgtacgttacgtttccgtacgtccgtctaccgacgtacggtaacgacggaactacgacgtaccacgttacacgtacgtacgtacgtcgggaccgtacgggacgtaacgggaacgtacggcgtaactacgggttaactttacgtacgtacggtaccctacggtaccgganaaccggacgacgtaggttaacggttcggtaacgtttacggttagttacgggttcgttacgggtaacgggtacgggaaaccgggttacctacggttcccggtaacgggttaccctaccggggttaaacccgcggtaaaccccggtaacccggtacgggttacccccggttcccccgtaaccccggttggttaacccccc

SEQ ID NO: 74995 - DNA, 786 bp, Homo sapiens
  misc_feature: GYAE6OF01BQG6S.49.20.B09.1.454.CMB.1.raw
  modified_base (175)..(175): a, c, t, g, unknown or other
  misc_feature (175)..(175): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctggaggcctcctatgagctgacacagtcaccctcggtntctgtgtcctcgaggacagacggccaggactcactgctcgtggcatcgctatacgaaccaaaaactatatcgtacttacgtacggtaccagcgaaggacgaccacggccgacggtccccttaggttcgttagggtattaaactttaagtaaaacgttacgtttaggaacggtaccgggtacccctacggaacccggggtaccccttaggaacggtaccgttaacgtttccgtacggtacgggtaccctaccggtaacggtcctaaccgggaaacgggaaacctaacggtacgttaccctaaccggtttacggaacctaagtaccgggtaagtcggggtaacccggtaccggacgaaacggggtaacggaacggtaggtactaccggtaactttacgttaaccgtcgtaaccgtacggtacccgacgtaacgacgtaacggacgttagggtaccggtacgtttaaggttagttacggttacggttacgggttaccgggacggggtaacgggtacctacggtaccggttaccggaacccggttacggtaacggtaaccgacccgtacccggtaaccggtacccgttccccggtcccccggttagggtaccccg

SEQ ID NO: 74996 - DNA, 841 bp, Homo sapiens
  misc_feature: GYAE6OF01CM3XP.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacggcctcctatgagctgacacagtcaccctcggtgtctgtgtcctcgaggacaggacggccaggatcacctgctcgtggcgatgacattacgaaccaaaaactatatgtacttacgtagtaaccagacaggacggaccacggccacggccccttagtcgttaggtataatttaagtaaagtacttggaacggtacgccctacggaacgggtaccctggaacgtcgtactttcctcgtacgccttaccgagtcgtaacgaacgggaactaactacgtacctaaccgttacgaaccgtacgtacggaaggttacgggacggttaccccgggacgaaacggggtacggggtaaacggtaacgggtaccttaacgggtaacctttaacggttttaccggtacggtaccgttaaccgggtaccccgaaggtaaaccggaaccggtaacggtacccggtaaggggtttaacgggtacccgtttaaaagggtttaaccgtttcggggttaaacccggggttttaacggttaacccggggggaacgggggttaaacccgggggtaccttaaaccccgggggtaccggttaacccggggtaaacccccggtttccgggtaaacgggtaaccccgttaaacccggggacccccggtaaagggtcccccggttaccccccgggtacccccgttccggggtttaaccccccg

SEQ ID NO: 74997 - DNA, 746 bp, Homo sapiens
  misc_feature: GYAE6OF01B4UYZ.49.20.B09.1.454.CMB.1.raw
  modified_base (133)..(133): a, c, t, g, unknown or other
  misc_feature (133)..(133): n is a, c, g, or t
  modified_base (218)..(218): a, c, t, g, unknown or other
  misc_feature (218)..(218): n is a, c, g, or t
  modified_base (669)..(669): a, c, t, g, unknown or other
  misc_feature (669)..(669): n is a, c, g, or t
tcagagtcgagagacacgaccggtgctcgatttagtgtagtgtgaagggcgtagggtgggtccaggaggcagaactctgggtgtctcaccatggcctggatccctctacttcctcccctctcactctctgcanaggctctgaggcctctatgagcagacacacgtccaccgtggtctcgtgtccgtcgtacgaggacgacgacggtacacggacctcncctgctcgtaggcgtagtcgacgtacgttaacgaaacctaaaatacgttagttacgttacgttaaccgtacgtaacgaacggaccgaacgggaccgacccgaccggtaccgtaccggttaccccgttgttaccgttagttaacgttaaattaaacgtaaacgtacgtttaggaaccggtaccgtaccctaacggaaccggaccttacggacgtacgtacttcgtacgtcgtccgtccgagtccgacggaacggtaacgaacgtacgtaccgtacgttaccgacgtaacgttacgaagttccggtacggaccggtacgaacgggacggtacggacgagtacgtaagtacgttacgtagtacgtaccggtacgaacaacgtacgaacggtaggtaacgtcggtaccgttagttacgttacgggttgtaacggtcgggtaagccggggtaaacnccggtacggtaccgtaccggtcgtacgggtaccgaacggtacccggtacggtcccgtcccggtcccgccgttacccg

SEQ ID NO: 74998 - DNA, 696 bp, Homo sapiens
  misc_feature: GYAE6OF01EZUWV.49.20.B09.1.454.CMB.1.raw
  modified_base (173)..(173): a, c, t, g, unknown or other
  misc_feature (173)..(173): n is a, c, g, or t
  modified_base (212)..(212): a, c, t, g, unknown or other
  misc_feature (212)..(212): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtntctgtgtcctcaggacagacggccaggatcacctgctcnggcgatgctatgaccaaaacaatatcgtacttacgtacggtaccagcaggaggaccaggccgacggcccctgttcgttggtagtatttaataaacgtctttaggaggtacgtccctacgacgggtacccctggacgtcgtattctcgcggcctccgacgtctacgtacgggacaaacgtacgtacctaaccgttacgacctaagtacgtaaggtacgggtaccggtacccgacggtaacgggaacgggtaaccggaacggtcctaaggtaaccgtttaagttaaccgttagtaccgtaccggtcccgtacaaggaacgacggacgtacggtggtaaccggttagtttaacgttcggtaacgttcggttaccggggtacgggtacgggtacgttaccggtcgttaccggtaacccggttccgttaacggtaccgaaccggtacccggtaaacggtcccgtacccggtcccccgttcggtaccccg

SEQ ID NO: 74999 - DNA, 689 bp, Homo sapiens
  misc_feature: GYAE6OF01A4BXB.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtcgtcctcgaggacagaccggccaggactccacctgcctcgtggcgtatgctattcgaaccaaaaacatatcgtactttacgtggtaaccagcgaggacggccaggcccaccggtcccccttggttccgtttagggtagttaaacttttaacgtaaaacgaccgtaacgttggaacggaccggtccccgttaggaacgggtacctccccgtaggacgtccgtacttccgtcgtggcctaccggaggtacgaacggtaaccaaccggtactacgtacgttcggaccctagtaccgaggtacggagttacccgagggtaccaagggacggacggagtccgtaggtaactttagtttagtcggtactaataccgaacgtacgaacctaccgtaagttacggttactttacgttacgtcgttaccggaacttcggaccgtaaccgtacgtccgtacccggtcggttgccgaaccgacccgtacggacccccaaccctcggttccgctaccccg

SEQ ID NO: 75000 - DNA, 844 bp, Homo sapiens
  misc_feature: GYAE6OF01B9B1O.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacgaggctctggacggcccttcctaagtgagctagacacgtagtccacccgtggtgtcctggttcgtcctagaggacaggaccggccgaggacttccgaccgtcgcctcggtacggcgtatcgacctagttaccgaaacctaaaaatattacgtacgttaccgtttaccgtacggtaaccagcgaacggacggacccgacggacccgtaccggtccccttggtttacggttagggttacttaaacgttttaagtaaaccggtttcgtttacggacggtacccgggtccctaacggaacccggggtaccctaggacgtaccgttcgttccgtcgtaccggtacctcgtaaacgccgtaaaccggtacggtaactaaccgtcgtaaccctaaccggtttccgaaacgttacgtacggggtaacggtttaccgggacccggttacccgggaacggtaacgggtaaccgggtaacggaccggttaccgtaaccggtaattaaccggtttacggtacgttaccgtaccggtaccgacggtaacgtaccgggctaacgggtacggttacggtactaacgggtttcgttacgggtaacgttcgggttaccggggacggggttaccggaacgttcccggtacggtacgttaacccggttcggtacgtaccgaacccgggtaacccgtcgaaccccgttcccggtccccgttaacgtacccg

SEQ ID NO: 75001 - DNA, 736 bp, Homo sapiens
  misc_feature: GYAE6OF01D1F7N.49.20.B09.1.454.CMB.1.raw
tcagagtcgagagacacgaccggtgctcgatttagtgtagtgtgaagggggctgtggggtccaggaggcagaactctgggtgtctcaccatggcctggatcctctacttctcccctcctcactctctgcacaggctctgaggcctcctatgagctgacacagtccaccctcggtgtctgtcgtcctcgacggacaggacggccaggactccacctgactcgtaggctatcgctattcgaaccaaaactatagtcgtacttacgtacggtaccagacaggaacggccgaacggcccgaccggtccccgttggttccgttggttacgttaagtttaacgtaaaggttccgtttaggacggtaccggtacccgtcggaaccggtaccccgtagtacggtcggtactttccgtcgtcgtactaccgtacgtccgtacgaacgggtaccaacgtacgtacccgtaacgttcgtaaccgtactacggtacggtacggggtacccgtaccgggtaaccgaacgggtacgggaccgggaaggtcctacgggttacttaacgttacgtcggtccgtaacggtccgaacgaacgtaacgccggtaccggaagggtacgtacgtttaggtttacgtcggtttacggtacggttccggggaggtacgggaaccgttccgtacggttaccgtaccggtacggtacggtcaccggaccgtaccggacctccccgggtcccgtccgtaccg

SEQ ID NO: 75002 - DNA, 679 bp, Homo sapiens
  misc_feature: GYAE6OF01E1F4L.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacaggaccggccaggatcacctgcctcgtggcagtgcctattgaaccaaaaacaattatcgtactttacgtggtaccaggacgagacggccacggccacggtcccccttgtccgtttggtgtaactttaagtaaacgtcgtttaggacgaccggtcccctcgacccggggtacccctaggtacggacgtactttcctacgtcggtcctcccgagtcctacggaagggtaaccaacgtacgtacctaccgttagaccctatacgtagggtacggacgtcccggactaagggacggacggaggtcgtgaacttattacgtgtacctcggtaccgacgacggtaacacggacgaggtccggtacttaaggtttacgttacgggtacgttggttcgggacgggtacgggtaccctacggtcgttaccggttacccggtacgtaccggtaccgaaccgtccggaacgtcccgtcccgtccccgtcgggtaaccc

SEQ ID NO: 75003 - DNA, 727 bp, Homo sapiens
  misc_feature: GYAE6OF01B2TOA.49.20.B09.1.454.CMB.1.raw
  modified_base (178)..(178): a, c, t, g, unknown or other
  misc_feature (178)..(178): n is a, c, g, or t
  modified_base (563)..(563): a, c, t, g, unknown or other
  misc_feature (563)..(563): n is a, c, g, or t
  modified_base (577)..(577): a, c, t, g, unknown or other
  misc_feature (577)..(577): n is a, c, g, or t
tcagagtcgagagacacgaccggtgctcgatttagtgtagtgtgaagggggctgtgggtccaggaggcagaactctgggtgtctcaccatggcctggatccctctacttcctcccctctcactctctgcacaggctctgacggcctctagtgagctgacacacgtccacccgttggtntcgtgtcgtcctacgacggacacggacggccgaggactccaaccgtcgccttcgtgggacgtagtcgactacgttacggaaaaccaaaaatattacgtacttacgttaacgtacggtaccgaagacgaaggaccggaccgacggaccgccggtccttaggttcgttggtagtaactttaagtaaacgtcgtttaggaacgaccgttaccgacgacccgggacctaggaagtcgtactttccgcgtacggtcctacccgagtccgacggaacggtaacaacgttcaccgtacgttaccgactacgtacgaggtccggacgtccggacgaaggtacgaacggtacgtccgtaataccgttagtcctacggtaccgacgtcccggaanagtaccacgggacncggtacggttacgttagttaccgtttaggtaccggtacgttacgggggacgggtacgtaaccgtccgaccggttcccggtacccggtaacggaccgtaccggacccgtaccgggtacccggtcccgcccccgttccggttacgtaccccg

SEQ ID NO: 75004 - DNA, 879 bp, Homo sapiens
  misc_feature: GYAE6OF01EQ4U0.49.20.B09.1.454.CMB.1.raw
  modified_base (194)..(194): a, c, t, g, unknown or other
  misc_feature (194)..(194): n is a, c, g, or t
  modified_base (243)..(243): a, c, t, g, unknown or other
  misc_feature (243)..(243): n is a, c, g, or t
  modified_base (277)..(277): a, c, t, g, unknown or other
  misc_feature (277)..(277): n is a, c, g, or t
tcagagtcgagagacacgaccggtgctcgatttagtgtagtgtgaagggggctgtgggtccaggaggcagaactctgggtgtctcaccatggcctggactccctctacttcctccccctcctcactctctgcacgaggctctaggacggtccctacctaagtcgagcctagaacacacgtccacccgttgggtntctgtcgtcctacgaggacacggaccggccaggactccacctgcttcgnggcgtatcgactacttacgaaaccaaaaatagtnttcgtacttaacgtcggaacacggacgacggacggaccacggacccgtccgggtcccctttaggtttacgtttgggttaaagttaaacttttaaaacgtaaacggtttacgtttaacgggaaccggtacccggtaccccgtaacggtaaccccggggtaccctaggaaccgtaccggtttaaccttcccggttacggtccggtaccctacccggtaaagtcccggtaacgggaaacggtaaacccgtaacgtttacggaaccctttaaccgtacgtaaacctacggtaacggacgggttacgggtaaccggtacccgggaacgaaggggacccggtaacggtacggtaccgtacgttaaccgttaagttcccgtacgtacgaccgtaccgaacggaacgtaacgaccggtaagtacggtacccggtaagttttaaccgtttaggttaaccgggttacggttaccggggtaccggggttaaacgggggaacccgtaaccgttaaaaccgggttcccggttaaccgggttaacccccggttgtaacccggtacccgaaccggtaccgggtacccggtacccgtcccgtccccggtcgtaccccg

SEQ ID NO: 75005 - DNA, 807 bp, Homo sapiens
  misc_feature: GYAE6OF01AUU5C.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctagacacacgtccacccgttcggtcgtcttggttcgtccctacgaacgggtaaccaggacccgggaccgaaggtactacccacccgttggcccttacggtcggggtaccgtagtcgaccgtaacgtttaccggaaaccctaaaaacgtattacgtcgttaccgttacgtacggtaccgagacgacggaccgaccggaccggccgtacccggtcccgttggttacggttaggttagttaagtttaaacgttaaacgttacggttaggaccggtacccggtaccgtaccgggaacccggtacccgtaggtacgttacgttacgttccgtccggtccggtacctaccgacggtaacccgtacgggaaaccggtaacctaaccgtaccgtacccgtaccgtactaaccgtacgtacggtacgggtacgggtacccggtacccgggagaacgggtacggtaacggacggtacgttaacgtacgttacgttacgtacgtacaccggtacctacggacgaccgtagacgtacggtacgtagttacgttacgtcgttacggtacgggtaccggacggtacggtaccgtcggtaccgtacggtacccggtacgtaccgaccgaccggtaccgtaccgtccccgtcccgtcccgtccggtc

SEQ ID NO: 75006 - DNA, 678 bp, Homo sapiens
  misc_feature: GYAE6OF01BRUNO.49.20.B09.1.454.CMB.1.raw
  modified_base (184)..(184): a, c, t, g, unknown or other
  misc_feature (184)..(184): n is a, c, g, or t
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
tcagagtcgagagacacgaccggtgctcgatttagtgtagtgtgaagggggctgtgggtccaggaggcagaactctgggtgtctcaccagtggcctggatccctctacttctcccctctcactctctgcacgaggctctgagcctctatgagctgacacagtccaccgtggtgtctgtgtcctnaggacagacgcagatcactgctctggcatcgctattacgaaccaaaaanattacngtacttacgtacggtaaccagacgaggacggaccgacggacctacggtccccgttggttccgttaggtacgtaatttaacgtaaacgtacgtttaggaacggtacggtacccgtacgaaccgggtacccctaggacgtacgtacgttccgtcgtcgtctcgacgacctacgaacggacaaccgtacgtacgtaccgttacgacctacgtacgtacggtcggtacggtaccggtacgaacgggtaacggacggaacggtcgtaggtaaccgttacgttacgtcggtacgacggtacccgacaacggacacgacgtaggtcggtactaggttacgtacgtacgtacggtcgggacggtaccggtacgtacgtccgtacggtaccgtcgtaacggtaccaccggtaccctaacgggtccctacccgtcccgtcggtaacccg

SEQ ID NO: 75007 - DNA, 781 bp, Homo sapiens
  misc_feature: GYAE6OF01C6QYA.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgagcctcctatgagctgacacagtccacccgtggtgttctgtcgttcctcgaggacacggaccggaccgaggactccaccgtgtccttcgtcggactagtcgactacgttacgaaaccctaaaaactagttagtacgtacctttacgtacggtaacccgagaccgaaggaccggacccgacggccccgtaccggtccccgttggtttccggtttaggttacgtttaaattttaacgtaaacggttacgtttacgggacggtaccgggtccccgtacggtaacccgggtaccccgtaggaccgtacgttacgtttccgttacggtccgggtacctaccgtacggtccgttaaccggaacgggaaacctaacgtacgttaccctaaccgttaccgaacctacggttacggacgggttaacccgggtacggtccccgggaacgaacggggtaacgggacggacggtactaacggttacttacgttacgttcggaccgtaccgtcgtacacgacgtaccgtagacggtttcgtagttacgttaggttcggttacgttaaccgggtcgggacgggacgtcgaccgtcggtaccgtcgtacgacggtctaccggcctaccgggtcctaccccgggcccgttcgtcccg

SEQ ID NO: 75008 - DNA, 762 bp, Homo sapiens
  misc_feature: GYAE6OF01CN8C8.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggccctcctatgagctgacacagtccacccgtcggtgtctgtcgtcctcgaggacaggaccggccaggactccacctgctcgtggacgatcgcctagttacgaaccaaaaactatactcgtacttacgtggtaacccagcgaaggacggaccgacggcccgacggtcccccgttgttccggtttagggtacgttaactttaagtaaaacggttacgttttacggaacggtaccgggtacccccgttacggaaccgggtacccccgtaggacggtaccgttaacttccgtcgtaccggtcctacccgtacgtaccgtaacggtacgggaaacctaaccggtacgtacctacccggttacgaaccctagtccggtaacggtaccgggtaccggttccccgggaccgtaagggacggggaaccggtacgggtacgttaccggtaacttaacgtttaccgtacggtacgtaccggtaccccgagtacggaacgtcggacgtaggtacgacgtagttacgttcgtacggttacggtccgggacgggtacggtactcggcgtacgacccgttcggtacggtaccgaccgtacccggacggtcccgtcccgtccccgtcgggtaccc

SEQ ID NO: 75009 - DNA, 762 bp, Homo sapiens
  misc_feature: GYAE6OF01AXCLB.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagaccggccaggatcacctgctcgtggcatgcattcgaccaaaacatatgcttactagtaccagcaaggacggaccacggaccgacggtcccccttgtccgtttgggtagttaacttttaagtaaaaacgtacgtttttagaacggtaccgggtaccccttacgaacggggtaaccccccttaggacggtacgtaactttcctacgttcggccttacccgagtacctacggaacggggaactaaaccgacggtttaaccaacccgtttacggaaacccctacgttaaccgacgggtttacgggtacccgggttaccccgggaaccgtaaacgggaacgggaaccggtacgggtaccgttacggtaaacttacgttttaccgtacggtaccgtaaccggtacccggtacgtaaaccggtaccgaacgggaaccgtaacggttcgggtaaccgttaacggtttaacgttacggttacgttaacggttccgggtacgggaggttaccgtacgtccgtagtaccccggtcgtacggtacgacgtaccgaacgtctacccgccccgttcgtaacccg

SEQ ID NO: 75010 - DNA, 663 bp, Homo sapiens
  misc_feature: GYAE6OF01C3A14.49.20.B09.1.454.CMB.1.raw
  modified_base (258)..(258): a, c, t, g, unknown or other
  misc_feature (258)..(258): n is a, c, g, or t
  modified_base (261)..(261): a, c, t, g, unknown or other
  misc_feature (261)..(261): n is a, c, g, or t
tcagagtcgagagacacgaccggtgctcgatttagtgtagtgtgaagggggcgtgtgggtccaggaggcagaactctgggtgtctcaccatggcctggatccctctacttcctccccctcctcactctctgcacgaggctcgtgacggtcccttcctatgagctagacacagtccacccgtggtgtctgtgtcctcgaggacgaggccggccaggactccgacgtgctcgtggctatgactagttcgaaccaaaactnttntgtacttacgcgacgagacgaggacgccgacggccgccggtccgtgtgttaggtattaagttaagtaagtcgtaggacggtacggtcgtacggaccggtaccgtagacgtcgtacttccgtcgtcgtcctacgacgtacgtacgacgacctaacgacgtacgtaccgtacgtacactacgtacgaggtacggacgtacggacgaaggacggacgtacgtacgtacgtaacgttacgttcgacgttacgtacgtactacgtacgaacgaacgttacggtagtacgtccttacgtttacgtcggttacggttacgggacgggacggtaaccgtacgtaacgtcgttaccggtacggtaccgtacgaccggtaacggacccgtcgtcccgtcccggtcccgtacg

SEQ ID NO: 75011 - DNA, 722 bp, Homo sapiens
  misc_feature: GYAE6OF01DGMIE.49.20.B09.1.454.CMB.1.raw
tcagagtcgagagacacgaccggtgctcgatttagtgtagtgtgaagggggctgtgggtccaggaggcagaactctgggtgtctcaccatggcctggactccctctacttcctccccctcctcacttctctgcacaggctcgtgacggccctcctagtgagcctgacacagtccacccgtggtgtcttgtcgtcctagacggacaggaccggcaggtactccaccgtgccgttcgtcggactgttcgctaattacgaaaccaaaatattacgtaggtacctttaacgtaccgtaaccgagaccgaacggacggccgaacggcccgtaccggcccgttggttcgtttaggtacgttaaatttaacgtaaagtacggtttgaacggtccgtaccgtacggaccgggtcctgacgtcgttactcgttcgcgacctacagtcgtaacgacggaacaacgtactaccgttctaacgtacacgtacgtaggtccggacggttaccggaacgtaacgggaccggtacggacgtacgttagttaacgttacgttacgttcgtaacgtaccgttaccgacggtacgtaacgtacggacggtaaggttcggttaacgttaacggtttacgttagggtttccgggttaacggttcgggacgggtacggacgtaccgtcgtacggtaccgtcgttacgaccgacgacgtaccgccgttccgtcccgtcgtcccg

SEQ ID NO: 75012 - DNA, 701 bp, Homo sapiens
  misc_feature: GYAE6OF01DGZXK.49.20.B09.1.454.CMB.1.raw
  modified_base (251)..(251): a, c, t, g, unknown or other
  misc_feature (251)..(251): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgacggcctcctatgagctgacacagtccaccctcggtgtctgtgtcctgaggacagaccggccaggactcacctgcctcgtggcgatcgactagttacgaacccaaaaaanattactgtacctttacgtaggtaacccaggaccgaaggacggaccgacggccccgacgggtcccccttggttccgtttgggtacgttaattttaagtaaaacgtcgttttaggacggtaccggtccctacgaccgggtacccctgacgtcgtattctctacgacctacgagctacgaacgggaacaacgcgttacctaccgttagaccctagtacgtacggtacggtaccggtaccgggaccgaagggaacgggtacgacggtactacggtaacttaacgtttacgtcgtacgacggtaccgacgaacgacgacgacgtacggtcggtactaggtttacgtcggttacgttaggttccgggacgggtaaccgggtacgtacggtcgtacggttacccgtccgtacggtaccacggtacccgtagtcccgtcccgtccccgttcgtacccg

SEQ ID NO: 75013 - DNA, 759 bp, Homo sapiens
  misc_feature: GYAE6OF01CLP6U.49.20.B09.1.454.CMB.1.raw
  modified_base (177)..(177): a, c, t, g, unknown or other
  misc_feature (177)..(177): n is a, c, g, or t
tcagagtcgagagacacgaccggtgctcgatttagtgtagtgtgaagggggctggtgggtccaggaggcagaactcgtgggtgtctcaccatggcctggactcctctacttcctcccctcctcactctctgcacaggctctgacggcctctatgagctgacacgatcaccctcggtntctgtcgtcctgacggacagacggccaggctcacctggctcgtggcgatcgcgtacttcgaaccaaaaactattactggtaccttacgtaggtacccagaccgaggtacggaccgacgtaccgacggccccttgtcttgggtactaatttagtaaagtctttaggacggtaccggtcctacggaacccgggacccgtaggaccgtacgtatttccgttcgtcgggaccttccgaacggtccgtaacggtaacgggaaccgtaaaccgtacggtacccttacccggtttaacaaccttacgtacggttaacggtccgggtaaccggtacccgggacgtaacggggaacgggttacggacggtaccgtaacgttacgttaaacgtttaccgggtatccggtaacgtcccgaagaaccgtaacgtaacgcgtaacggtacggtacgttaaggttacttcgggttacgttaaccggtcgggtacgggtaccgggacctttaaccgggccgttacccggggttacccgtacggtaccggttaccgaccgacccggtaacgcccttaccccggcccgttacgtacccg

SEQ ID NO: 75014 - DNA, 797 bp, Homo sapiens
  misc_feature: GYAE6OF01AGM38.49.20.B09.1.454.CMB.1.raw
  modified_base (182)..(182): a, c, t, g, unknown or other
  misc_feature (182)..(182): n is a, c, g, or t
  modified_base (370)..(370): a, c, t, g, unknown or other
  misc_feature (370)..(370): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgccacaggctctggacggcctacctatgagctagacacgtagtccaccgtcggtntcgtgtcgtcctcgaggacagaccggcaaggctcacctgctcgtggcgtatgactattacgaacctaaaactactatcgtacttacgtacgaaccgacgcgtagacggtccgacggccgacggtccccgtgtccgttggtatattaactaaagttctacggacggtccgcctaccggacggtacccgnggtacgacgtacgttcgtaccggtgcctacgcgtacgtaacggaaggtaacctaacgtacgtacccgttacgtaaccgtaaccggtacttacggaggttacgggacccgggttaacccgggacggtaaacggaacggggttacgacccgggtacgttaacggtaaccggtttaacttaccgggtttacggtacccgggtaaccgcccgtaaggaccgggtaaacgtacggtaacggtaacggggttacgtaccggtttaaggtttaacgttacgggtttacgggtaacccggggttcgggacgggggttaaaccctaggggtaccccgcggtttaccggggttaacccgtccggttaaaccggtacccggtacccgacccggggtaacggtccccgtaccccggttcccgggttaacccgttcccgg

SEQ ID NO: 75015 - DNA, 768 bp, Homo sapiens
  misc_feature: GYAE6OF01AC0KA.49.20.B09.1.454.CMB.1.raw
  modified_base (141)..(141): a, c, t, g, unknown or other
  misc_feature (141)..(141): n is a, c, g, or t
  modified_base (180)..(180): a, c, t, g, unknown or other
  misc_feature (180)..(180): n is a, c, g, or t
tcagagtcgagagacacgaccggtgctcgatttagtgtagtgtgaagggggctgtgggtccaggaggcagaactctgggtgtctcaccagtggcctggatccctctacttctcccctcttcactctctgcacgaggctccngaggccctcctatgagctgaacacagtccacccgtggtnttctggtactcctagacggacacggaccggtccaggactcacctggccttacgtggactagtcgcctattacgaaccctaaaatgtactgtacttacgtcgtacgagcgaggacgccgacggccaccggcccgttgttcggttacgttagttaactttaagttaaacgttacgttacggtacggtaccggtaccccgttccggaccgggtacccccgtaggtaaccgtcgtaccgtttcgttaccgtcggtaaccttccgaacggtcgtacggtaacggtacaacgtacgaccttactaccggtaactacggttacgacgttaccggtaaccgggccgtaccggaacggtacggaaccgtacggaccggtttaagaccctttaaggtacgttaccggtacttaccgggacggtaccgaagccggtaacgtccggtacggtacgtacgtttacggttaacggtcggttaaccgttcggtaccgggtacgggtacgtaaccgacccgttcgttaccggtaccggttaaaccggtccgaccgttaacccggaccgacggtacccggtacccggtcccgtcccggttacccg

SEQ ID NO: 75016 - DNA, 781 bp, Homo sapiens
  misc_feature: GYAE6OF01BCXEN.49.20.B09.1.454.CMB.1.raw
  modified_base (176)..(176): a, c, t, g, unknown or other
  misc_feature (176)..(176): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtccaccctggtntctgtctcctcgaggacagacggccaggactcacctgctgtggcgtatgctagttcgaaccaaaaactatatacgtacttacgtacggtaaccagacgaaggacggaccgacggccaccggtccccttgttcgttggtattaactttaagtaaagttacgtttagacggtaccgacccgtacggaaccggtaccccgtagacgctacttcgtcgtcgtcctacgtacgtaccacggtaacgaacgtaacgtacgtaccgtaccctacgactacgtacgtacggtacggaccggtaccgggacgaaggacgggaacgacggtacgtacgttaacgttaacgtttacgtaccgtaccgtacgtaccggaacgtaccggaacgaccggtaacggtaacgggttacggtaaccgtttaaggtttaccggttacggttaccgggttaacgggttccggggtaaaccggggttaccgggtaacccgttaaacccggttccggttaacccgggtaaccgggtttaccccgggttaacggtacccggaaacccggttaaccccggacgggtacccccgtcccccgggttacccccgttaccggtttacccccg

SEQ ID NO: 75017 - DNA, 818 bp, Homo sapiens
  misc_feature: GYAE6OF01D0BH8.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgacggcctctatgagctgacacagtcaccctggtgtctgtgtcctcgaggacaggacggccaaggactcgaccgtgctcgtaggcgatcgctattacgaaccaaaaactatactcgtactttacgtacggtaccagcaagacggaccgacggccgaacggtcccccgttggttccgttagggtacgttaattttaaacgtaaacggtaccgttttaggaacggtaccgggtacccctacgaacccggggtaaccccctaggtaaccggtaccgttactttaccggtcgttacgggtccctaccgtacggtaccgttaacggaaacggtaaccaaccgtacgtacctaaccgtttacgacctaagttacgacggttacggaccggttaccggacgtaacgggaacgggtaccggtaacgggtaccgttacggtaactttacggtttaaccgtacggtactaaacttaccgaaactaacggtaacctaaccgttagtttaacggttaaccgtttagttaccgttaacgtttaaccggtaacgttacggtaacccgtaaccggtaaccgttccgtaacccgggttccggttaacgggtacccgtaaaccggtacccccgaaaccggacccccgtaacccgtaaacccgtttcggaaccttacccggttcccgttaccccccgg

SEQ ID NO: 75018 - DNA, 722 bp, Homo sapiens
  misc_feature: GYAE6OF01C0RTL.49.20.B09.1.454.CMB.1.raw
tcagagtcgagagacacgaccggtgctcgatttagtgtagtgtgaagggggctgtgggtccaggaggcagaactctgggtgtctcaccatggcctggactcctctacttcctcccctcctcactctctgcacaggctctgacggcctcctatgagctgacacagtccacccgtggtgtctgtgtcctcgaggacaggaccggccgaggactacaccgtgctcgtggcgatgactattacgaaccaaaaactattagtcgtactttacgtacggtaccgacgacgaaggaccggaccgacggacccgaaccggtccccttaggttccgtttgggtacgtttaatttaaacgtaaacggttacgtttaggaccggtaccggtccccgtacggacccgggtaccccgtggaaccgtacgttcgtttaccgtccgttacgcccttaccgacgtaccgtaccggaacggaaaccgtaacgaccggtttcctaaccgttaccggaacttaccggttacgaacggtcgggtaccggtacccggtaccggaacggaacgggtacggacggtaccgtacgtaactttagttaccgtacggttaccgacgtacccggataaccgacgtacgagtcggtgtacgtgttaacggtgtcgtacggtgggacgtacggctacgtcgtagtaccgcgttaaccgcacccgtcgaccggtctcccgcccgttcgtacc

SEQ ID NO: 75019 - DNA, 685 bp, Homo sapiens
  misc_feature: GYAE6OF01CLR3T.49.20.B09.1.454.CMB.1.raw
  modified_base (187)..(187): a, c, t, g, unknown or other
  misc_feature (187)..(187): n is a, c, g, or t
  modified_base (247)..(247): a, c, t, g, unknown or other
  misc_feature (247)..(247): n is a, c, g, or t
  modified_base (525)..(525): a, c, t, g, unknown or other
  misc_feature (525)..(525): n is a, c, g, or t
  modified_base (553)..(553): a, c, t, g, unknown or other
  misc_feature (553)..(553): n is a, c, g, or t
tcagagtcgagagacacgaccggtgctcgatttagtgtagtgtgaagggggctgtgggtccaggaggcagaactctgggtgtctcaccatggcctggactccctctacttcctcccctctcactctctgcagaggctctgacggcctctatgagctagacacagtccaccctggtgtctgtcgtccngaggacaggacggcctaggactcgactgctcgtggcatgctagttacaaccaaaatatangtcttagtacgtaccagacgaggacggaccgacggccacggtccctgttcgttgggtatatttaagaaatgtttacgaggtacgacccgtacgaccgggtacccgtggaacggccgtatttccgtcgtcggtccttccggagtacctacggaacgggtaactaacgtacgtcctaaccgttaggaccagtacggacggtacggtacggaccgacggaaggggacggaacggacggacgttaacggaactttacggtttacgagtaccgtacgtccganaacggaacgtgacccgtaggtaaccggngttaacggtttactccgggttacgtacgggttacggacgggtaaaccgggtacaccggtcggttacggacccggtcgttaacgggaccgtaccgaccggtaacctcggtcccctaacccgtcgggttacccc

SEQ ID NO: 75020 - DNA, 687 bp, Homo sapiens
  misc_feature: GYAE6OF01ANT49.49.20.B09.1.454.CMB.1.raw
  modified_base (175)..(175): a, c, t, g, unknown or other
  misc_feature (175)..(175): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtntctgtcgtcctcgaggacaggaccggccaggactccacctgctcgtggcgatgcattcgaacccaaaatatatcgtaccttacgtcggtaaccagacgaaggacggccgacggcccgaccggtccccttgttccgttaggtagttaatttaagtaaacgtcgtttaggaacggtaccggtacccctacggaaccgggccccgtagacgtacgtacttccgtcgtcggcctccgacgtccgtacggaacggaacctaacgtacgtaccctaaccgttacgaacctacgtacggtacggtacgggtaccggtacccggacggtaacgggacgggaacgtcggtacgtagttaaccttagttaccgtcggtacgtaccgccgaacgacgtacgacgacgtacgggtcggtacgttagttcgttacgtacggttacgtacggggacgtacggtaccgtcgccgtacgtacccgtcgacgtcgaccgccggacgtcccgcccgtcccgtcgtacccg

SEQ ID NO: 75021 - DNA, 693 bp, Homo sapiens
  misc_feature: GYAE6OF01DL4K5.49.20.B09.1.454.CMB.1.raw
  modified_base (154)..(154): a, c, t, g, unknown or other
  misc_feature (154)..(154): n is a, c, g, or t
  modified_base (160)..(160): a, c, t, g, unknown or other
  misc_feature (160)..(160): n is a, c, g, or t
  modified_base (263)..(263): a, c, t, g, unknown or other
  misc_feature (263)..(263): n is a, c, g, or t
  modified_base (573)..(573): a, c, t, g, unknown or other
  misc_feature (573)..(573): n is a, c, g, or t
  modified_base (579)..(579): a, c, t, g, unknown or other
  misc_feature (579)..(579): n is a, c, g, or t
tcagagtcgagagacacgaccggtgctcgatttagtgtagtgtgaaggggctgtgggtccaggaggcagaactctgggtgtctcaccatggcctggactccctctacttcctcccctctcactctctgcacaggctctgcgcctctatgacgcngacacngtccacccgtggtcgtctgtcgtccgtacgaggaccaggaccggcaaggtactccgaccgtcgccttgcggcagtgacctagttacgaaaaccctaaaaactntacgtcgtaccgttacgtacgtacgacagacgacggaccgtacggccgaccggtccttggttacgttggacttaagtttaacgtaaacggttcttacggaacggtacccggtacccgttacgggaccggtacccgtagggtaacctccgtttaccgttaccgtcggtacgacccgttcaaccggtcttacggaaacggtaaccacgtaccgtacttacgtacgaacgtactagaacggttacggcggtaccgaacggtaggacggtaaccgcgtatacgtaacgttcgtactcgtaacgccgtcggtaancgttancggtagagtccgtatcgttagtacgtacgacggtacgcgtaaggcctacgtccgtaccgtactccggtacggaccgtacccggtacctaaccggcgtccccgtacgccgtcccg

SEQ ID NO: 75022 - DNA, 785 bp, Homo sapiens
  misc_feature: GYAE6OF01AE7VG.49.20.B09.1.454.CMB.1.raw
  modified_base (136)..(136): a, c, t, g, unknown or other
  misc_feature (136)..(136): n is a, c, g, or t
  modified_base (169)..(169): a, c, t, g, unknown or other
  misc_feature (169)..(169): n is a, c, g, or t
  modified_base (238)..(238): a, c, t, g, unknown or other
  misc_feature (238)..(238): n is a, c, g, or t
  modified_base (513)..(513): a, c, t, g, unknown or other
  misc_feature (513)..(513): n is a, c, g, or t
tcagagtcgagagacacgaccggtgctcgatttagtgtagtgtgaagggggctgtgggtccaggaggcagaactctgggtgtctcaccagtggcctggactccctctacttcctccccctcctcactctctgcacnggctcgtggacggtcctcctatgagctgacacncgtccacccgtggtgtctgtcgtcctagaggacacggaccggaccaaggtctccaccgtgtaccgttgnggaccgatcgcctagttaaccggaaaccctaaaaactaatttacgtccgtacctttaaccggtaccggtaaccgagaccgaggaccggaccgaccggccgacccgtcccgttgttcggttggtaagttatttaagtaaacgtcgtttggaaacggccggttcccgacggaccgggtaccccgtggtacgtaccgtactttcgtaccggtcgtcctacgtacgtcgacggaacggaacgtaacgtacgtaccgtacctaccgaccgtaattccggnggttacgggacccggtcggacccggtaagggaacgggcggtacgtccgttaacgttacttacgttcggacgtccgtaccggtacgcgaaccgtaacggcgacgggtacggtcgtaacgtttacggttagttacgggttccggtaacggttccggggacggtacgttacccgaggttaccggttcccgggtaccggttaccttcggggaccccgttaagtacccccggggtacggttacccccgttccccggtaccggtttccccgtaacccg

SEQ ID NO: 75023 - DNA, 746 bp, Homo sapiens
  misc_feature: GYAE6OF01DD0T0.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgagccctcctatgagctgacacacgtccaccctcggtgtctgtcgtcctcgagacagacggccaggactccactgctcgtggacatgctatacgaaccaaaaactaatatcgtacttacgtacggtaccaagcaaggacgaccgacggccgacggtcccctgttcgttggtacgttaatttaagtaaacgtacgtttggacggaccggtccctacggaaccggtacccgtggaaccgcgttactttcgtcgtcggtcctaccgagtccgtacgaacgggaccaaacgtacgtacctaaccgttacgaacctacgtcgtaacgggtcggtaccggtacccggaccgaagggacgggacggtaacgtcgtacgtaacttacttacgttacgtccgaccggtccgacaacggcgaacgtaccggtacggttacgggtaccgttaagtttcgttacggttacgggtttacggtccggggaacgggggtacgggtaccgtaccgggtcctaaccgggttacccggttaccggtaaccgggttaccgaaccccgggtaacccgtaaaccggtcccggttacccccggttcccccggttcccgggttaacccg

SEQ ID NO: 75024 - DNA, 629 bp, Homo sapiens
  misc_feature: GYAE6OF01AB728.49.20.B09.1.454.CMB.1.raw
  modified_base (172)..(172): a, c, t, g, unknown or other
  misc_feature (172)..(172): n is a, c, g, or t
  modified_base (241)..(241): a, c, t, g, unknown or other
  misc_feature (241)..(241): n is a, c, g, or t
tcagagtcgagagacacgaccggtgctcgatttagtgtagtgtgaagggggctgtgggtccaggaggcagaactctgggtgtctcaccatggcctggatccctctacttctcccctctcactctctgcacaggctctgaggcctcctatgagctgacacagtcaccctggtntctggtcgtcctcgaggacagaccggccaggactccacctgctctggctatgctattcgaccaaaaatntagtgtcttacgtcgtaccagcgagacgccacggccacggccctgtcgttggtgtatttataacgtactttgagacggccctcgacgggtacccctgacgcgtacttctcgtcggcctccgagcgtacgacggaacaactacgtactaccgttgacctagtcgaggtggacgtccggccgtagggacggacgaggtacgtcggtaacttagttacgtgtactagtacagtaccgagtacgtacgtaggtcgtacgtacgttcgtcggttaccgtaggttaccgggcggtaaaccgggtaccgaacggtcgtaccggtacccgttccggtaacgttaccgaccggtaacccgtacggtcccgttaccccgtcccccggtggttaccccg

SEQ ID NO: 75025 - DNA, 732 bp, Homo sapiens
  misc_feature: GYAE6OF01AQC0X.49.20.B09.1.454.CMB.1.raw
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (259)..(259): a, c, t, g, unknown or other
  misc_feature (259)..(259): n is a, c, g, or t
  modified_base (459)..(459): a, c, t, g, unknown or other
  misc_feature (459)..(459): n is a, c, g, or t
  modified_base (481)..(481): a, c, t, g, unknown or other
  misc_feature (481)..(481): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggtccctcctatgagcttgacacagtccaccctcggtgttcctgttcgtccctacgaggacaggccggccaggactaccncctgcttcgnggactntgctattacgaaccctaaaaatnttacgtcgtacctttacggtacgtaccaggactaggaccggccacggaccccgtacggtccccttggttaccgttggtagttaactttaaagtaaacggttcgttaggaaccggtccggtaccccgtacgggtaacccgggtacccctaggaccgtcgttaacttccgtcgtacggcctacgcgtctacggaaccggaanaacgtccgtactaacccggttnaacctagtaccgagttcgggaccgtacccggacgaggtacggacggtaacgtcgtaacgtaacgtttcttaacgtcgttaccgacgtttcccgagaacgaccgtacggacgtacggtacgggtacgttaccttagttaccggttacggttaggtacccgggagggttaccgtactaacggccgttacccgacggttaccggacgtcgaacccgtacccggtacggcccgtccccgtcccggtgtaaccccg

SEQ ID NO: 75026 - DNA, 729 bp, Homo sapiens
  misc_feature: GYAE6OF01BP9VI.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctctcactctctgcacaggctctgacggcctccatgagtctgacacagtccaccgtcggtgtctgtcgtcctgaggacagacggcaaggctcactgctcgtaggcagtgctatacgaaaccaaaaatactatcgtacttacgtaggtaaccaggacgaaggaccggaccaacgggaccccgtaacggtccccgttggttccgtttagggtagttaacttttaaagtaaaacggtcgtttaaggacgacgggtacccctacggaaccgggtaccccgtaggaacgtcggtactttccgtacgtcggtcctaccggtaacgtccgtacggtaacggaacctaacgtacggttaccctaaccgttagaaccctaagttacggtacggttacgggaccgtaccggacgaacgggacgggaacgtacggtactacgtaactacggttaactcgtactacggtcgtacgaacgtacgacgtacgtaggacgtcgttaagttgtaggtccgttaggtacgggacgggtacggtactaaccggcgttaacccggtccggtaccgtaaccggtcgaaccggtacccgaaccggtcccgttcccgggtcccccgtggttaccccg

SEQ ID NO: 75027 - DNA, 683 bp, Homo sapiens
  misc_feature: GYAE6OF01BKEYW.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctcggtgtctgtcgtcctcgaggacagaccggccaggactcacctgctcgtggcgatgctattcgaaccaaaacatatcgtacttacgtcggtaccagacgaggacgccgacggccgacggtcccctgttcgttggtataatttaataagtcgttgacgaccggtcccgtacgacgggtaccctgacgtcgtacttcgtcgtcggtcctacgacgcgtacggacggaacctaacgtacgtacctaccgttacgactactacggtacggtcggaccggtaccggacgaagggtacggaacggacggtccgttaacgtaactttacgttacgtacgtaccgtacgtacccggtacacggtaccgaggtacggacggtcggtaagttacgttaggttccgttacggtaacggttcggggaacggtaccggtaccgtacgtccggtaccggacccggttcggtaccggtaccgaaccggtcccgtaacggtccctacccggtcccccgtacggtacccg

SEQ ID NO: 75028 - DNA, 700 bp, Homo sapiens
  misc_feature: GYAE6OF01DXNHS.49.20.B09.1.454.CMB.1.raw
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacgagctctgacgcctcctatcgagctgacactagtccacccgttggtcgttcgtcgttcgtccttacgacgtaaccgacgggaaccggccgtaaggtactaccgtaccgtgtccttccgngggtctacgtgccttaagttaccgaaaaccctaaaaanaattacgtacgttacgttaacgtacggtaacgacgacgacggacgcgaccggccgcgtccgtgttcgtagtagttaatttaagtacgttacgtacgacggtccgtaccgtacggacgtccgtagtacgtcgtcttcgtcgtcgtcctacgacgtacgtacgaacgactaacgtcgtacctacgtacgacgtacgtacgtaggtacggtaccggtacggacgaacggacggtacgacgtacgtactaacgttacgttacgcgtacgtaccacgagacgacgacgtacgtagtagtacgttaagttcgtcgtaacggtacgggacggtacggtacgtacgtaccgtacgtaccggtacggttacgaccgacgacccgtaccgtacggtacccgtcccgtcccgttcgtcccg

SEQ ID NO: 75029 - DNA, 724 bp, Homo sapiens
  misc_feature: GYAE6OF01EN3H8.49.20.B09.1.454.CMB.1.raw
  modified_base (513)..(513): a, c, t, g, unknown or other
  misc_feature (513)..(513): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtcacccgtggtgtctgtcgtcctcgaggacagacggccaggactcacctgctcgtggcgatgctattacgaccaaaaacaatatcgtcctttacgtcggtaccagcagacggccgacggccgacggcccctgttcgttggtgtaatttaagaaacgactactgagacggcccctagacgggactcccgtgaggtacgtactttccgtcgtcggtccctacccggtacgggtaccggaacggggaacctaaaccgggtcctaaccgtagttacggaccctagttacgtagggtcggtaaccgtccggaaggccggaaggacgggacggaggctacgttaatttaagtttntttacggtaacaacgttacaaaccgtacgaaccctaacgtttaagtttaccggtttaatttacgttacggtttaccgtttacgggaaaccgtcggtaaccccggtaaccggttaaccggtcccggttacccgtacccgggttagggccccgtaaaccacccccgggtaaacccgaccccctaaaccccgtgttccccgtacttacccccgg

SEQ ID NO: 75030 - DNA, 707 bp, Homo sapiens
  misc_feature: GYAE6OF01CD7P1.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggccctcctatgagctgacacagtccaccctggtgtctgtcgtcctcgaggacacgacggccaggactcgacctgctcgtggcgatgctattcgaaccaaaactatatcgtaccttacgtcggtaccagacgaaggacggccgacggccgaccggtccccttgtcgttggtagttaatttaagtaaagtacgtttgaacggtaccggtcccgtacgtaccgggacccctaggacgtaccgttacttccgtcgtccggtcctaccgacgtacctacggaacggtaaccaacgtacgtaccctaacttacgacctacgtacgtaggtacggaccggtcccggacgaacgggacggacggacggtctacgtacttaacgttacgtacgtacgacgtccgaacgacgagtacgacgtacggtacgtacgtagtttacgtacggttacggttacggttaccgggacgggtacggtaccggtaccggtcggtacccggtacccggttaccgtacgggtaccacccggtacccggaaccggtccccgtccccggttccccggttcgtacccg

SEQ ID NO: 75031 - DNA, 726 bp, Homo sapiens
  misc_feature: GYAE6OF01EL6XW.49.20.B09.1.454.CMB.1.raw
  modified_base (81)..(81): a, c, t, g, unknown or other
  misc_feature (81)..(81): n is a, c, g, or t
  modified_base (129)..(129): a, c, t, g, unknown or other
  misc_feature (129)..(129): n is a, c, g, or t
  modified_base (188)..(188): a, c, t, g, unknown or other
  misc_feature (188)..(188): n is a, c, g, or t
tcagagtcgagagacacgaccggtgctcgatttagtgtagtgtgaagggggctgtgggtccaggaggcagaactctgggtntctcaccatggcctggatccctctacttcctccccctcctcactctcngcacaggctctgagcctcctatgagctgacacagtccacccgtggtgtctggtgtcctnaggaccaggaccggccaggacttccacctgccttcgtgggacgatcgcctaattccgaaacctaaaaacgattagtcgtacttaacgtcgtacagacaggacggaccgacgccgacggtccctaggttcgttggtagttaatttaataaacggttactttaggacggtaccgtcccgtacgaacccgggtaccccgtaggacgtccgttacttccgtcgttacggccttacgaacgtccgtaacgaggaaccaacgtaccgtcctaaccgtacgaactacgcgaggtacggtaccggtacccggaaccggagggtaacggaacggacgtacggtacttaacttaacgttcggttcttacggaccgtcgacggacgtaacctggaaccgttggtacgggtaactttagggttacgtcggtttaaccggtcggtttacggggacggggtaaccgggtacctaccggttccgtaaccggcccggttacgtcgtaacgaacccgtccgtaacggaccttccccggtcccttaccgttacccc

SEQ ID NO: 75032 - DNA, 797 bp, Homo sapiens
  misc_feature: GYAE6OF01DII4Y.49.20.B09.1.454.CMB.1.raw
  modified_base (81)..(81): a, c, t, g, unknown or other
  misc_feature (81)..(81): n is a, c, g, or t
  modified_base (129)..(129): a, c, t, g, unknown or other
  misc_feature (129)..(129): n is a, c, g, or t
  modified_base (232)..(232): a, c, t, g, unknown or other
  misc_feature (232)..(232): n is a, c, g, or t
  modified_base (250)..(250): a, c, t, g, unknown or other
  misc_feature (250)..(250): n is a, c, g, or t
  modified_base (768)..(768): a, c, t, g, unknown or other
  misc_feature (768)..(768): n is a, c, g, or t
tcagagtcgagagacacgaccggtgctcgatttagtgtagtgtgaagggggctgtgggtccaggaggcagaactctgggtntctcaccatggcctggactccctctacttcctcccctcctcactctcngcacaggctctgacggcctctagtgacgctagacactaacgtcctaccgttcggtgttctcgttcgtcctagacggacgacggaccggaccgaggtactaccncctcgtcctcggtcgggntatcgcctaattaccgaaaacaaaaactattacgtacggtaccttaacggtacggtaaccgacggacgaagggaccggaccggaccggaccgtccggtcccgttggttaccgttaggttacgttaagtttaaacgtaaacgttacgttacggaacggtaccggtacccgtacggtaaccgggacccgtaggacgtacgttattccgttacggcggttaccgacgggtacggtaacgggaaccggtaaacggtaaccggtacgtaaaccggttacggtaccgacgttaaactcgggtacgggttacggaccggttacggaacgggcggaaagggtacggacggtacgtaccgttagtaactttagttacggttactaacgaactaaccgaacgaccgtaacttacggttacgttcgtttaacgttacgtacggtgttaccgtacgaccggtaacgaacccgtcgaccgtacgtccgggtaggtaacccaccggtaccgaacccggtaccctaacccggntttacccaccggttctcccgggttacccc

SEQ ID NO: 75033 - DNA, 812 bp, Homo sapiens
  misc_feature: GYAE6OF01B5RNS.49.20.B09.1.454.CMB.1.raw
  modified_base (177)..(177): a, c, t, g, unknown or other
  misc_feature (177)..(177): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtntctgtcgtcctcgaggacagacggccaggctccacctgctcgtggcatgctattacgaccaaaacatatgtccttacgtacggtaccagacgaaggtaccggccgacggcccggaccggtaccccttcggttccgttagggttagttaagttttaaacgtaaaacggttacgtttacggacggtaccgggtaccccgtacggtaacccggggtacccccgtaggaccggtacgtacgtttccgtcggttcgaccgtcccgacgtccgtaccggaacgggtaaccaacgtacggtacccttacccgttagaaccctagtaccgtaacggggttaccgggtaaccgggttccccggaaccgtaacgggggaacccgggtaacgggaacggtttccggtaccgttaaacgtttaaccgtttaccgttcggtaccgtaaccgggttcccgacgtaaacggaccgtacggtaagtacgggtacgggtacgtaacggtttggtcggtttacggttacgggttaccggggaccgggtaccgggtaacgtaccgggtcgttacccggtaccggttaccgtaccgggtaccgacccggtacccggaccggtacccgttccccggtccccgtcccgggttacccg

SEQ ID NO: 75034 - DNA, 753 bp, Homo sapiens
  misc_feature: GYAE6OF01E3NA8.49.20.B09.1.454.CMB.1.raw
  modified_base (221)..(221): a, c, t, g, unknown or other
  misc_feature (221)..(221): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacgcctcctatgagctgacacagtcaccctggtgtctgtcgtcctgaggacaggaccggccaggactccacctgaccttgnggcatcgacctattcgaacccaaaatatacgtcgtccttacgttcgtaccgagacaggacgaccgacggtccgaccggcccctgtccgttggtgtaactttaagtaaagtctttaggaaggccggtaccctaggtaacccgggaccccgttaggacgtaccggtacttttccgttacgttccggtccctaccgtacgtaccgtaacggaaccggggtaaccaaacggtaaccgttacccgtaacccttacggtaaaccctagttaccgtaggttccgggaaccggttacccgggaccgaacgggtacgggaacgggtacggtacgttacgtaaccttagtttacctacgttaccgaccggtaccacgagacgacggtacggaggtcggtactaggttacgttacggttaccgtttaggtccgggtacgggtaaacggtacgtaccgtccgttacggtaacccggttacccggtacggtccgaacccggtacccgtaccggtcccgttccccggccccgttccggttaacccg

SEQ ID NO: 75035 - DNA, 836 bp, Homo sapiens
  misc_feature: GYAE6OF01BXH80.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgacggcctcctatgagctgacacagtcaccctggtgtctgtgtcctcgaggacagaccggccaggactcacctgcctcgtggcgtatcggactaagttcggaacccaaaaactaagttacgtcggtacctttaacgtaccgggttaacccgaacgtccgaacggtacgggacccgaaccgggacccgtaaccggggtcccccccgttggtttacccggtttttacggggttagttaaacgtttttaaacgttaaaaaacggttaccgtttttacgggaaacggtacccgggtaccccttacggaaacccggggttaccccctggtaacgtcgttaacgtttccgtcgttcgggccttccgagtcctacgtagggaacctaaacgtacgtaccctaccgttacgaacctacgttacgaggttcggaccggtcccgggacaagggacggtaaccggaggtacgttagtaaccgttaagtttaccgtacggttaccgtaacggtccgtacgtaacggaacgtacgtaccgaagggttcgtacgtaaagtttcggtacgttacggttacggttcggggtaccggaacggggttaccttaccgggtaccgtttacggtaaccccggttcggtaaccggtacccggtaaccggtccccgtaaagggcccccgtttaacccggtccccccgttacgggttacccc

SEQ ID NO: 75036 - DNA, 734 bp, Homo sapiens
  misc_feature: GYAE6OF01EAZI8.49.20.B09.1.454.CMB.1.raw
  modified_base (601)..(601): a, c, t, g, unknown or other
  misc_feature (601)..(601): n is a, c, g, or t
  modified_base (609)..(609): a, c, t, g, unknown or other
  misc_feature (609)..(609): n is a, c, g, or t
  modified_base (617)..(617): a, c, t, g, unknown or other
  misc_feature (617)..(617): n is a, c, g, or t
tcagagtcgagagacacgaccggtgctcgatttagtgtagtgtgaagggggctgtgggtccaggaggcagaactctgggtgtctcaccatggcctggactccctctacttcctcccctcctcactctctgcacaggctctggacggtcctcctatgagctgacactacgtcctacccgttcggtgttcgttcgttcgtcctcgaggacacgggaccggccgaaggtactccacgttcgcgtcgtggcgtatcgactacttacgaaccaaaactagtacgtcgttaccttacgtacggtaaccaggacgaacggacgtaccgacggtacccgaccggttccccgttaggtttccgttagggttacgtttaactttaaagttaaacggtcggtttacggaacggtccggtacccgtacggtaccggtaccgtgtaaacgtcgttacttcgtacgtcggtcctaccggtacgcgtacggaacgggtaacctacgtacgtaccctacgtaccgaactacgtaggtacggtcggaacggtccgacggagggaacggacgagggtctaacggtactttaccgtagtcgtacgccgtcgacagacgancgtacggngtacgttnttagcgttcggtacggtcgggtagggtaccgtaccggtcggtaccgttaccggttaccggttccgaccgccacccgggtaacgtccggacccgttccccggtcccgtagttaccccg

SEQ ID NO: 75037 - DNA, 755 bp, Homo sapiens
  misc_feature: GYAE6OF01ETG4O.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctggaggcctcctatgagctgacacagtcaccctggtgtctgtgtcctcaggacaggacggccaggatcacctgctcgtggcgatgcattgaccaaaacatatcgtacttacgtcggtaaccagcaagacgccgaggccacggtccccttggttccgtttggtagtaactttttaagtaaaacggtacttttaggacgtacggcccttacgaccgggacccctagacgtcgtatttccgtcgtacggtcctccgagtccgtagaaccggggaacaaacgtacgtaccttacgttaccgacgtaactacgtaggtacggtaccgtcccggaccgaaggggaacggaaccggaggtccgttacgtaacttaacgtttaccgttcggtactaccggtcccgtacgaacggaacgtacgtaccgtaggttacgggtacttaacggtttaggtttaccggtacggtttaagttaccgggggaccgggttaaacgggtaacccgtttaacggccgttaacccggggtacccccgtttaccccggttaagggtcccgaaacccggttaaccccggaacccgggttacccgttccccccgggttaccccgttcccgggtttacccc

SEQ ID NO: 75038 - DNA, 658 bp, Homo sapiens
  misc_feature: GYAE6OF01B0RHK.49.20.B09.1.454.CMB.1.raw
  modified_base (174)..(174): a, c, t, g, unknown or other
  misc_feature (174)..(174): n is a, c, g, or t
  modified_base (439)..(439): a, c, t, g, unknown or other
  misc_feature (439)..(439): n is a, c, g, or t
tcagagtcgagagacacgaccggtgctcgatttagtgtagtgtgaagggggctggtgggtccaggaggcagaactctgggtgtctcaccatggcctggatccctctacttctcccctcctcactctctgcacaggctctgaggcctctatgagctgacacagccaccctcggtntcagtcgtcccaggacagacggcaggactcacctgctcgtggagatgctagttcgaccaaaacgatagtgacttattggtaaccagacaagaacggccgggaccgacggccccttaggtgttcggtgtagtacgtaataaacgacactaggagtacggaccctagaaggactcccgtagaagctattcctcgtggtctccgtaaggtccgaaggtaaccgaacggtacaacgtagttcggactagttcgaagtggacgtcgaagngaaggacggagacggactaggtaactttattagttacgactaaatccaaacacgtaaccaaccgtaagtttaccggttaaatttaacgttcggttaccgtttaacggaaccgttggtaacccgtaaccgtaaacgggttacccaaccggttaccgtagggtaccctaaccgaacccgaaacggtaccccaaccccgttactacgtccgtaccttacccg

SEQ ID NO: 75039 - DNA, 709 bp, Homo sapiens
  misc_feature: GYAE6OF01CJHWN.49.20.B09.1.454.CMB.1.raw
  modified_base (115)..(115): a, c, t, g, unknown or other
  misc_feature (115)..(115): n is a, c, g, or t
  modified_base (187)..(187): a, c, t, g, unknown or other
  misc_feature (187)..(187): n is a, c, g, or t
  modified_base (199)..(199): a, c, t, g, unknown or other
  misc_feature (199)..(199): n is a, c, g, or t
  modified_base (259)..(259): a, c, t, g, unknown or other
  misc_feature (259)..(259): n is a, c, g, or t
  modified_base (406)..(406): a, c, t, g, unknown or other
  misc_feature (406)..(406): n is a, c, g, or t
  modified_base (513)..(513): a, c, t, g, unknown or other
  misc_feature (513)..(513): n is a, c, g, or t
  modified_base (521)..(521): a, c, t, g, unknown or other
  misc_feature (521)..(521): n is a, c, g, or t
  modified_base (681)..(681): a, c, t, g, unknown or other
  misc_feature (681)..(681): n is a, c, g, or t
tcagagtcgagagacacgaccggtgctcgatttagtgtagtgtgaagggggctgtgggtccaggaggcagaactcgtgggtgtctcaccagtggcctggactccctctacttccncccctctcactctctgcacgtaggctcgtgacggtcctctatgacgctagacactacgtccacccgttggtntctgtcgtaccngaaggacaggaccggctaggctccactgctcgaggacagtcgctaatcaaacctaaaatntacgtcgtacttaacggtggaaccagacgacggacggaccgacggtccacggtcccgtgttcgttggtattaatttaaccgaaagttcgttaggagaccggtcctacggaccggacccgtgacggctactttcgcgtggcctccggntaccgaggaacggaacctagtacgtacctacgtacgacctagttacgacggtacggtacggtcccggaaggtaaggacggacgttagtactacgtaatacgtttacncgggtacncggtacccgagaacgacgtagaccggaggttgtaccgttaaagtcggttactacgggttaacggtcgggacggtaaaccggtaaccgttccgccgggtttaaccgggaccctttaaccggaccgggttacaaccgggtaccccgaaaccgggtttacccncccccgggaacccgttttcgggaacccc

SEQ ID NO: 75040 - DNA, 740 bp, Homo sapiens
  misc_feature: GYAE6OF01DRZEN.49.20.B09.1.454.CMB.1.raw
  modified_base (171)..(171): a, c, t, g, unknown or other
  misc_feature (171)..(171): n is a, c, g, or t
  modified_base (188)..(188): a, c, t, g, unknown or other
  misc_feature (188)..(188): n is a, c, g, or t
tcagagtcgagagacacgaccggtgctcgatttagtgtagtgtgaagggggctgtgggtccaggaggcagaactctgggtgtctcaccagtggcctggatccctctacttcctccccctcctcactctctgcactggctctgacgtccctacctatgacgctacgacaacncgtccacccgttcggtntctgtcgtcctcgaggaccagaccggccaaggactccacctgctcgtgcgatgacctatacgaaaccaaaaacgtattcgtattccttacgtacgtaccaggcacggacgaccgcgaccgaccgtcccgttcgttcgtaggttgttaaattaacgttaacgttacgttacgaacggaccggtacccgtaccggtaccgggtaaccccgtacgttaacggccgttacgtttccgacgttacgtcctaacgtacgttccggtaaccggaacggaactaaaccgggtcttaaccgaccgttaaccgaccgtaactacggtacggtacgggtaccgaccggagtaacggaggacgtaacgtcgttaacgtcgtttacgttaactcggtaactccggaccgtaccgtaagctaacggtggtaaccgttggtaaccgtttaggtacttacgggttacggttccggtaaacgggccgggtagtaccgtccgtacgtaacccgttccgtacggtcgtaccgacgtacccgacgttcccgtacccgtcccggtcgttaccg

SEQ ID NO: 75041 - DNA, 722 bp, Homo sapiens
  misc_feature: GYAE6OF01CAMSG.49.20.B09.1.454.CMB.1.raw
  modified_base (259)..(259): a, c, t, g, unknown or other
  misc_feature (259)..(259): n is a, c, g, or t
tcagagtcgagagacacgaccggtgctcgatttagtgtagtgtgaagggggctgtgggtccaggaggcagaactctgggtgtctcaccatggcctggatccctctacttcctcccctctcactctctgcacaggctctgacggcctctatgagctgacacagtccaccgtcggtgtcgtgtcgtccgtacgaggacacggacggaccgaaggactccaccgtgacttcgcgggcagtcgactagttacaaacctaaaanaagttacgtcgtaccgtttaacgtacggtaccaaggaccgaagggtaccggccgacggccgtaccggtccccgttaggtcggtttacggttaagtatttaaacgtaacgtacgtttaagacggaccgtaccgacggaccgggtaccctaggtacgtaccgttacgttaccgtcggttaccggctaccgaccgtacgtacggaacggaacctaacgtaccgtacctaaccgtacgacaaggtacggtaggtacgggtccgaccgacggaaggaacggacggtacgacgtagtaactacgttacgttacgtaccgtacgtaccgagacgacggagacggtacgcggtacgttagtacggttccgtacggtaccggttacgggacgggtaccggtacgtccgccgtacgacccggttggtacggaccgtacgacccggtgaccccgttccgccccggttgtacccg

SEQ ID NO: 75042 - DNA, 814 bp, Homo sapiens
  misc_feature: GYAE6OF01DIKUR.49.20.B09.1.454.CMB.1.raw
  modified_base (653)..(653): a, c, t, g, unknown or other
  misc_feature (653)..(653): n is a, c, g, or t
tcagagtcgagagacacgaccggtgctcgatttagtgtagtgtgaaggggctgtgggtccaggaggcagaactctgggtgtctcaccatggcctggatccctctacttctcccctcctcacctctctgcacaggctctcgacggcctctatgagctgacacgagtcaccctggtgtctgtgtcctgaggacagacggccaggactcactgctgtggcgatgctattacgaaccaaaaactattagtacggtaccttttaacgtacgggtaaccaaggaccgaaacgggaccggaccgaacgggaccccgtaaccggtccccccgttggtttaccggtttaggggttaacgttaaaattttaaccggtaaaaaggttaccgttttacgggaacggtaaccgggtccccttaacggaccgggtaacccctgggaacgtcggttaactttcgtccgtacggtaccctaccgacggtacctacggaaacgggaacctaaacgtaccgtttacctaccggtttacgaaaccgtacgttacggtaacggtacgggtacccggtaacccgggaccgaaggggtaacgggacggtaacgggtacttaccgtaaacgttttacgttaacccggttacgtacccggtaaggttaccccggaanaacggtactaacggtcggtaaacggttcggtaacgtacggtttacttacgggttacgttacggttacgggacgggtacggttacaccggtaccgtacggtaccgtaccggttaggccctaacggacccgaacggtccctacccggtcccccgtgtaccccg

SEQ ID NO: 75043 - DNA, 645 bp, Homo sapiens
  misc_feature: GYAE6OF01CJPKJ.49.20.B09.1.454.CMB.1.raw
  modified_base (280)..(280): a, c, t, g, unknown or other
  misc_feature (280)..(280): n is a, c, g, or t
  modified_base (428)..(428): a, c, t, g, unknown or other
  misc_feature (428)..(428): n is a, c, g, or t
  modified_base (441)..(441): a, c, t, g, unknown or other
  misc_feature (441)..(441): n is a, c, g, or t
  modified_base (444)..(444): a, c, t, g, unknown or other
  misc_feature (444)..(444): n is a, c, g, or t
  modified_base (462)..(462): a, c, t, g, unknown or other
  misc_feature (462)..(462): n is a, c, g, or t
  modified_base (481)..(481): a, c, t, g, unknown or other
  misc_feature (481)..(481): n is a, c, g, or t
  modified_base (486)..(486): a, c, t, g, unknown or other
  misc_feature (486)..(486): n is a, c, g, or t
  modified_base (533)..(533): a, c, t, g, unknown or other
  misc_feature (533)..(533): n is a, c, g, or t
  modified_base (564)..(564): a, c, t, g, unknown or other
  misc_feature (564)..(564): n is a, c, g, or t
  modified_base (572)..(572): a, c, t, g, unknown or other
  misc_feature (572)..(572): n is a, c, g, or t
  modified_base (586)..(586): a, c, t, g, unknown or other
  misc_feature (586)..(586): n is a, c, g, or t
  modified_base (614)..(614): a, c, t, g, unknown or other
  misc_feature (614)..(614): n is a, c, g, or t
  modified_base (639)..(639): a, c, t, g, unknown or other
  misc_feature (639)..(639): n is a, c, g, or t
tcagagtcgagagacacgaccggtgctcgatttagtgtagtgtgaaggggcgtgtgggtccaggaggcagaactctgggtgtctcaccatggcctggatcctctacttcctcccctcctcactctctgcacgaggtctctgaggtcctcctagtcgacgctacgactacgtacgtccacccgtggtcgtctgtcgttcctcgaggacgacgccggacgagggactccgaccgtgcctggtcggcgtatacgactacgttacgaaacaaaacacttacgtntactttacgtcgtaaccagacacggacgaccgaccggaccaccggttcccctggtttccgttaggtagttaacttaacgtaaacggttcttaggacggtacggtccgacgtaccgggacctggaccgacgtactttcgcgtcgctccnggactggacgganacncgtacaccgttacactancgtaggtacgcgtacccgnacggngtaaccggagcgtaacgtacttacgttacacgtcgtaacgccgtaanacgtacggacgagtaggtacggtctttaaangtttacgnggtacgttacgggnggtaacgccgtacgtcgtaacgcgtcgngtacccgagtcacgccgtctcccgntacccg

SEQ ID NO: 75044 - DNA, 931 bp, Homo sapiens
  misc_feature: GYAE6OF01EMFDW.49.20.B09.1.454.CMB.1.raw
  modified_base (172)..(172): a, c, t, g, unknown or other
  misc_feature (172)..(172): n is a, c, g, or t
tcagagtcgagagacacgaccggtgctcgatttagtgtagtgtgaaggggctgtgggtccaggaggcagaactctgggtgtctcaccatggcctggatccctctacttctcccctcctcactctctgcacaggctctgagcctctatgagctgacacagtccacccgtggtntctgtacgtcctcgaggacacggaacggcctagggactccaccgttgccttccgtggggacctattggaccagttcgaaccaaaaaactagtacttacggtacctttaccggtacggtaaccacggaccgaaggtaccggaccgtaaccggggaccctaccgggtcccccgttcggtttacgtttaggggttacgttaaacgtttttaaaggtaaaccggtttacgttttacgggaaccggtaccggtccccgttaccgggaacccggggtaccccttagggaacgttacgtacctttccgtcgtacggtaccctccgtaacgtccgttacggaaccgggtaactaaccgtaccgttacccgtaaccgtttacggaaaccctttaacggttaccggtaacgggttccgggtaaccccgggttcccgggtaaccggtaacggggaaaccggggttaaaccccggaggggttacccgtttaaaccggtaaccgttttaacggttttaaccgtaccgggttaccgggttaacccgggttaccgtaaccgaaccgggttaacggaaccggtaaccgtacgggtacgggtaactttacgggtttaacgtccgggttaacgttaccgggtcggggtaaccgggtaccgggttacccgtaaccgggttcccgtaccgggttaacccggttccgtaaccggtacccgggaaccgtaccccgggtaccggaccccgttttaccccgggccccccggttggttaccccg

SEQ ID NO: 75045 - DNA, 798 bp, Homo sapiens
  misc_feature: GYAE6OF01C1CQV.49.20.B09.1.454.CMB.1.raw
  modified_base (267)..(267): a, c, t, g, unknown or other
  misc_feature (267)..(267): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacgcctctatgagctgacacacgtccacccgtcggtgtcttgtctcctcgacggacaaggaccggccaggactccaccgtgccttacgtgggactagtcgactaacttccggaaaccctaaaacgtntttaagtcgttacgtttacgttacggtaaccgaggaccgaaggaaccggcccgggccgtaccggtcccgttaggttgggtttaggtagtagttaagtaaacgtaaacggacgtaacgtaggaacggtaccggtaccccgttaggacgggtacctcccggtaggtacgtaacgtcgtttcgtcgttcggactaccggtaggacggaacggtaacctacggtacacggtacgtacgcctagtacgtaggtacggtacgtacggacggagacgggaacggacgggtacgtcgtaacgttacgttttaacgtttacgttaccggtaactaaacggtaacctaaacgtacgtaaaccgttacccgttaaggttttaccgtaagtttacgttacgggtttaccgaaccggttaacgaccgggtaacccgtaacggttaaccgggttacccgtaccccgggttacggttcgaaccccggtaccgaaccccggtaaccgtaaacccccaccgtttacgtacccggttcctaacccccgg

SEQ ID NO: 75046 - DNA, 781 bp, Homo sapiens
  misc_feature: GYAE6OF01AYVRQ.49.20.B09.1.454.CMB.1.raw
  modified_base (227)..(227): a, c, t, g, unknown or other
  misc_feature (227)..(227): n is a, c, g, or t
  modified_base (249)..(249): a, c, t, g, unknown or other
  misc_feature (249)..(249): n is a, c, g, or t
tcagagtcgagagacacgaccggtgctcgatttagtgtagtgtgaagggggcgtgtgggtccaggaggcagaactctgggtgtctcaccatggcctggatccctctacttcctccccctcctcactctctgcacaggctctgaggcctcctatgagctgacacagtccaccctggtgtcagtcgtccccgaggacacgaccggccaggactccacctgctcgtgganattgctattcaccaaaccgatntagctttattcggtacagtcaagaacggccggccacggcccctaggtcgttggtagtatagtaagtaaagacctgtagaagacggccctagaacgggtactcccgtaaggagtcgtaacgtttcgtcgtcggtccctcggtaacgtaccggaacggtaaccgtaaccggtacaccgtagtttaccggactaactacggtacggtaggacgtacccgtaaggacgaacgggaaccgggaaggaaccgggtacgacggtttaactttaaggtttaactttacggtaacctaatttaacccgaaacgtaaccgtaaccctaacgttaaggtttaaccggtttaaccgtttaacgtttcggttaccgttaaacccgggtacggttaaaccgtaccgggttaaacccgaaacgggtaacccccgttaccgggtttaccccggacggggtttaaccccgaacccggtaacccctaacccgggtaaaccccctaaccccttaccggttacccgtacccgttaacccctttaacccccgg

SEQ ID NO: 75047 - DNA, 533 bp, Homo sapiens
  misc_feature: GYAE6OF01BM6BH.49.20.B09.1.454.CMB.1.raw
  modified_base (233)..(233): a, c, t, g, unknown or other
  misc_feature (233)..(233): n is a, c, g, or t
  modified_base (291)..(291): a, c, t, g, unknown or other
  misc_feature (291)..(291): n is a, c, g, or t
  modified_base (423)..(423): a, c, t, g, unknown or other
  misc_feature (423)..(423): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
tcagagtcgagagacacgaccggtgctcgatttagtgtagtgtgaaggggctgtgggtccaggaggcagaactctgggtgtctcgaccatggcctggatccctctacttctccccctctcactctctgcacaggctctgaggcctcctatgagctgacacagtcaccctggtgtctgtgtcctcaggacagacgcctaggatcacctgctctggcatgcattcgaccaaaaanagtatcgcttagtcggtaccagcagacgccagccacggcccctgtctggtgtatttanaagtctttgacgacggtccctcgacgggtacccctgacgcgtacttctcgtggacctcgacgtcacgagggacaacacgtcacttcgacctatcagtcgacgtccgacagaggtacgagtcagactattacngactacgtcgnagacngtacgagtgactagttangttacgtacgtcgggnggtacgacgtacgcgtacgaccgtcgtacgacacgccacggcctaccgccccgtggtccc

SEQ ID NO: 75048 - DNA, 795 bp, Homo sapiens
  misc_feature: GYAE6OF01E523O.49.20.B09.1.454.CMB.1.raw
  modified_base (160)..(160): a, c, t, g, unknown or other
  misc_feature (160)..(160): n is a, c, g, or t
tcagagtcgagagacacgaccggtgctcgatttagtgtagtgtgaagggggctgtgggtccaggaggcagaactctgggtgtctcaccatggcctggactccctctaccttcctccccctcctcactctctgcacaggctctgacgtcctctatcgagcncgacacacgtccacccgtcgtgtctgtcgtcctacgacggacacgaccggcgaggtactccacctgtctcgtcggcgtatcgactagttaccaaacctaaaatattacgtcgttacgttaacgttacgtaccgacgacgaacggaccggccgggaccgtaccggtcccgtggttgttggtagtagtaagtaaacgtaagacgtacgtacggacggtccgtaccgtacggacggtacctcgtacgtacggtacgttcgttccgtacgtcggtaccgtacgggtacggtacgggaacgtaaccggtacgtacgtaacgtcggtaccgtacgtacggtacggtacggttacgggaccgtaccgggaacgggtacggaacgggtaacgggacgggttaaccgtaacggttagtttaaacgtttacgtttaacgttaaccgttacgaaacctaaccgaaccgttaacgaaccttaacgttagttaacgtttacgttacgttacggttacgtaaccgtacgtaccggtaaaccgtaaccggttaccgtaccccgggtacgtttacccgggaccggtaaccccgaccgaaacccccggtaaccccgaccccgtaacccttccgtacccgttcccgttacccc

SEQ ID NO: 75049 - DNA, 700 bp, Homo sapiens
  misc_feature: GYAE6OF01D7M63.49.20.B09.1.454.CMB.1.raw
  modified_base (408)..(408): a, c, t, g, unknown or other
  misc_feature (408)..(408): n is a, c, g, or t
  modified_base (678)..(678): a, c, t, g, unknown or other
  misc_feature (678)..(678): n is a, c, g, or t
tcagagtcgagagacacgaccggtgctcgatttagtgtagtgtgaaggggggctgtgggtccaggaggcagaactctgggtgtctcaccatggcctggatccctctacttctcccctcctcactctctgcacaggctctgaggcctcctatgtgttgacgcagccacctcggtgtccgtcggccccaggacagacggcctaggtttcccgtgtcggagggacaaacaaactagtttgggtagggtaaaaggtgtgactacgtcggtaaccagacaaggaacgccgaaggccaacgggtccccgtgttacggttcggtcgtaccatcgagtgaacgagacggacccggtcctacgaggtactcctaggagcgttattttcgaggtcctacaaaggtcgtacggaaaccncgaccctaccgtcggacccgtacgacgacgacggggtaccgaaacgggccggggaatacgggaacgggtaccgtaacgttaacgttaacgtcgttaggttacgagggtttacgggtagggtaagttaaggttaggtaggtcgtacggttccggttcgggggttggttccggggacgggtaacggacggtaacgttacgggacgttcggttggcctacggacccgtaaggccgtcgccccgttcgggtcctacgtcgttccgtaccctccnccgttctctactcgtctgtcgg

SEQ ID NO: 75050 - DNA, 609 bp, Homo sapiens
  misc_feature: GYAE6OF01A1D1V.49.20.B09.1.454.CMB.1.raw
  modified_base (459)..(459): a, c, t, g, unknown or other
  misc_feature (459)..(459): n is a, c, g, or t
  modified_base (491)..(491): a, c, t, g, unknown or other
  misc_feature (491)..(491): n is a, c, g, or t
  modified_base (507)..(507): a, c, t, g, unknown or other
  misc_feature (507)..(507): n is a, c, g, or t
  modified_base (593)..(593): a, c, t, g, unknown or other
  misc_feature (593)..(593): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgctattgaccaaaacaatatgtcttactggtaccagcagagccaggccacggtcccctgtcgttggtacgtaattttaagtaaacgtacgtttaggacggtaccggccccttacgaaccgggtaccccctaggacggtcgtacttccgtacgtcggtcctccgagctacgacggtaacaactacgtacctaccgttacgacctagtccgaggtcggacgtccggacgaaggcggaacgnggactagacttattacgtcgtcaccggtccgnacgacgagacgtaggngtactagtttagtcggtacgtagttccgggacggtaaggtaccgtagtcgtaggtacccgtcgtaggtccacggcccgtaaggccnccgtccccgtgtcccg

SEQ ID NO: 75051 - DNA, 720 bp, Homo sapiens
  misc_feature: GYAE6OF01DT9CM.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtcgtcctcgaggacaggaccggccaggactccacctgctcgtggcgatgactattacgaaccaaaaactatatcgtaccttaacgtaggtaaccagtcgaaggacggccgacggcccgacggtcccccttggttccgtttagggttagttaaattttaacggtaaaagttaccggttttaggaaccggtacggtcccctacgggtaccgggtacccctggaacgtcgtactccgtcgtcgctacgcgtcgtacgaacggaactaacgcgtaccctaccgttacgaacctagtacgtacggtacggaccgtaccggacgaacggacggacgacgtacgtacgtacttaagttactcgtacgtacgtccgacgaacgacgacgacgtacggtaggtacttagttacgttacggttacggttacggttaccgggacgggtaacggtacgtaccggttccggtacgttaacccgggttacgtaccggttacgacccggtaccggtaaccggtcccgtaaccccgtcccccggttcgttaccccg

SEQ ID NO: 75052 - DNA, 869 bp, Homo sapiens
  misc_feature: GYAE6OF01APN5B.49.20.B09.1.454.CMB.1.raw
  modified_base (81)..(81): a, c, t, g, unknown or other
  misc_feature (81)..(81): n is a, c, g, or t
  modified_base (244)..(244): a, c, t, g, unknown or other
  misc_feature (244)..(244): n is a, c, g, or t
tcagagtcgagagacacgaccggtgctcgatttagtgtagtgtgaagggggctgtgggtccaggaggcagaactctgggtntctcaccatggcctggatccctctacttcctccccctcctcactctctgacacgaggctctgaggtccctcctatagagcgtagacacacgtccacccgttgtgttcgtgtctcctagacggacacggaccgaccgaagactcccgactgactcgtggacgtntacgactagttaccgaaacctaaaagtattatacgtaccgtaacgtacggtaaccacgacgaaggacggaccgtacggacccggaccggttccccgtgttccgtttagtaagtttaacgtttaaagtaaacgtttacggttaggaaccggtacccggttaccccgacgggtaacccgggtaccgttacggtaacgtaccgtttacgttccgtaccgtaccggtacccgttcgacccgtaagtacgggtaaccggaaacctaacggtacctacctaaccgttacgacctacgtacggcgttacggtaccgggaccgtagaacgtacgggacgaacgtcgtaccggtaacttaccgtacgtcgtaaccgtaccggtacgtaacgaccgacgtacggacgttaaggttcccgggaaatttttaccggtacggttaggtacccgttttacggggtaacccggtacgggggttaaaccggtttacccgtacgggttacccggtttaaccgggacccccgttttaaaccggggtaacggtaccccccggtaacggttaaaacccccggggttccgggtccccccgttttaaacccccccggggtacccggtttccccggtaaaccccccgg

SEQ ID NO: 75053 - DNA, 900 bp, Homo sapiens
  misc_feature: GYAE6OF01EGQKF.49.20.B09.1.454.CMB.1.raw
  modified_base (175)..(175): a, c, t, g, unknown or other
  misc_feature (175)..(175): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctggacgcctctatgagctgacacagtccaccctggtntctgtgtcctgaggacacggacggccaggatcacctgcctcgtggacgtatcgactattacgaacccaaaaacgtattacgtcgtactttaacgtacggtacccgagaccgaaggtaccggaccgtaacgggccccgaccgggttcccccgttggtttacgttcgggtaattaacgttttaaagtaaaacggttcggtttaggaacgggtaccggtacccctcgggaaccggtaccccgtggtaccggtccgttacttcggtcgtacgggtccctacccgtaaggtccgtaacggtaaacgggaaccctaaacggtaccgtttaacccaaccgtttaccgaaacccttacggttaacccggtaacggggttacccgggtaacccggttaccccggggaacggtaaaccggggaaacggggtaaccgggtaaccgggtacggttaaccggttaaccgttttaaacgtttaaccggttccggttaaccggttaccgggtacccgtaaccggtaaccggtaacggtacgtaacgggtacggtacggggtactttaacggtttacggttaggttaccgggttacgggttaccgggggtacgggtaaccggttaccgtacccgggtaccgttacccgggttacccgggttaccgtaaccgggtacccgaacccgggtaccccggtaacggttccccgggttacccccgtccccggttacggttaaccccg

SEQ ID NO: 75054 - DNA, 731 bp, Homo sapiens
  misc_feature: GYAE6OF01EPKOZ.49.20.B09.1.454.CMB.1.raw
  modified_base (103)..(103): a, c, t, g, unknown or other
  misc_feature (103)..(103): n is a, c, g, or t
  modified_base (148)..(148): a, c, t, g, unknown or other
  misc_feature (148)..(148): n is a, c, g, or t
  modified_base (151)..(151): a, c, t, g, unknown or other
  misc_feature (151)..(151): n is a, c, g, or t
tcagagtcgagagacacgaccggtgctcgatttagtgtagtgtgaaggggctgtgggtccaggaggcagaactctgggtgtctcaccatggcctggatccctntacttctccccctcctcactctctgcacaggctctgagcctctanganctgacacagtccacccgtggtgtctgtcgtcctgaggacacggaccggcaggactccacctgctgtggcagtcgactatcgaaccaaaatatgtcgtctacgtacggaaccagcgacgaggccgacggccgacggtcccgttgttcgttggtacgtatttaagtaaacgtacgtttaggacgtaccggtacccgtacgaccggtaccctacggacgtcgtaccgttgtccgaggtcctcgacgtcgtaacgaacgggaactaacgtacgtacctaaccgttacgacctaacgtcgtaggtaccgggtaaccggtcccggaaccgaaggggtacgaaaccgggtacgggtaccgtaacgttaaccttaaggtttaaccgttaccggtaactaccggttaccggaccgtaacggaccaaggaacgtcggtaggggtaccttaagggtttacgttacgggttacgttccgggtaccgggtaagggtaccggtaccggtacgttacggttcccggaaccggttacggaccgggtactaccggttaaccgacggtaacccctcccggcccccgtcggttaccccg

SEQ ID NO: 75055 - DNA, 869 bp, Homo sapiens
  misc_feature: GYAE6OF01CML2X.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctctatgagctgacacagtccacccgtcggtgtctgtcgtcctcgaggacaaggaccggccaaggactccacctgcctcgtggacgatgctagttgaaccaaaaactattatgtaccgtttaactacggtaacccagacacggtaggaccgaaggacccgacggcccccttggttctttagggtaggttaaattttaacgtaaaacggttacttttaggaacggtaccgggtaccccttacggaaacccggggacccccttggaacggtaccgtaacttttcccgtcggttaacggggcccttacccgtaaacggtcccgttaacgggaaacggggtaaacccaaaaccgtaaaccggttccccttaaacccgtttaacggtaaccccgtaaagttccggtaacgggtttaaccgggacccgggttaccccgggtaaccccgtaaacggggaaacgggtaacccgggaacgggtaccgttaacggttaaccttaaacgtttacgttacgggtaaccgtaaccggtcccggtaacgaaacggtaccgaacggtaccgtaaggggtaccgtacgtttaaggtttacgttacgggttacgttaacggttccggggtaccgggacggggttaccgttaacgggtccgtacccggtaaccggtacccggtaacgttacccggaacgtacccggaaacggtccaccccggttcccccgtacggttaccccg

SEQ ID NO: 75056 - DNA, 703 bp, Homo sapiens
  misc_feature: GYAE6OF01CXSCM.49.20.B09.1.454.CMB.1.raw
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (410)..(410): a, c, t, g, unknown or other
  misc_feature (410)..(410): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcacaggctctgacggccttcctatgagctgaccacagtccacccgttcggtgtctgtcgtcctacgaggacaggacgccaaggctcnccgtgcctgtggctatgctattacgaccaaaatntatcgtacttacgtaggaccagacgaacggcgaccacggccctacgtccccgttgtcgtttagggtacttaaatttaagtaaaacgttcgtttaaggacggtaccgtaccctaggacccgggtaccctgacgtctactttccgtcgacgttcccagaccgngtaccggaaaggaacctaagtacccgtactaaaccgtgtaaccagttaccgtaagggttaccgaccggttaccgaaccggagggtaaaccggcgtacggtacgttacgtaacgtttacttaacgtccgactacggtacccagacgtaagcgtacgtggaccgttgtaaggtttacgttccggttagttaggtcccggggtaacggtacgggtacaccgggttacgtaccgttacccggtcgttagggacctaccgggtaaccacgttacccgtccgacccccggttggtaccc

SEQ ID NO: 75057 - DNA, 836 bp, Homo sapiens
  misc_feature: GYAE6OF01EQA9E.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctggaggcctcctatgagctgacactagtccacccgtggtgtctgtcgtcctgaggacaggaccggccaggtactccaccgtgcctcgtggcgtaagtcgactagttacgaaaccctaaaaaactaagttacgttcgttaccgtttaaccgtacggtaaccgaaggtacgaacggaccggaccgaaccgggacccggtacccggtccccgttacgtttaccggtttagggttaacgttaaacgttttaaaggttaaaacggttacgttttacgggaaccggtaccgggtacccgtacgggtacccgggtaccccgtaggacgtcgtacgttcctcgtcggtcctaccgacgtacgtaacggaacggaacaacgtaccgtaccgtaccttaccgaactacgttacggtacgggttaccggtaccggtaccgggaccggaacggggtaacgggaacggtacggtacgttaactaaccgtttaacgtttacgtacggttaccggtaccgtccgtacgaaccgtacgacgtcggtacggttcggtaagtttacgttaggttacggttacgggttacggtaccggggtaagggtaccgggtaccgttacggtccggttacgggtaacccgttcgggttaaccgacggaacccggttacccggaacccggtcccgttaccccgggttaccccggttcggtaccccg

SEQ ID NO: 75058 - DNA, 685 bp, Homo sapiens
  misc_feature: GYAE6OF01BARMO.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctctcactctctgcacaggctctgaggcctcctatgagctgacacagtcaccctggtgtctgtgtcctcgaggaccagacggccaggactccgacctgctcgtggcgatcgctattcgaccaaaacatatgcttacgtcggtaccagcaggacggccacggccacggccccttgtccgttgggtgtacttttaagtaaagtactttaggacggtaccggtcccgtacgacgggtacccctgaacggcgtacttcctcgtcggcctccgacggtctacggacgggaacaacgtacggtacctaccgttacgaacctacgtcgacggtcgggaaccgttccgggaccgtagggaacggacggcggtacgtacgtacttacgtttacacgttaccacggttcccgactaacgacgtacgacgtaaggtcggtacgtagtttacgtacggttacgttacggttaccgggaggtacgggacccggttacgtccggttccggaacccggttcccggtagtacccggtacgtaccccggtaacggtccctcccggtacccccggttcgggttaccccg

SEQ ID NO: 75059 - DNA, 758 bp, Homo sapiens
  misc_feature: GYAE6OF01BE783.49.20.B09.1.454.CMB.1.raw
  modified_base (530)..(530): a, c, t, g, unknown or other
  misc_feature (530)..(530): n is a, c, g, or t
tcagagtcgagagacacgaccggtgctcgatttagtgtagtgtgaagggggctgtgggtccaggaggcagaactctgggtgtctcaccatggcctggactcctctacttcctcccctcctcactctctgcacaggctctgacggcctctagtgagctagaccacacgtccacccgttggtgtcgtgtcgtcctcgaaggacacggtaccggaccaggactcaccgtgcctcgtggactatcgactagttacgaaacctaaaaacgtattagtcgtaccttacgtacgaaccgacgacgacggacggaccgacggtaccgtccggtccccttggttacgttagggttattaaagtttaacgtaaacgttacggtttacgaacgggcccgtacccgtacggaacccgggtcccagggtactaccgttacgtctcggtcgcctacgcgtacgacgtaacggaactacgtactacctacgtacgactcgtagcgggtgtacccggtaccgacgaggtaacggacgtcgggttanaccgttaagtacttaccggtcgtaaccgggcctacggtaacacggtacgtaccggagtaacggttcgtaacgttaggttacgttcggttacggtaaccggggacgggtacggttaccgtaaacggtccccggtaacggttacccgggtaccggttaaccgttacgggtaacccgaccggtaaacccggttcccggtacccgttccccggtaccccgttgtacccccgg

SEQ ID NO: 75060 - DNA, 688 bp, Homo sapiens
  misc_feature: GYAE6OF01C6SMF.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggccctcctatgagctgacacagtccacccgtcggtgtctgtcgtcctcaggacagaccggccaggactccacctgccttcgtggcatcgactattcgaaccaaaaacattatcgtacttacgtcggtaaccagcgaaggacggaccacggcccacggtccccttggttcgtttcggtattaacgttttaaagtaaacgttacgtttaggacggtaccggtaccccgtaccggaaccgggtacccctggaaccggtcgttaactttccgtcgttcggtaccctccgagtccgtacggaacgggaccaacgtcgtaccctaccttacgacctagtacgtaggtcggacggtaccggacgaggacgacgaggtctagtacttatcgtcgtctacgccacgacgacgacgacgtcggtcgtacgtagttacgtaggttcgttacggtccgggtacggacggtaccgtacgtccgtaccggtacccggttccgtacggtccgacccgtacccggtaacggtcccgtaccccgccccgttccggtaccccg

SEQ ID NO: 75061 - DNA, 652 bp, Homo sapiens
  misc_feature: GYAE6OF01AOZZD.49.20.B09.1.454.CMB.1.raw
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
  modified_base (237)..(237): a, c, t, g, unknown or other
  misc_feature (237)..(237): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtntctgtgtcctnaggacagacggccaggatccgacctgctctggcatgcattgaccaaaacatngacttacgtggtaccagcgagagtccaggccaggtcccctgtcttagactactaatttaataaacgtcgtttaggacgtacgggtcctaccgacgggtaacccctggagtcgtacgtttctccgtacggtcctaccgacggtacctccggaacggtaccggtaaacaaaccgtacggtaacccgttaaggttaccggaaccctaagttaccgtaggttacggggacgttccccgggagtaacggacgggaacgacggtacgtagtaccgttaattacgtgactgacctatacgaagaactagggttacgcgtactactttcgtacggtcgttaacggtcgggacgggaacggtacctaagggtctcggtaaccctcggtaacgtccacggtacccgagtcccgtcggtacccccg

SEQ ID NO: 75062 - DNA, 635 bp, Homo sapiens
  misc_feature: GYAE6OF01BAD3R.49.20.B09.1.454.CMB.1.raw
  modified_base (176)..(176): a, c, t, g, unknown or other
  misc_feature (176)..(176): n is a, c, g, or t
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
  modified_base (596)..(596): a, c, t, g, unknown or other
  misc_feature (596)..(596): n is a, c, g, or t
  modified_base (604)..(604): a, c, t, g, unknown or other
  misc_feature (604)..(604): n is a, c, g, or t
  modified_base (619)..(619): a, c, t, g, unknown or other
  misc_feature (619)..(619): n is a, c, g, or t
  modified_base (628)..(628): a, c, t, g, unknown or other
  misc_feature (628)..(628): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctctatgagctgacactagtcacccgtgggtntctgtcgtcctgaggacagaccggcagctcactgctcgngcgtatgctatacgaccaaaatntatcgtactttagacggttaccagtacgagacggtaccaaggccgtaccgtcccgttgtacggtggtataagtttaagtaaacgtgttacgagaccggtccgtacgacggtaccctgacgtacttcgttcgcgttcgtccgtacgtaacgtcgacggaacgggtaacaaccgggtactacctacccgttacgaacctaaggtgtaacggtcggttacggccccggaagagggaccggttaacgcggtacgtagtacgttacttcgggctgtaacgcccagactcgagtacaggtagtctaagttgtgtacgtaacggtcgggagtaccggagttacccctgggttcccacgggttacncggttacncgtaacgtcggaccnccggtcccnggttccc

SEQ ID NO: 75063 - DNA, 649 bp, Homo sapiens
  misc_feature: GYAE6OF01A4C8K.49.20.B09.1.454.CMB.1.raw
  modified_base (178)..(178): a, c, t, g, unknown or other
  misc_feature (178)..(178): n is a, c, g, or t
  modified_base (245)..(245): a, c, t, g, unknown or other
  misc_feature (245)..(245): n is a, c, g, or t
  modified_base (272)..(272): a, c, t, g, unknown or other
  misc_feature (272)..(272): n is a, c, g, or t
  modified_base (399)..(399): a, c, t, g, unknown or other
  misc_feature (399)..(399): n is a, c, g, or t
  modified_base (475)..(475): a, c, t, g, unknown or other
  misc_feature (475)..(475): n is a, c, g, or t
tcagagtcgagagacacgaccggtgctcgatttagtgtagtgtgaaggggctgtggtccaggaggcagaactctgggtcgtctcaccatggcctggactccctctacttcctcccctcctcactctctgcacaggctctgacggcctccgtatgagctggacacagtcacccttggtntcctgtgtcctacaggacagacggccaggtatcacctgctcgtggcagtgcagttgaacaaaacatngcttacgtggtaccagcagtgcacgcncgccctgtcttggatactttataaacgtactttgacgtacggccctacgacggtcccctggaaccgtgtacttctcgtcggtacctcgacgtcgcgaacggtacaacgctaccgtacgtgaccgtancgtaggtcggaccgtccggctaagggacggtacgacggtctaggtaactagttacctaggtaccaacgggttcccngtaacggacgaacggagtacggtaacggtcgtaagtttacgttcggtaccgttacggtcgggtacgggaccggtaacgtaccggtacccgttgggaccccgttacgggttacgacccgtaccggtaacccggaacggtacccgtcccccgggttaaccccgttcgggtaccccg

SEQ ID NO: 75064 - DNA, 700 bp, Homo sapiens
  misc_feature: GYAE6OF01BS09B.49.20.B09.1.454.CMB.1.raw
  modified_base (519)..(519): a, c, t, g, unknown or other
  misc_feature (519)..(519): n is a, c, g, or t
  modified_base (527)..(527): a, c, t, g, unknown or other
  misc_feature (527)..(527): n is a, c, g, or t
tcagagtcgagagacacgaccggtgctcgatttagtgtagtgtgaagggggctgtgggtccaggaggcagaactcgtgggtgtctcaccatggcctggatccctctacttcctcccctcctcactctctgcacaggctctgaggcctcctatgagctgacacagtccaccctcggtgtctgtcgtcctcgaggacagacggccaggatcacctgctcgtggcgatgctattcgaccaaaaactatatcgtacttacgtacggtaaccagcgaaggagccgaggccacggccccttgtcgttaggtagtatttaagtaaagtcgtttgagtacggccctacgaccgggtaccctgaacgtcgtacttccgtacgtcggtacctcgtaacgctacggaacggaacaacgacgtacaccgttcgaacctagtacgacggtagggacccgtccggaccaagggcggaacggacgtcgtacggttaacttagttaccgtgtacccgcggtaccagtaacgaacncggtacgnggtacggtacgtaaggtttccgtaggttaccggttagggttcccggggaaccgggtacgggtaccttaccggtacgttaccccgggtaaccccggttcgttacggggaacccttaccccgggtacccaaacggggttccccgttcccccggtacccccggttgttaaccccgg

SEQ ID NO: 75065 - DNA, 845 bp, Homo sapiens
  misc_feature: GYAE6OF01DMA66.49.20.B09.1.454.CMB.1.raw
  modified_base (130)..(130): a, c, t, g, unknown or other
  misc_feature (130)..(130): n is a, c, g, or t
  modified_base (194)..(194): a, c, t, g, unknown or other
  misc_feature (194)..(194): n is a, c, g, or t
tcagagtcgagagacacgaccggtgctcgatttagtgtagtgtgaagggggctggtgggtccaggaggcagaactctgggtgtctcaccatggcctggactccctctacttcctcccctcctcactctcngcacaggctcgtggacgtcctcctagtgagctgacacacgtccaccgtcggtgtctgtcgtccncgaggacaggacggccgtagactccacctgccttgcggcgtatcgctattaccgaaccaaaatatcgtctacttacgtacgtaccgagcgaaggtaccgccgaccgtccgaccggtccccttggttacgttaggtattaagtttaacgtaaacgtttacggttaggaaccgggtacccgtacccgtaaccgggaccccgggtaaccgtagggtacgtaccggttacgtttcccgtacgtccggacctttaccggacgttacccggaacggaaccgggtaaaccctaacgtaccgttacccttaaccggtactaaccgtacgtacggtacggggtaccggaaccgggtcccggaaaccgggtagggacgggtaaccgtacggtaccgtttaacgtaacgtttaccgttacggttacccgtaccggtaacccggtccggtaacaaccgggaacggttaaccgggacgttacggggtaccggttaacgttaagttttccggggttaacgtttaccggggacgggttacccggggacgggtaacggtacccggttccgtaccggttacccgggttacccggtaccggtaccgggtaccgtaacccggtacccggacggttaccccttccccgggtacccccgtggtttccccccg

SEQ ID NO: 75066 - DNA, 583 bp, Homo sapiens
  misc_feature: GYAE6OF01ETGCQ.49.20.B09.1.454.CMB.1.raw
  modified_base (470)..(470): a, c, t, g, unknown or other
  misc_feature (470)..(470): n is a, c, g, or t
  modified_base (476)..(476): a, c, t, g, unknown or other
  misc_feature (476)..(476): n is a, c, g, or t
  modified_base (480)..(480): a, c, t, g, unknown or other
  misc_feature (480)..(480): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggactcacctgctcgtggcgatgcattgaaccaaaaactaatatgtacttacgtcggtaccagcagacggccgaggccacggccctgtcttggtagtatttataaagtctttgaggacggtccctacgacgggtacccctggacgtcgtacttcgtcgtcggctccacgctcgaacgggaaccaacacgtcctaccttcgaccagtacgtaggtgggacgtccggactaagggacggacgaggctagacttattctgtcgacgtcacgngaacgngcgngtacggtcttagttactgtacgtcggtcgggacggtacggacctaggcctacggacccggtcgtacggccacggacccgtacggccctccgccccgtgtaccc

SEQ ID NO: 75067 - DNA, 801 bp, Homo sapiens
  misc_feature: GYAE6OF01CA0W6.49.20.B09.1.454.CMB.1.raw
  modified_base (249)..(249): a, c, t, g, unknown or other
  misc_feature (249)..(249): n is a, c, g, or t
  modified_base (502)..(502): a, c, t, g, unknown or other
  misc_feature (502)..(502): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtgtctgtcgtcctcacggacagacggccaggactcaccgtgcctcgtggacgatcgcacttacgaccaaaacgnttaactgtacttagttcggtaaccgagtccgaaacggtaacggcccgggaacccgtcggtcccccgttggttacggtttgggtaaccgtagttaagtaaacgttaaaacggacctaacggtaggaacggtaaccgggtccccgttacgggtaaaggggtccctcccgttaagggccgttacgtacgttttcgtacgttcgggtacccgtaaccggtacgggtaacgtaaaccggggaacgtaacccgggttanaaacgttcggtaccgacgtaactaccggtaggggttacggaacgttaccgaacgggtacgaacggtacgggaaggaacgtccgtaagtaaccctttaaatttacggttaatacgtaaacttaccgaaacgtaacgaacccgtaccgttagtttaacgttacttaacgttcggtaccggtttaccggtaagttcccggaacgtaacccgtacgggtcccgtacccgggttcgtacccgggtacgaccccgaacccggtaaaccccgacccctaacccgtaccgtccgtaccgtacccccg

SEQ ID NO: 75068 - DNA, 735 bp, Homo sapiens
  misc_feature: GYAE6OF01D45A1.49.20.B09.1.454.CMB.1.raw
  modified_base (134)..(134): a, c, t, g, unknown or other
  misc_feature (134)..(134): n is a, c, g, or t
  modified_base (418)..(418): a, c, t, g, unknown or other
  misc_feature (418)..(418): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacnggctctgacggcctcctatgagctgaccactagtccacccgttcggtgtcttgtcgtcctacaggcaggaccgccgaggactccacctgaccttcgtcggacctagtcgaccttattacgaaaccctaaaaatatattacgtactttacgttaccggtacagaccgaacggtaacggcccggacgaccggtccccgttggttgggtttggtagttacgtagttaaacgtaaaaccgcgtaacgttacggacggaccggtcctacggtacggtacctaaccccgngggtaaccttcgttaccgttcttacggtccgccgtaccggtaggtaccggaacggtaacctaccggctaacgtaggtccgacctaggtaccgtaggtcggaacgtacgaggacgaggacggaaggcgtacgttaacgtaccgtttaagttacgtttacgactaaccgtacgaacgtaaccgtaacaaccgttttacgttagttaactttgtaccgttaccgttacggaaccttcggaacccgtaaccgttacggtccctaccgttcggtcccggacaccccgaacgtacccgaaccccacgtccttccgctaccccg

SEQ ID NO: 75069 - DNA, 662 bp, Homo sapiens
  misc_feature: GYAE6OF01BWJI1.49.20.B09.1.454.CMB.1.raw
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacgacgtcaccccgttcggtgtcctgtcgtcctcgaggacaggaccggcctaggactccgacctcgctcgtggcatcgctaagttcgaaaccaaaaactattcgtgtccttacgtcggtaaccacgacgaggaccggccgacggccgacggtccccgtgttcgtttggtagttaatttaagtaaagtacgttaggacgaccggtcccgtacggaccgggtaccccgtaggacgtccgtaacgttccgtcgtcggtcctccgacgtccgtaacgacggaaaccacgtaccgtactaccgtacgacctagtacgacggtcggaccggtcggaccgtacgggaggacggacggtcgtacgtaacgttcttacgcgtacnccggtccncgancgacacgtgtgtattacgttgtacggtcgttaggtccgggtacggacgtacgtacgtcgttcgtaccggttgaccgtaccgcgtacccgacggtcctacccgtccgtcggtccg

SEQ ID NO: 75070 - DNA, 833 bp, Homo sapiens
  misc_feature: GYAE6OF01D7OFF.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctctatgagctgacacagtccacccgttggtgtctgtgtcctcaggacagacggcaggatcactgctctggcatgcattgaccaaaatatatgacttactaggtaccagcagacgcacggccacggccctgtactggtgtatttataagtctttgagtacggcctcgacggaccctgacgcgtattctacgtggactcacgctacgacggacaacgtacgtacctaccgttacgacctagtaccgtacggtacggtaccggtaccccgggaaccgtaacgggaacgggaaccgggtaacgggtccgttaacggtaaccgttttaacgtttaaccggttacgttacccggtaaccggttacccggtaccgtaaacgggtaaccgtaaacgggtaccgtaacgggttacgggttaaacccggttaaacggttttttaaccggttacgggtttaaccggggttttaacccgggttttaccccggggggggtaaaccggggttaaacccgggggggttaaacccttaacccggggtttaccccgggtaaaccggggtttaacccccgggtttacccgggtttaaaccccgggggtttacccgaaccccggggtaacccccggttaaaaccccggggttccggtttacccccccgggttaaccccccccgggtttccgggtttaaacccccccgg

SEQ ID NO: 75071 - DNA, 812 bp, Homo sapiens
  misc_feature: GYAE6OF01BAH3X.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctggacggtcctcctagtgacgtctgacactacgtccacccgttggtgttcgtgttcgtcctcgaggaccacggaccggaccgaaggtactcctaccgtgccgttcggtacggacgtacgtcgactacttacggaaaccctaaaaactattacgtacgtaccttacgtcggtaaccgaggacgaaggaccgaccgacggacccgtccggtaccccgttggttcgttaggtagttaaagtttaagtaaacgttacggttacggaacggtcccgtacccgtaccggtaaccgggtacccctaggtaccgtacgttacttccggtaccgtcggtaccctacgaccgtaccgtacggaacggaacctaacgtacgtacctacgtacaacctacgtacgcggtacggtaccggtccggaacggagggtacgggacggtaccggtacgttaacgtaaccgttacgttacgtacgtaccgtaccgtccgaacggtaaccgtacggaacgtacggtaacgggtcggttaacggtttaggttacgttaccggttaggttaccgggtaccggggtaacgggtaccggtaacggttccggtccggttaccgggtacccggttccgtacggtaccgacccggtaccgtaccggtacccgttccccgtaccccggttccggtacccg

SEQ ID NO: 75072 - DNA, 704 bp, Homo sapiens
  misc_feature: GYAE6OF01AM9DE.49.20.B09.1.454.CMB.1.raw
  modified_base (334)..(334): a, c, t, g, unknown or other
  misc_feature (334)..(334): n is a, c, g, or t
  modified_base (472)..(472): a, c, t, g, unknown or other
  misc_feature (472)..(472): n is a, c, g, or t
  modified_base (586)..(586): a, c, t, g, unknown or other
  misc_feature (586)..(586): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgccacaggctctgacggcctcctatgagctgaacctacagtccacccgtcgggtgtctgtcgtcctcaggacaggaccggccaggatccactgctctggcgatcgctattagaccaaaaactataacgttcgtctttaacgtcggtaaacccagaccgaaggtacggaccgacggccgaccggtcccccgtgtttccgttagggtnttaattttaagaaaaggttcctttaggaacgtaccggccccgttaggacccggggtacccctggtactcgtaactttccgcgtacggtcctaccgaggtcctacggaacggtaaccaacgtacgttcctaaccgttanaacccgtagtccgacgtggacgtccgggacgaggaacggacggaggtccgaacgtacttaacgttacgtcgtacgtaacgtccgtagacgacagacgtaggtgtacgttagttntcggttacgtacgtcgggacggttacgggaccttaggtccgttacggtacccggttccgtaacggacccggtacccgtaccgtaaccggtccctcccggtcccccgttggtaaccccg

SEQ ID NO: 75073 - DNA, 738 bp, Homo sapiens
  misc_feature: GYAE6OF01D7HQJ.49.20.B09.1.454.CMB.1.raw
tcagagtcgagagacacgaccggtgctcgatttagtgtagtgtgaagggggctgtgggtccaggaggcagaactctgggtgtctcaccatggcctggactccctctacttctcccctcctcactctctgcacaggctctgacgcctctatgagctagacacacgtccacccgttcggtgtctgtcgtcctacgacggacacggaccggccgaggactccgacctcgcctcgtcggacgtagtcgactagttaccgaaccaaaactatagtcgtactttacgtacggtaccagacgacggacgaccgacggccgaccggtccccgttggttcgttacggttagttaagttttaaacgtaaacgttacgtttcggaacggtaccggacccgttacggaccggtacccgtaggaccgtcgttacttccgtcgtcgtcctacgcgtacgacgaacggaccaacgtacgtacctacgtacgaacctagtacgaggtaccggtaccggtacccgacgaggaacgggacgtaacggtcgtaacgttactttacgttaccgtcgtaccgttacggtctacgaacgacgacgtaacggtcggtacggtaacgttacgttagttaggttccggtaacgggttcgggtacggaccgggtacggttaaccgcgttaccggtaccggttacccgttacggtacgacccggaacccgtaccgggtaccgtccccgtcccgtcccggtacccg

SEQ ID NO: 75074 - DNA, 863 bp, Homo sapiens
  misc_feature: GYAE6OF01ARR9V.49.20.B09.1.454.CMB.1.raw
tcagagtcgagagacacgaccggtgctcgatttagtgtagtgtgaagggggcgtgtgggtccaggaggcagaactctgggtgtctcaccatggcctggatccctctacttctcccctcctcactctctgcacaggctctgacgcctcctatgagctgacactagtccacccgtggtgtctgtcgtcctacgacggacacggaccggaccaggactacctacgttcgccttcggtcggacctatcgacctacttacgaacctaaaaacgtactaatcgtacttacgtagaactaaccgagacgaacggaccggaccgaacggcccgtaaccggtcccccgttaggttcggtttcgggtagttaacgttttaaacgtaaacggttacgtttaggaccggttaccgacccgttacggtaaccgggaccccgtaggacggtaccgttacgttcgtcggtaccgtccttaaaccgcgtacctacggaacggtaacctaaaccgtacgttaccctaaccgtttacggaacccttacggtacggtaacggggttacggaacccgggttacccgggaccggttaaaacggggaaccggggtaacggtacgggttaccgtaacggtttaaccgttaaacgtttacggttaccgtacgtaacccggtaccgaaccggaacgaaccgaacggttacgaagggttaccgacggtttaaggttaacgttacggttacggttaacgggttcggggaaccgggtaacggtaacccgttaccgggtacgtccggttaaccggtcccggttaacggtaacccgtacccgggtaaccccggtaaccggtccccggttccccggtaccccggttaaccccgg

SEQ ID NO: 75075 - DNA, 831 bp, Homo sapiens
  misc_feature: GYAE6OF01A8AE9.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctctcactctctgcacaggctctgaggcctctatgagctgacacagtccacccgtggtgtctgtcgtcctagaggacagacggccgaggactccgtacctggccttcgtgggacgtagtcggacctacgttacgaacctaaaaaactattaagttcggtacttacgttagggaaccagccgaaggacggccgaacggcccgtacggtcccccttggttccgtttagggtacgttaattttaacgtaaaacggtttacgtttaggacggtaaccgggtccccctttacggaaacccggggttaaccccgtgaaccggtgtttaccgttcgtcgttccggacttcccgaagtccgtaacggacgggaaactaaacccggtcttaaccgtacccgttacgaacctacggttagtaacgggtcgggtaaccggtccggaaccgtaagggacggtaaccggacgggtacttaccgggtaacttacgtttacgtacggtactaaccgtacgtacgtaacgtacgtaacgaaggttacggtacggtaccttaccgtttaggtacgtttccggtacgggtttaccggggacccggggttaaacgggaaaccccgttaaaggggtccgttaacccgggtcccgttaaccgggtaacccggtaggtaaccccgggacgttaacccggtacccggttccccggttaaccccgtcccggtttaaacccg

SEQ ID NO: 75076 - DNA, 828 bp, Homo sapiens
  misc_feature: GYAE6OF01EN501.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctctatgagctgacacagtccaccctcggtgtctgtcgtcctcgaggacaggaccggccaggactccacctgcctcgtggcgtagtcgactagttacgaaaccctaaaaaacgtaattacgtcgtacctttaaccgtacgggtaacccaggaccgaaggaccggccgaccggacccgtaccggtcccccgttggtttccggtttagggttagttaaagttttaaacgttaaacgttacggtttaacggacggtacccgggtaccccgttacggaacccgggtaccctggaaccggtcgtacttccgtcgttcggcctaccggacgtctaacgggaacgaacaacgtcgtacctaccgtacgacctacgtacggtacggtacggtaccgtacccggaaggaccggtaaagggacgggtacgtaacgggttaccgtaagtttacttaagttttcgtacgtaacctaacgtaacgaaccgtaacgtaacccgtaacgtttacgtttacgtttaacgttttacggttacgttaccgttaaccggaccgtaccgtaacccggggttaaacctaaaccgggtttccccgtaacccggtttcggggtaaacccggtccgaaacccgtaacccccgaaccgggttaccccccaaacccgtttacgtacccttacccgttaacccttccccgg

SEQ ID NO: 75077 - DNA, 824 bp, Homo sapiens
  misc_feature: GYAE6OF01EKJUR.49.20.B09.1.454.CMB.1.raw
  modified_base (182)..(182): a, c, t, g, unknown or other
  misc_feature (182)..(182): n is a, c, g, or t
  modified_base (404)..(404): a, c, t, g, unknown or other
  misc_feature (404)..(404): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacagctctgagcctcctatgagctgacacagtccacccgtcggtgtctgtntcctcaggacaggaccggaccaggactccacctgtcctcgtggcgatcgctattacgaaccaaaaataatagtcgtcttacgtacgtaccagcgacggacggaccacggccgacggtccccgtgttcgtttggtagttaatttaaagtaagttacgtttaggaacgaccgtacctacggaccggtaccccgtagacgtcgtacttcgtcgtcggcctaccgngtcctacgaacggtaaccaacgacgttaaccctaccgttacgaacccgtagtaccgtagggtacgggtaccggttaccccggaaccggtaaggaccgggtaacgggacgtacgttacggtaactttaacggttaccgttacggtacccgtagggtacccgtaaagggtaccgaaccggaccggtaacgtaaccgggtttacgggaacccggtttaaaggttttacgtttaccggggttaccgttttacgggggtaaccggggtaaccgggggtaaccggttaccccggttaaccggtacccgggttaacccgggtttacccggtaccggggttaaaccgttccccgggtaaacccgggtaaccccgggttaaccgggaccccctttcccccggggtacccccgtttcccccggggtaccc

SEQ ID NO: 75078 - DNA, 832 bp, Homo sapiens
  misc_feature: GYAE6OF01BLWHG.49.20.B09.1.454.CMB.1.raw
  modified_base (345)..(345): a, c, t, g, unknown or other
  misc_feature (345)..(345): n is a, c, g, or t
  modified_base (464)..(464): a, c, t, g, unknown or other
  misc_feature (464)..(464): n is a, c, g, or t
tcagagtcgagagacacgaccggtgctcgatttagtgtagtgtgaatgggctgtgggtccaggaggcagaactctgggtgtctcaccatggcctggatccctctacttctccccctcctcactctctgcacaggtctcgtggacggcccttcctagtgacgtctagacacgtacgtcccacccgtcggtgtctggtactcctagacggacgaggaccgaccgtaggactccgactcgcttacggtcggacgtatcgacctaagttaccgaaacctaaaaaagtattacgtacgttaccttacggtaacggtaaccacggacgaacggacggcccgaacgggcccnccggttaccccttggtcgtttagggtacttaaactttaaagtaaaacgttcgttacggacggccgtacccgtacggaaccgggtcccgtaagacgtaccgtactttcctcgaccgtacnccttacgcgtaacggaacggaacctaacggtcttacgtacttacgtaacgacgtacggagttcgggaaccgtaccggaccgaagggacgtaacggcgaacggttacaaaccgtttaagtacgtaccgggtacgttaaccgtccggaaacacggaaccgtacggttacggacgggtaaccgttaacgttaacgttacgttacgggtttaaccgggtaaccgggtttacccggaggggtttaaacccgtaccggtaacccggtttccgggtaccggttaaacccgggttacccggtaaaccggttacccggaccgaaacccccggttacggtaccccgggttaccccggtaccccccggtttaaaccggg

SEQ ID NO: 75079 - DNA, 731 bp, Homo sapiens
  misc_feature: GYAE6OF01ETH91.49.20.B09.1.454.CMB.1.raw
  modified_base (207)..(207): a, c, t, g, unknown or other
  misc_feature (207)..(207): n is a, c, g, or t
  modified_base (582)..(582): a, c, t, g, unknown or other
  misc_feature (582)..(582): n is a, c, g, or t
tcagagtcgagagacacgaccggtgctcgatttagtgtagtgtgaagggggctgtgggtccaggaggcagaactctgggtgtctcaccatggactggatccctctacttcctcccctcctcactctctgcacgaggtctctggacggtcctctatcgagctgacacacgtcctacccgtcgttgtcgtgttcgtcctcgacggaccnggaccggcgaaggactccgactcgtctacgtggactatgacctattacgaaccaaaaattattacgtcgtaccgtttaacgtacggtaccgagacgaaggtacggaccgacggtacccgaccggtccccgttggttcgtttaggtagttaaatttaaagtaacgttacgtttaggacgtacggaccccgttaggacccggtacccgtagacgtaccggttattccgtcgtcggtcctacgtacgctaacggaacgaccaaacgtacgtactaacctaccgactataccggagtaccggtaccgacgaccggtagaacggcgtaacgtgttaacggactttaacgttcgtcgtacgacgtccggatacgacgtaanccgtagtaccgtataacggttcgtacgttcgggtaacgttacgggacgtacggtaaacccgttcgtacgttacccggtaacgtcccggttaggtaaccgacccgtacccgtacggggtaacccttcccgtcccccggttacgtacccgg

SEQ ID NO: 75080 - DNA, 736 bp, Homo sapiens
  misc_feature: GYAE6OF01DCMCW.49.20.B09.1.454.CMB.1.raw
  modified_base (247)..(247): a, c, t, g, unknown or other
  misc_feature (247)..(247): n is a, c, g, or t
tcagagtcgagagacacgaccggtgctcgatttagtgtagtgtgaaggggctgtgggtccaggaggcagaactctgggtgtctcacatggcctggatccctctacttcctccccctcctcactctctgcacagctctgagccctctagtgagctgacacacgtccacccgttggtctgtcgtcgttccctacgacggacgaaggaccggccgaaggaccttccgaccgtgtccttcgtaggcgtatnactacgttacgaaaccctaaaaaatattagtcgttacttaccgtacggtaccgagcgaacggacggaccgacggtaccgaccgtccccgttgttccgttggttagttaaatttaacgtaaaggttactttacggacggtaccgtcccgtacggacccggtaccgtcggagtcgtacttcctcgtcgtcaccggtccgtaacggacgactaacgcgtacctaccgtcaacgtacgtacgacggtcgaccggtaccggacgtacggaccggacgggtacgtaccgtagttaacgtttaccttacgtccggtaccgtaccggtaacccacggtaacgacgacgtaacggtggtacgtgttacgtttcgtaggttacgtcgggtaccggtacggggtaccgttaccgtccggtaccgttacccggtacccggttcggttacccgtaccgaccggtacccgaacggtccccgtacccgtccccgtcgtaccccg

SEQ ID NO: 75081 - DNA, 614 bp, Homo sapiens
  misc_feature: GYAE6OF01CJO9O.49.20.B09.1.454.CMB.1.raw
  modified_base (226)..(226): a, c, t, g, unknown or other
  misc_feature (226)..(226): n is a, c, g, or t
  modified_base (432)..(432): a, c, t, g, unknown or other
  misc_feature (432)..(432): n is a, c, g, or t
  modified_base (472)..(472): a, c, t, g, unknown or other
  misc_feature (472)..(472): n is a, c, g, or t
tcagagtcgagagacacgaccggtgctcgatttagtgtagtgtgaagggggctgtgggtccaggaggcagaactctgggtgtctcaccagtggcctggactccctctacttcctcccctcctcactctctgcacgaggctctggacggtcccttcctatggacgctacgacacgacgtccacccgtcggtgtcctgtcgtcctcgaggacaggcgccgaggctacnctgctgtcggcatcgactactacgaacctaaaagtatatcgtaccttacgtacgaccgagacgacggtacgcgacggccgtaccggtccctggttccgttaggtattaagtttaataacgttagtgacgcggtcctagaccgggtacctgacgtctagttccgagtccgctcgacgtctacgaacggactacgacgtacctagacncgtacgacgaggtacgacggtaccgacgagggacgacggngtacgacgttactacgttcgactgactacacgtacgagaacgtagtgtacgtacttcgttctcggtacgtcggtacggaggacgcgtacgtcggtacgacgtcgacggaccgacgacgtacgcccgtacccgccgtcgtccg

SEQ ID NO: 75082 - DNA, 745 bp, Homo sapiens
  misc_feature: GYAE6OF01AJRAE.49.20.B09.1.454.CMB.1.raw
  modified_base (175)..(175): a, c, t, g, unknown or other
  misc_feature (175)..(175): n is a, c, g, or t
  modified_base (187)..(187): a, c, t, g, unknown or other
  misc_feature (187)..(187): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtntctgtcgtcctnaggacaggacggccaggactcacctgctctggcatgcattcgaccaaaaacatatgacttacgtggtaccagacagacggccgaggcccgacggtcccctgtcgttggtgtatttaataaagtacgtttggaacgacggtaccctcgaacgggaccccttggacgtcgtaactttccgtcgtcggcctccgacgcctacggaacgggacaaccgtacgtccctaaccgttagaccctatacgaggttacggaccggttacccgggaccgtaagggaacgggtaacggtacgggtaccgttagaacctttaagtttaccgtacgtcctaaccgggtcccgacgtaacggaccgtaacgaccggtaggttcgggtactttaagggtttacgttacggtttaccgggttaacgggttccgggggacggggttaacgggtaccgttaaccgggtccggttacccgggttacccggttacccgttaccggggttacccgaccgggtaaccccggtaacgggtccccgtttccccggtcccccccgggttaggttaccccccgg

SEQ ID NO: 75083 - DNA, 846 bp, Homo sapiens
  misc_feature: GYAE6OF01AY063.49.20.B09.1.454.CMB.1.raw
  modified_base (233)..(233): a, c, t, g, unknown or other
  misc_feature (233)..(233): n is a, c, g, or t
tcagagtcgagagacacgaccggtgctcgatttagtgtagtgtgaagggggctgtgggtccaggaggcagaactctgggtgtctcaccatggcctggatccctctacttcctccccctctcactctctgcacaggctctgacggcctcctatgagctgacacagtccacccgtcggtgtctggtcgtcctcgaggacacggacggccaggactacacctgctcgtagggctangcagttacgaaccaaaaactacttaagtcgtaccttacgtaccgtaccgacgacgaggacggtccgacggaccgaccggtaccccgttgtccgtttaggttagtaatttaagtaaacgtagtttacggaggaccggtaccctaccgggaccgggtacccccgtaggaccgggtacttaccgtttcctacgtccggtacctcccggagtccggtacggaacgggaacctaactaccggttactaccccggtttacgaacctacgtaccggtaagggtccgggtaccgggttaccgggaacccgggtaacggggacggggtaaaccggaggggttacccttaacggttaaccgtttaacgtttacttacggttacccgtaagttaccgtaacttacgggaaacgttaaccggttaggtttaaggggtcccgttaaccggttttccgtttaaccggttacggttcgggttttaaaccgggttcgggggaccgggtaaaccggggttaacccgaaggttccccgttaacggggaccccgtttacgggttaccggaacccgtacggtacccgggacccgttaccggtaccccccggtcccggttaccggttaccccgg

SEQ ID NO: 75084 - DNA, 594 bp, Homo sapiens
  misc_feature: GYAE6OF01A1KU6.49.20.B09.1.454.CMB.1.raw
  modified_base (177)..(177): a, c, t, g, unknown or other
  misc_feature (177)..(177): n is a, c, g, or t
  modified_base (183)..(183): a, c, t, g, unknown or other
  misc_feature (183)..(183): n is a, c, g, or t
  modified_base (188)..(188): a, c, t, g, unknown or other
  misc_feature (188)..(188): n is a, c, g, or t
  modified_base (205)..(205): a, c, t, g, unknown or other
  misc_feature (205)..(205): n is a, c, g, or t
  modified_base (245)..(245): a, c, t, g, unknown or other
  misc_feature (245)..(245): n is a, c, g, or t
  modified_base (421)..(421): a, c, t, g, unknown or other
  misc_feature (421)..(421): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacactagtccaccctcggtntctgtntcctnaggcagtacggccaggntcgacctgctcgtggcatagcattgaccctaaaagattangcttactggtaccagcaggaggacctaggccacggccccctagttcgttggtagtatttactaaagtctttggacgaggccctacgacggaccctgagtcgtattcgtctcggctcagctcgagggacacgagtcctactcgaccatcagtcggacgtccgacgacggtaggacgngtctagacttattacgtgtaccagtccgacgacgactagaccgtaggtcgtattagttattcggtacgttacgtcgggtacggacggtactacccggtcgtacccggtaccgttcccgtacggtaccgaccgtacccgtaacggtcgtaccccgtcccccgtagggttacccc

SEQ ID NO: 75085 - DNA, 850 bp, Homo sapiens
  misc_feature: GYAE6OF01AZXUR.49.20.B09.1.454.CMB.1.raw
  modified_base (136)..(136): a, c, t, g, unknown or other
  misc_feature (136)..(136): n is a, c, g, or t
  modified_base (168)..(168): a, c, t, g, unknown or other
  misc_feature (168)..(168): n is a, c, g, or t
tcagagtcgagagacacgaccggtgctcgatttagtgtagtgtgaagggggctgtgggtccaggaggcagaactctgggtgtctcaccatggccctggactccctctacttcctccccctcctcactctctgcacnggctctgacggcctcctatgacgtctgacacncgtccacccgtggtcgttctggttcgtcctcgaacggacacggaccggaccgacggtactaccacctcgtcctcggtcggacgtacgtcgactacgttacgaaccctaaaaactaattacgttacgtactttaaccgtacggtaaccgaacggacgaacgggaccggacccgtacggcccggaacccggtccccgttggttcggtttaggtagtttaactttaagtaaacggttcgttaggacggtccggtacctacggacccggtaccctggacggtacgtcgttcgtcgtcggtcctccgtacgcgtacgacgtaccgtaacaaccggttacgtaaccgtaccgtacggaactacggtacgtacggggttacgggtaccggggtacccgggaacgtaacgggaccgggtaacggaaaccgggtacgttaaccggtaaaccgttttacgtaaccggttacgtacggttaacggttacaacgttaacccggaacgtaacggttaaccgggtagggttacccgtaaccgttttccgttacgggttaccgttacgggttaccgggtttccgggaacggggttaacccgggacgtaccgggttaccggaaccggttcccggtaccggttaacggaccgtaccccggaacggtaacccgtccgttccccggttccccggtacccgg

SEQ ID NO: 75086 - DNA, 838 bp, Homo sapiens
  misc_feature: GYAE6OF01CHE66.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacggccctcctatgagctgacactatccacccgtcggtgttctgtcgtcctcgaaggaccaaggaccggaccgaaggactccaccgtcgcgttcgtggccgtattcgactattacgaaaccaaaaactaattacgtagttacttaaccgtacggtaaccagtaccgaaggtacggaccgacgggacctccgggttcccccttggttacgtttcggttaagtttaatttaaaacgtaaaggtccgtttaggaacggtccggtacccctacggacccggtaccctagggtactacggttacttccgtcgtacgtcctacgtaacggtaccgtacgaaacgggtaaacccaacggtacgtacccttaacgtaaccgtaaccacgttaacggagtaccgggtaccggggtaccgaccgggaaaggacggaacggtaacggtaccgttaacgttaaccgttaacgttaccggttacgttaccgacccgggtaactacggaaaccgtacgtcgaacggtacggttaccgtaggtttaaacggttttcgggaaccgttttacggtacccgggttacggggtaacccggggtaacgacccggttaccggtacccgtaacgggtccccggtttaaccgtacggaccggttaccccgaacccgggttaaccgttccccgaaaccccggttcccggtcccgttaacccg

SEQ ID NO: 75087 - DNA, 733 bp, Homo sapiens
  misc_feature: GYAE6OF01CULA9.49.20.B09.1.454.CMB.1.raw
  modified_base (258)..(258): a, c, t, g, unknown or other
  misc_feature (258)..(258): n is a, c, g, or t
  modified_base (586)..(586): a, c, t, g, unknown or other
  misc_feature (586)..(586): n is a, c, g, or t
tcagagtcgagagacacgaccggtgctcgatttagtgtagtgtgaagggggctgtgggtccaggaggcagaactctgggtgtctcaccatggcctggactccctctacttcctcccctcctcactctctgcacgaggctcgtggacggcccttcctagtgagctagacacagtccacctcggttgtctgtctcctcgaggacaggaccgccgaggatccgactcgctcgtaggcatcgctaattacgaaccaaaaatnttactgtaccttacgacggtaccagacgaggacggaccgaccggccgacggtccccgttggttccgtttaggttacgtttaatttaaacgttaaacggttacgttacggaacggtaccggtcccttacggacccggggtaccctaggacgtcgtactttccgtcggtacgtcctcgactacggtacggaacggtaacaacgtacgttcctaaccgttacgaacacggttacgaacgggtcggtaccggtccgggaaccgtaagggaacggggtacgcggttaacgtaagttaaccgttagttaccgttacgaccgtcgggtaaccccngaacgtacgaggtacggtagtacgggtatttaggtctagggttcgttaacgggcgggaaacggcgttacgcgggtacgtaccgttaccgggtacgtaggaacccgccgtaccgggaacgttccctacccgtccccggtcgtacccgg

SEQ ID NO: 75088 - DNA, 748 bp, Homo sapiens
  misc_feature: GYAE6OF01EB3BC.49.20.B09.1.454.CMB.1.raw
tcagagtcgagagacacgaccggtgctcgatttagtgtagtgtgaagggggctgtggtccaggaggcagaactcgtgggtgtctcaccatggcctggatccctctacttcctccccctcctcactctctgcacaggctctgaggccctcctatgagctgacacacgtcacccgttggtgtctgtctcctcgaggacaggaccggccaaggactccaccgtgtctcggtggctatcgctagtacgaaaccaaaaagtattatcgttacttaccgtacgtaccgagacgaggacgccgtaacggccgaccggtcccgttgttcgtaggttattaagtttacgtaaaggttacgttaggacggtaccggtccctacggaccggtaccctggacgcttcgtccgtcgtccggtccacgtagtaccgtacggaacggtaaccgtaccgtacgtacccgtaacgttaccgaaccgtaacgtacgtaacgggtccggtaccgggtacccgggaccggtaaaggggaacccgggaggtacccggtagttaaccgtaagtttaacttaccggttaccgtacgtaaccgtccgtaagaaccgacgtaccggagtaggtacgtacgttaacgttggtcgtttacggggttacgttacgggaaccgggtaccgtaacgttccggtcgttacccggaccggttacggttacgcccgaaccggtccggaaccgttcccggtccccgtccccgtcgttacccg

SEQ ID NO: 75089 - DNA, 631 bp, Homo sapiens
  misc_feature: GYAE6OF01CZNL7.49.20.B09.1.454.CMB.1.raw
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
  modified_base (544)..(544): a, c, t, g, unknown or other
  misc_feature (544)..(544): n is a, c, g, or t
  modified_base (555)..(555): a, c, t, g, unknown or other
  misc_feature (555)..(555): n is a, c, g, or t
  modified_base (574)..(574): a, c, t, g, unknown or other
  misc_feature (574)..(574): n is a, c, g, or t
  modified_base (598)..(598): a, c, t, g, unknown or other
  misc_feature (598)..(598): n is a, c, g, or t
  modified_base (609)..(609): a, c, t, g, unknown or other
  misc_feature (609)..(609): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacggcctctatgagctagacacagtccacccttcggtgtcttgtcgtcctgacggacacggacggccaggactcacctgcttcgnggcatcgtctagttcgaaacctaaaatagttncgtacttacgcgtaccagacgagacggccgcgaccgtaccggtccgttggttcgttggtattaacgtttaaataacggttacgtttaggaacggtaccgggtcccctaacggtacccgggtacccctaggaccgtaccgttactttcgtccggtccgtcctacgagttccgacgaacggtaacacgtacgtcctaacgtcgtactatcgaggtcgtacggccgagaggtacgacggtcgacttagtactagttcgtgtcacggtcganacgtanacgcgtgtacgtntagtgttcggngttcggagtcggaggtccncggctccggtacgtcgtacggacnccgtaccggancccgtcccgtccgtccgtaccg

SEQ ID NO: 75090 - DNA, 675 bp, Homo sapiens
  misc_feature: GYAE6OF01A42X4.49.20.B09.1.454.CMB.1.raw
  modified_base (175)..(175): a, c, t, g, unknown or other
  misc_feature (175)..(175): n is a, c, g, or t
  modified_base (241)..(241): a, c, t, g, unknown or other
  misc_feature (241)..(241): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccacccgtggtntctgtgtcctcgaggacaggacggccaggactcacctgcctcgtggcatgctattcgaccaaaaanatatcgcttacgacggtaccagcagacggccgacggccgacggccccttagttcgttggtcgtaatttaagaaagtcgtttaggacgaccggtccctacggaccggaccccgttaggacgtaccgtactttcgtcgtcggtcctaccgagtccgtacgaaggaaccaacgtcgtacccgtaccgttacgacctacgttacgagggtacggtaccggtacccggacgacgggtaacggacggacggtacgtacgtaacgttacgttcgtcgtacgtaccgacgtacgaacgaacgtcggacgtagggtcgacgttaggttacgtggttacggtacgttcgggacgggtacggtaccgttacgcggttccgtacggttcccggttaggacccgacggtacccggacgtccggttccccgtccccggttggtacccg

SEQ ID NO: 75091 - DNA, 718 bp, Homo sapiens
  misc_feature: GYAE6OF01BA658.49.20.B09.1.454.CMB.1.raw
  modified_base (205)..(205): a, c, t, g, unknown or other
  misc_feature (205)..(205): n is a, c, g, or t
  modified_base (563)..(563): a, c, t, g, unknown or other
  misc_feature (563)..(563): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacagtccacccgtcggtgtctgtcgtcctgagacagacgcagganccacctgctcgtggctatgctattaccgaaccaaaacgtatatcgtcttacgtacggtaacagacaaggaccggtaccggacgcccgtaccggtccccgtgttccggtttaggtacttaatttaagtaaacgttcgtttaggaccggtaccggtcccctacggaccggtacccgtagacgtcgtaccttcgtcgtcgtcctacgcgtaccgtacggaacggaactaacggtctacccttacgtacgtaacgtactcggtaacgtacggggaccggtaccgggaaccgaagggtaaccgggtacggacgggttacttaacggtaactttacgttaccgtccgtaccgtacggtcccganaaggaccaggtacgtacgggtgtacgtttaacgttgtacggttacgttacggaccgggtaggtaccggtaccctacggtcgtacccggtaccggtacgtcggtaaccgacccgggtacccgtacggtcccgttcccggtaccccgttggtacccc

SEQ ID NO: 75092 - DNA, 822 bp, Homo sapiens
  misc_feature: GYAE6OF01DNRBJ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgacggccctcctatgagctgacacagtccacccgtcggtcgtctgtcgtccctcgaggacaggccggaccaggactccacctgctcgtggcgatcgctattacgaaccaaaactatatacgtacttacgtacggtaccagacgtaacgacggtccgacgggcccgaccggtccctggttacgttaggtacgttaagtttaagtaaacgttacgtttagaacggtaccggtccctacggtaacccgggaccctaggacgtacgttactttccgtccggtaggaccttaccgacgtaccgtacgaacgggtaaccaacgtaccgtacccttaccgttacggaccttagtacgggtacggttacgggacccgggtcccggaaccgggtaaggggaacccgggaacggtcggtaaccgttacgtaacgtttaacgttaccggttccgtaacggtaccggaacgtccgtaaacgggccgttaacggaccgtaggttacccgggagtttaacgggttttacgttaccgggttacgggttacgggttacccggggtacggggtaacgtaacccggttccgggaacgtttaccccgggacccgggtttacccggaccggttaccgaaccccgggttaccgtaacccggggtccccttacccccgggtccccggttaccccgttaccccgg

SEQ ID NO: 75093 - DNA, 712 bp, Homo sapiens
  misc_feature: GYAE6OF01ASSFH.49.20.B09.1.454.CMB.1.raw
  modified_base (302)..(302): a, c, t, g, unknown or other
  misc_feature (302)..(302): n is a, c, g, or t
  modified_base (337)..(337): a, c, t, g, unknown or other
  misc_feature (337)..(337): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtcgtcctcaggacagacggccaggactcacctgctctggcgatgctattcgaccaaaacattatcgtcttacgtcggtaccagcagacggccacggcacgtcccctgtcttggtgtactttanaagtacgttagagacggtcctagaggtactcccgngacgtctacgttctcgtcggccctacgacggtacgggaacgggtaaccgtaacggtaccgtacgttaagttcggacccgtagttaccggtaaggttcgggtacgttacccgaacgggacgaacgggaaccgggtaacggtacgggccttaacgggtaaccttttaacgtttaacgttacggtaaccttaaaccgtacaaacggtaacgtacctaaccggtaacgttttagtttaaccgtacgtttcgttaaccggttacggaaccgtaggtacccgtaaacggttaaacggtccccgtaaccggtttccggtacggtacccgacggaaccccgtaacggtaccccccaacccgtattccgaaccgttccttcccg

SEQ ID NO: 75094 - DNA, 706 bp, Homo sapiens
  misc_feature: GYAE6OF01AZYU3.49.20.B09.1.454.CMB.1.raw
  modified_base (236)..(236): a, c, t, g, unknown or other
  misc_feature (236)..(236): n is a, c, g, or t
tcagagtcgagagacacgaccggtgctcgatttagtgtagtgtgaagggggctgtgggtccaggaggcagaactctgggtgtctcaccatggcctggatccctctacttctcccctctcactctctgcacaggctctgaggcctctatgagctgacacagtcaccctggtgtctgtgtcctcgaggacagacggccaggactcacctgctgtggcagtgacagttacgaccaaaanattagtcgtacttacgtacggtaccgagacgaggacggaccgacggcccgacggtcccccgttgttcgttggtagttaagtttaagtaaagtacgttttacggaacgtcggtacccgtacgtaccgggtaccccgtgacgtacgtacgtttcctcgtacgcctacgacgtctacggaacggacaacgtacgtacctaccgttacaccgatacgaaggtcggtaaccggtccggaccggaagggtaccggaacgggtacgggtacctacggtacgtttaacgttaaccgtcggttaccgtaacggttccgaacgaccgacgacgaccgtaggtcgtagtaacgtttacgttcggtacggtacgttacgggacgggttacgtaccgttaccggtcgttaccggtaaccggttccggttacggccgaccgtacccggtacgggtacccacccggtccccgttccggttacccg

SEQ ID NO: 75095 - DNA, 813 bp, Homo sapiens
  misc_feature: GYAE6OF01EP903.49.20.B09.1.454.CMB.1.raw
tcagagtcgagagacacgaccggtgctcgatttagtgtagtgtgaagggggctgtgggtccaggaggcagaactctgggtgtctcaccatggcctggatcctctacttctcccctctcactctctgcacaggctctgaggcctcctatgagctgacacagccaccctggtgtctgtgtcctcaggacagaccggccagtatccaccgtgccttcgtgggagtatgacctagttcgaacccaaaaagactaaattagttcgtaccttttaacgtcggttaacccaaggacctaacggaaacgacccgacgggaccccgacggtaccccccttggttcgtttaggacttaccttaattttaaagtaaaacgtacgttttagggaacggtacgggcccttaccggaaccgggtacccctaggacgtacgtaacttccttacggtgtaccttaccgaagtcccgtacgacggtacaaccgtaaacgtacggttaccgtaacggttacgaacctactaccggttaaggtcgggtaccggtaacccggggactaacggggaacgggtaacggtaccgggtaccgtaggtaacctttaacgtttacgttaggttaccaacggttacctaactaccgtaaacgaacggtaacggttaaggttcgggactttaccggtttcgttcgggttaccggtttaggtacccggggaccgggtaaacgggttaacccacgggttccgttaacccgggtaccccgttaacccggttacgggtaacccaaccgggtacccccggtaaaggtccccgtttaacccccgggg

SEQ ID NO: 75096 - DNA, 671 bp, Homo sapiens
  misc_feature: GYAE6OF01E1FDY.49.20.B09.1.454.CMB.1.raw
  modified_base (496)..(496): a, c, t, g, unknown or other
  misc_feature (496)..(496): n is a, c, g, or t
  modified_base (504)..(504): a, c, t, g, unknown or other
  misc_feature (504)..(504): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacggcctcctatgagctacgacacagtcctacccgtcggtgtctgtcgtcctcgaggacacggacggaccgaggactccactgcctcgtggcgatcgactatacgaaccaaaatatagtgtacttacgtacgtaccagcgaaggcggaccgacggaccgaccggtcccttgttcggttaggtagttaatttaagtaaacgtcgtttacggacggccggtcctacggaccggtcctaggacgtacttacgttctacggtcgtctccggacgtccgacgaacggacacgtacgtcctaacctacgactacgacgtggacggtacgccggagaggacggtacgaggtactacgtacttnttacggtntaccgtacggccacgagtacgcgtagtacggttcgtacgttagttagtcggttaacggtacgggtcggaacgggtaacggtccgtacggtcggttaccgggtaccgttcggaccggtacgaacccggtccggtacgtccccggttcccgttacccggccggttaccg

SEQ ID NO: 75097 - DNA, 733 bp, Homo sapiens
  misc_feature: GYAE6OF01B1YF8.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctctcactctctgcacaggctctgagcctctatgagctcggaacacagtccaaccccgttcgggtgtcctgttcgtacctcgagggacagaccggaccaggactcacctgcctcgtggacatgactaattacgaaccaaaaaatatatgtcttacgtagtaccagacgaaggacgaccacggccgaccggtcccctggttcttggtagtaatttaacgaaaacgtctttagacggtacgcccgtacgaccgggaccctggacgcgtattctcgtcgactcacgcaacggacggaacaactacggtacctaaccttacgaaacccgtagtacccgtaaggtacggtaaccgggtcccggaaccggaaaggtaaccgggaaccggtaacgggtactaacggtacttaaacgtttacgcgttaccgtacgtacccgaacgtaacgtaaccgaggtaacgtacgggtgtacggtaagtttaacgtagggtttaaccgttacggtaccggggaacggtaaccgggttaaccgtacggtacgttaccgaacccgggtttacccgaggttaacccgaacggtaacccggtaacggccgtaccccggttcccccgtaggttaacccg

SEQ ID NO: 75098 - DNA, 842 bp, Homo sapiens
  misc_feature: GYAE6OF01D53A9.49.20.B09.1.454.CMB.1.raw
  modified_base (504)..(504): a, c, t, g, unknown or other
  misc_feature (504)..(504): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacgaggctctgacggcctcctatgagctgacacacgtccacccgtcggtgtcttgtcgtcctacgaggacacggcgccaggactccacctgctcgtggcatcgactattccgaaacctaaaaactaataacttcgtactttacgtacggtaccagcgaacggacggccgaacggccgaccggtccccgttggttcttagtacttacttaattttaaagtaaacgttacgtttaggaacggtacggtacccgtacggtaaccgggtaccccgttaggaccggtaccgttacgtttccgttccgtcggtccctaccgaccgtccgtaacacggaacgaaacctaaccgtacggtaccgtaccggttcaaacccgtntacggtagggtacgggccgggtacccggggtacaacggggaacgggtcggaacgggtttacgtacgttaaacgttaaccgttttacggtctttaacggacgttaacctacgtaccgtaagtaaccggttaagggtttacccggtacggttaacctttaaccggttcgggttaaccgtttaaccgggtttacggggttcccgggggaccggggttaaacgggtaaacccggtaaccggttacccgggttaccggtaaccccgggtaccggtttaaccgggacccctaaaccccgggtacccggtaccccggtcccgggtttacccccgtccccccgggg

SEQ ID NO: 75099 - DNA, 965 bp, Homo sapiens
  misc_feature: GYAE6OF01BUSKG.49.20.B09.1.454.CMB.1.raw
  modified_base (161)..(161): a, c, t, g, unknown or other
  misc_feature (161)..(161): n is a, c, g, or t
  modified_base (175)..(175): a, c, t, g, unknown or other
  misc_feature (175)..(175): n is a, c, g, or t
  modified_base (187)..(187): a, c, t, g, unknown or other
  misc_feature (187)..(187): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacngtccaccctcggtntctgtcgtcctnaggacagacggccaggactcacctgctcgtggcgatcgactattcgaaccaaaaactattacgtgtaccgtttaacgtaggttaacccagaccggaacggacggaccgaaccggtacccgaaccggttcccccgttagtttcccggtttagggttaacgtttaaagttttaaacgtaaaaacggttaacgttttacgggaacggtaccgggttaccccgtaccggaacccgggtaccccgtaggacggtacgttacttccgttacgtcgggtcctaccgacgtacgtacggaacggtaactaacgtaccgtcctaaccgttacgaacccttagacggttacggtacgggtaccggttacccgggaacggtaacgggaacgggtaaaccgggtacggtaccgttaacggtaaccttttaaacggtttacccgtacggttttacccgaccggttacccggtaacggtaaaccgtaacccggtacggtaaccgggttaaccgggttacgggtaccgttttaaacggtttacggttaacccgggggtttttacggttaaaccggggtttaccccgggggtaaacgggggttaaaccccgggggttaaacccggttaaccgggtccccggttaaacgggggtttaaccccccgtttacccggggtaaaacggtttacccccgggaaaccccggggtttaacccccggtaaacccgggggtttaacccccccttttccccccggggtaacccccccgtttaacccgggggttttaaaccccccg

SEQ ID NO: 75100 - DNA, 745 bp, Homo sapiens
  misc_feature: GYAE6OF01BGIOV.49.20.B09.1.454.CMB.1.raw
  modified_base (594)..(594): a, c, t, g, unknown or other
  misc_feature (594)..(594): n is a, c, g, or t
tcagagtcgagagacacgaccggtgctcgatttagtgtagtgtgaagggggctgtgggtccaggaggcagaactctgggtgtctcaccatggcctggactccctctaccttcctcccctcctcactctctgcagagctctgacggcctctatggagctagaacacgacgtcctacccgtggtgtctgtcgtcctacgaggaccaggaccggaccgaaggactccgacctggtcctcggtcgggactagttcgacgtaacttaccgaaaaccaaaaataattactacgttacctttacggtacggtaaccgagacgacggtaccggaccgacggaccgtaccggtccccgtggttcggttacggtttataaagtttaagtaaacgttacgttaggacggtacccgtccgttaccggaccgggtacccgagaggttaccgtacgttcgtacggcgtccgcgtacgcgtaacgaacggtaacacgtacgtaccctacgtaccacgtacgtacgcggtaccgtacggaccggtacggaacggtacgggaacggtacgtacgtacgtaacttacgtacgtacgtacgacgtctaacganacggtcacggtagtaacgggttagttactttaaggtgggtaacccgtttagggaccgtaccgggtacgttaccgtacgggccgttaaccgggtccgtaagtccggaccgtaaccggaccgccggtacccgttccggaccccgttcctacgg

SEQ ID NO: 75101 - DNA, 721 bp, Homo sapiens
  misc_feature: GYAE6OF01EGDEZ.49.20.B09.1.454.CMB.1.raw
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
tcagagtcgagagacacgaccggtgctcgatttagtgtagtgtgaaggggctgtgggtccaggaggcagaactctgggtgtctcaccatggcctggactccctctacttcctccccctcctcactctctgccacaggctctggacggtccctcctatgacgctgacacagtccacccgtggtntctgtcgtcngagacagcgccagctccactgctcgtggacatgactattacgaaacctaaaaatatacgtcgtacgttacgtacgtaaccacgacgaggacgaccgacggaccgtaccggtcccgttcgttcggttaggtagttaagtttaacgtaacgttacgttacggaccggtacccgtacccgtacggtaccggtacccgtagacgtacgtacttccgtaccgtccgtacctacccgtacgtaccgtacggaaacgaacctaaacgtaccgtacctaccgtaccgtaaccgtagtacggtaggtaccggtaccggaccggacgtaaggacggaacgtacggtacgtacgtaacgttagttacggtcgtaccgtcgaccgagacgaacgcgtagtaggtacgtagttacgttacggttacgtacggtacggtacgggtacgggtaacgtaccgtaccggtacgtacccggtaccggttccggaccggtaccgacccggtacccgtacggaccccgttacccggtccccgtgtccc

SEQ ID NO: 75102 - DNA, 704 bp, Homo sapiens
  misc_feature: GYAE6OF01AT3Z6.49.20.B09.1.454.CMB.1.raw
  modified_base (161)..(161): a, c, t, g, unknown or other
  misc_feature (161)..(161): n is a, c, g, or t
tcagagtcgagagacacgaccggtgctcgatttagtgtagtgtgaagggggctgtgggtccaggaggcagaactctgggtgtctcaccatggcctggactccctctacttctcccctcctcactctctgcacaggctctgagcctcctatgagctgacacncgtacaccctggtgtctgtcgtacctcgagactaggccggacctaggactccaccttggctacggtcggcgtagtgactaacgttcgaaccaaaaactatacgttacgtaccttacgttacggacctaaggacgaaggacggaccgacggtaccgaccgggtaccccttggttaccgtttaggttagttaaactttaacgtaaaacggttcgttagacggaccggtccctaccggacccggtacccgtgacggtctacggttcctcgtccgtactacgtagtaccgacgtaacggaccaagtaccgtacttaactcgacctagtcgtacggttggaccgccggtacgaggtacggaaccgtcggacttagacgttacgttacgtcgtacgtaccgcctaacgactaccgaggtaccgtaggtacgtacgtagttacgtcttagggtaccgttagggacggacgtacccgtaggtcgtcccgaacggttccgacgacgacccggtaaccggaccgtcccgttacccgtccccgtggttaccccg

SEQ ID NO: 75103 - DNA, 823 bp, Homo sapiens
  misc_feature: GYAE6OF01BGNA2.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctggacggcctactatgagtctagacacacgtcctacccgtcgggttgtctggttcgtcctcgacggacgacggaccggccgaggatccaccgtgtcctcgtaggcgtatcgctacgttacgaacctaaaaacattagtactcttaacgtcggtaaccacggacgaggaaccggccgaacggcccgaccggtccccgttcgttcggttggtagttaactttaagtaagttacgtttaggacgtccgtccgtaccgaccgggtaccccgtaggaccgtacgtacttccgtcgtcggtcctacgacgtaccgacggtacgaaccactacggtcctaaccgtcacgtacgtaccggtaggtacggtacggtaccccggacggtacggggaaccggacgggtaacggtacgtaacgtttaacgttaacctttacgggtacccgtacgtacccgggtacccgacggtaaaccgaacggccggaccgggtaagggtcgggtttaaccgttaaggtttaccggttaacggtttcgggttaaccgggtacggggggaccgggttacgggtaacccgggttaccgtccgggttaacccggtacccggggttacccgtacgggtacccgtaaaccgggtacccgggtacccggttccccccgtcccccgggttccccgggttcccgttaacccccg

SEQ ID NO: 75104 - DNA, 681 bp, Homo sapiens
  misc_feature: GYAE6OF01CG52L.49.20.B09.1.454.CMB.1.raw
  modified_base (187)..(187): a, c, t, g, unknown or other
  misc_feature (187)..(187): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgacggcctctatgagctgacacagtccacccgtggtgtctgtcgtcctnaggacaggacggccaggactccactgctcgtggctatgactagttacgaaccaaaaacattatgtacttacgtacggtaccagacgaaggacgccgacggcccgaccggtccccttagttcgttaggtacgtaagtttaactaaaggtactttggaacggtaccggtccctacggaaccgggtcccctaggacgtacgtacttccgtcgtacggtcctaccgacgtcgtaacgacgggaacctaacgtaccgtacctaaccgttagaccctagtccgtaaggtacggggtacctacccgggacgtaagggacgggaccggtacggtacttacgtaacgttactttcgtacggtactacggtaccgacaagcgtacgagtacggtcgtagtagtttaacgtgtttacggacgttcgggacggtcgtacgtacgtcgtacgacccgttgaccggtccaacggcccgttacggtccctcccggtcccgtcggtaccc

SEQ ID NO: 75105 - DNA, 890 bp, Homo sapiens
  misc_feature: GYAE6OF01DLZJ7.49.20.B09.1.454.CMB.1.raw
  modified_base (178)..(178): a, c, t, g, unknown or other
  misc_feature (178)..(178): n is a, c, g, or t
  modified_base (183)..(183): a, c, t, g, unknown or other
  misc_feature (183)..(183): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgagcctctatgagctgacacagtccaccctggtgtctgtntcctnaggacagacgccaggactcactgctcgtggacgatgctattacgaacaaaaacattacgtgtacttacgtacggtacagacgaggacggaccgacggcccgacggtccccgttggttacgtttcggtagttaattttaacgtaaacgttacgtttaggacggaaccggtacccttaccggaaccgggtaccccctaggtacggtccgtaacttcgtccgtcggacctccgacgtcgtaacggacggaaccaacgtacgtaccctaccttaggacctacggtacggtaacggtacgggtaccggtacccgggtaacggaacgggaacgggtaaccggaacgggtacggttaaccgtaaccgttttaacgtttaaccgttacggtaacccggtaaccgggtttacccgaacgtaaccggtaaccggtaacgtaccgggtaacgggttacgggtaacgtttaacgggttttaacggtttaccggtttacggggtttaccggtttaacccgggggaaccgggggtaaaccgggtttaaacccgggtaacccggggttaccgggtttaaaccccgggttacccccggggttttaaacccgggtttaaccccgggttacccggtaaaccccggtacccccgggttaaacccgggtccccccggtttaacccccggggttacccccgggtttaccccgggtttaaccccccggg

SEQ ID NO: 75106 - DNA, 729 bp, Homo sapiens
  misc_feature: GYAE6OF01B1DMK.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctctatgagctgacacagtccacctcggtcgtctgtcgtcctcgaggacacggacggccgaggactcacctgctcgtggcgagtcgactagttcgaaccaaaaacgtattagtcgtacttacgtcggtaccagtcgaaggacgccgaacggccgaccggtccccgtgttacgttagggtacgttaagttttaaacgtaaacggttacgtttacggaacggtaccgggtaccccgtacggaaccggggtacccctaggtacggtaccgttacgttccgtacgtcggtaccttaccgacgtccgtaacggaaccgggaactaaccgtacgttacccgtacgttaccgaccgaagttacggacgggttcggaaaccgtcccgggacgaaaggggacggaaaccgtcgggtaacttacgggaacttaacggtttcgtccgtacggacggtaccgacgtaacgacgacgttacgagggtacgtacggtagtttacggtggttacgtcggtacgggacggtacgggtactagtccggtacgtaccggtacgtagtaccgaccgtacgtacgaccgtccgttcccgtggtacc

SEQ ID NO: 75107 - DNA, 766 bp, Homo sapiens
  misc_feature: GYAE6OF01BSEUE.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgacggcctcctatgagctgacacagtccacccgtggtgtcgtgtgtcctgaggacaggacggccaggactcactgctcgtggcatgctagttacgaacctaaaacaattagtcgtacttacgtacggtaaccagacgaggacggtccgacggacccgaccggtccccttggttccgttagggttagttaaacttttaagtaaaacgttacgtttaggaacggtaccgggtcccctaacggacccgggtaccccgttaggaccggtacgttacttccgtacgtcggaccctcgacgtacgtacggaacggtaacaacgtccgttacccgtaacgtccggaaccttggtaaccgtacgggtaccgggtaaccggtaccccgtaacggaagggtaacggaacgggtacggttacgtacggtaactttaacgttacgtacgtaccgaccggtccgacgtaaccggacgacgtacggtaggtcgggtacttaacggtttagttcggtacggttcgggtacgggggacggtacggtaccgtacggtccggttaccggtaccggttccgtaccggtacggaacccggtacccgtaacggttcccccgtacccgggtccccgttacggtaccccg

SEQ ID NO: 75108 - DNA, 765 bp, Homo sapiens
  misc_feature: GYAE6OF01DNODE.49.20.B09.1.454.CMB.1.raw
  modified_base (336)..(336): a, c, t, g, unknown or other
  misc_feature (336)..(336): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgacggcctcctatgagctgacacagtccacccgtggtgtctgtcgtcctgacggacaggaccgccaggactccacctcgcttcgtggcgatcgctacgttacgaaaccaaaaactattatcggtaccttacggtacgtaaccagacaacggacgccgacggcccgacgtcccctgttctagacttataagtttaanaacgttacgttaggacggtcggtcctacggaccggaccctaggacgtacgttacttcctcgtcgacctcgacgtctacgacgaccgaactaacgtcgtacgtacgtacgactacgtacgacgggtacgggacggtaccgggagtaacgggaacgggacgtacgggtactacggttaaccttacggttacgtacgtacgtacgtaccgtaacgtacgaacgtaaccggttagtttccgggtacgttacctttaccggtttcgttacgggtttaaccgggttaccgggtaccgggggtaaccggggttaacccgggtaaacccgtaacgggttcccgggttacccggttaacccccggtttaacgggaaccgggtttccccggaaccggttaccccggtaaccggtcccggtacccccggttacccccggg

SEQ ID NO: 75109 - DNA, 721 bp, Homo sapiens
  misc_feature: GYAE6OF01EG22Z.49.20.B09.1.454.CMB.1.raw
  modified_base (130)..(130): a, c, t, g, unknown or other
  misc_feature (130)..(130): n is a, c, g, or t
  modified_base (481)..(481): a, c, t, g, unknown or other
  misc_feature (481)..(481): n is a, c, g, or t
  modified_base (489)..(489): a, c, t, g, unknown or other
  misc_feature (489)..(489): n is a, c, g, or t
  modified_base (571)..(571): a, c, t, g, unknown or other
  misc_feature (571)..(571): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctncacaggctctggacgccctctatgagctagaccacacgtccacccgttcggtgttcgtgttcgtcctcgaggacaggaccgcaggactctacgtcgctcgtggcgtatcgacacttacgaaaccaaaaactattatcgtcttacgtcggtacagacaggacgccgacggccgaccggtccccgttgttcgttggtacgttaagttttaacgtaaagttaccgtttaggaacggtaccggtacccgtaccggaacccgggtaccccgtaggtaacggacttcgtttccgtcggtcggtccctacccggtaacggtcctaaccggaacggaacaacttacgtacctaccgtanaccgttanacggacgggttcgaccgggtaccgacgtacgggacggacgtaggtctacgtacttacttcgtacgtaccacggtccacgtanacgtcggactaggttcgagttacttagttcgtacgttcggtaccgggtacggacggtaccgtccgggtaccttacgggtacccgttccggtaacggaccgtacccggtaccgtaacccggtccccgtttccccggccccgtgtacccccg

SEQ ID NO: 75110 - DNA, 773 bp, Homo sapiens
  misc_feature: GYAE6OF01EGHNC.49.20.B09.1.454.CMB.1.raw
  modified_base (168)..(168): a, c, t, g, unknown or other
  misc_feature (168)..(168): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctggacgcctctatgagctgacacacgtccnccctggtgtctgtcgtcctacgaggacgagacggccaggatccgacctgctcgtggactgtagcctaagtacgaaccaaaaataacgtatacggtacttaacgtcggtaccagacgaaggaccggtaccgacggtaccgaccggtcccgttagtttaccggtttggtagttttaaacgtttaaaagtaaacgtttaacggtttacgggaggaaccccgggttaccccaggggtaaacccccgggtcccgaaggttccggaacgttttacgtccttaacgggtcgttccctaacgggaacgttccaaacggggaacgaaaccaacggttaccaccctttaacgaacccgaacttcgaaggttcgggaacgggttaccgggccccgaaggaacggggtaacgaacgggtccgtagtaaacccgttattaacgtacggtccgtaagtcccggaccaacggaacgaacgcgaagtcgggtactaagttacgttagtcgggttaacgtcggggtaccggacggggtactaaccggcgttacgtaccgggtccgtacggttccgaacgcccgtaaacgggcccttacggcccccgttccggtcgtaccccg

SEQ ID NO: 75111 - DNA, 704 bp, Homo sapiens
  misc_feature: GYAE6OF01BPD42.49.20.B09.1.454.CMB.1.raw
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (531)..(531): a, c, t, g, unknown or other
  misc_feature (531)..(531): n is a, c, g, or t
tcagagtcgagagacacgaccggtgctcgatttagtgtagtgtgaagggggctgtgggtccaggaggcagaactcgtgggtgtctcaccatggcctggatccctctacttcctccccctcctcactctctgcaacaggctctgacggcctcctatgagctagacacagtccacccgtcggtgtctgtgtcctcgaggacaggaccggacaggatccaccgtgctgtggnagtnactattacgaaaccaaaaagtaatactacgtacttacgtacggtaaccagacgacggaacgccgacggaccgacggtccccttggtcgttaggtacgtaatttaaagaaaacgttcgttaggacggacggtaccctaggacccgggacctaggtacgcgtattccgtcgacgctacgatccgacgaaggaaccaactagacctactacaacctataccgaggtcggacgtccggacggtaagacggacggtacgtaactacggtaacttaagttacctagtaaccgtactcccggaanaaccggtacgaacggtacggtacgggtagtaaccgtaagtttaagaccgggttcgtaaccgggttgggaaccgggttaacggggaaccttacggtccgaacggtacccgttaccgaaggttcccaacgggtaaaccctaccgggactttacccccgggccttcggggtaaccc

SEQ ID NO: 75112 - DNA, 1002 bp, Homo sapiens
  misc_feature: GYAE6OF01DXRC6.49.20.B09.1.454.CMB.1.raw
tcagagtcgagagacacgaccggtgctcgatttagtgtagtgtgaagggggctgtgggtcaggaggcagactctgggtgtctcaccatgcctggactcctctacttcctcccctcctcactctctcgcacgacggctcgtggacggtccttacctagtgagtctgacactacgtccaccgtggtgtctcgtcgtcctacacggtacacggaccggccaggactccaccgttcgccttacgtcggactactcgtactaagttaccgaaaacctaaaaactattacgtacgttacctttaacggttacggtaacccgaggtaaccggaacgggtaaacccggggcccggacccggtaccggtcccggtttagggttcggttacggggtaagttaagttaacggttaaaacggtaaaacggtacccgtaacggtacgggtaaccggtaacccgggtccgtaaaccgggtacggggttacccttcccgggaacgggtaggtaccgttttacggtttccgttaccgggttaccggggtaccgttaaccgggtaacgggggtaaaccggtaaacggggtaaacccgttaaaccgggttaccgtaaaccggtttacggttaaccgggtaaccttacggttaacccgggttagggggtaaccggtaaccgggttaacccggaaggggtacccggtaaacggggtacggggtaaccgggttacgggtaacccgtttaacggttaacccttttaagggttttaaccggttaacgttaaactaaaacgggtaacccctaaagtaacccgggtaacccttacggtttaaaccgggttttacgttttaaccgttaacggtttcccgggtttacgttaaaccggtaaacccgggttccggaaacccggttaaccggttaaccggttccccgtaaacggggttcccggttacggtaaacccggacccctaacccggaacccgttaacccctaccgtaacgttcccacccggtttacc

SEQ ID NO: 75113 - DNA, 720 bp, Homo sapiens
  misc_feature: GYAE6OF01A212E.49.20.B09.1.454.CMB.1.raw
  modified_base (132)..(132): a, c, t, g, unknown or other
  misc_feature (132)..(132): n is a, c, g, or t
  modified_base (217)..(217): a, c, t, g, unknown or other
  misc_feature (217)..(217): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacnggctctgaggcctcctatgagctgacacagtcaccctggtgtctggtcgtcctgaggacagaccggcaggactcacctgcttcgnggcatcgactatacgaaccaaaacaatagtcgtcttacgtaggtaccagcaggacggccgacggccgaccggtcccttgtcgttggtagttaatttaagtaaacgttcgtttaggacggtaccggtccctaccggaccgggtacccgtaggacgcgtacgttcgtcgcgtacctccacggtcctacgaacggtaaccaacgttaccgtcctaaccgtcgaaccgtacgtaggtacggtacgggtaccggtccggaccggtaagggacgggaacggtcggtacgtacgtaacttagttacgtcgtactaccgtcgaacgtacgacgtcgacggtacggtacgtacgttacggtttacgtagggttaccgggttacgggtacgggggtacgggtaacgggtaccgtaacccggtcggtaacccggtccccggttacggttaccggacccgtacggtacccggtaacccggtccccgttccccggtcccccggttccgttacccgg

SEQ ID NO: 75114 - DNA, 663 bp, Homo sapiens
  misc_feature: GYAE6OF01CW6S5.49.20.B09.1.454.CMB.1.raw
  modified_base (247)..(247): a, c, t, g, unknown or other
  misc_feature (247)..(247): n is a, c, g, or t
tcagagtcgagagacacgaccggtgctcgatttagtgtagtgtgaagggggctgtgggtccaggaggcagaactctgggtgtctcaccatggcctggatcctctacttcctcccctcctcactctctgcacgaggctctgacggcctcctatgagctgacacatccaccctggtgtctgtgtcctcgaggacagacggcaggactcacgtgctacgtggcgatgacagttacgaacaaaaacaatanacgtcttacgtacggacagacaaggacgcgacgcgacggccctgtcgttggtagtaacttaagaaagtcttaggacgacgcctacggacggtacccgtgacgtacagttccgtcgtcgtccgtcagtaccacggaaggaacactacgtactacctacgaacctagcgtaggcggtcgacccggagaaccgggaggacgacggtacaggtactaacgttacgtacgtaccgtcgtaccgacgaacgttaaccgaggaacctagggtaccgtaggttaagttacgttacggtacggtacggttccgggaaacgggtaccgggtaaccgacggtaccgtaccggtacccggttacgaaccggttaccaaccggggaccctaacgggtcccgtaaccccgggttccccgcgggtttaccc

SEQ ID NO: 75115 - DNA, 935 bp, Homo sapiens
  misc_feature: GYAE6OF01EESIU.49.20.B09.1.454.CMB.1.raw
tcagagtcgagagacacgaccggtgctcgatttagtgtagtgtgaagggggctgtgggtccaggaggcagaactctgggtgtctcaccatggcctgatccctctacttcctcccctcctcactctctgcacgaggctctgacgcctactatgagtctagacacgacgtacctaccccgttcggttgttccgttggttcgttccgtacggaaggaccgaacgggaccggaccgaaggtaacttccctacccgtcgtccttccggtacgggacgtacgttacggtaccttacgttaaccgaaaaccctaaaaaactaaagttaacgttaccgttaaccgttttaaccggttaaccggttaaacccgaacggaccggtaaacgggaaccggggacccggaacccgggtacccccgtaaacccccgggttccggttaccggttttccggtttagggtttaaacggttttaaaacgtttttaaaaccggttaaaaggtttaccggttttaacgggaaccgggtacccggttacccgtaaccgggtaacccgggtacccgtacgggtacgtaccgttcttaccgttccgtccggtcctaccggacgtaccggtaacggaacgggaacctaactaccggttaccctaaccgtacgtaactacggttacgtacgggtccgggtaccggtaccggacggtaacggacgggtaacgacggttcgtaacgttacttacgttacgtacgtcgaccggtcaacgcgtaacgacggtacgtacgggattaacggtttagttaacggttacggtttaccggtgggttaaccggggtaccggggtaaaccgtaaccggtccgtacggtacccgggtacggttaccccgggtacggtaacccgaccggtacccggttaccgtacccccggtcccgttccccgtacgtccccg

SEQ ID NO: 75116 - DNA, 794 bp, Homo sapiens
  misc_feature: GYAE6OF01CMFZE.49.20.B09.1.454.CMB.1.raw
  modified_base (136)..(136): a, c, t, g, unknown or other
  misc_feature (136)..(136): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactcggtctgcacnggctcgtgagtccctacctatagagctacgacactacgtaccacccgtcggtgtctggttcgtcctcgaggaccgacggaccggacgaggactccgacctcgtcctcgtcggacgtagtacgtactagttaccgaaaacccaaaaataacttaacgtcgtaccgtttaaccgtacggtaaccgacgtaccgaggaaccgggacccgaccgggtaccccgaccggtcccccggttaggtttaccggtttagggttaacgtttaaagttttaacggtaaacggtttacggttacggtaacgggtacccgtccccgttaaccggaacccggggtaccccgtaggaccggttaccgtaatttcccgtcgtccggtccctacgtacgtacggtaaacggaaccactaccgtaccgtacctacggactacgtacgtacggtacggtcccggtaccgacggaggtaacggacgtacggactacgtattacgttcgtacgtctaccgtaccagacgagtacggcgtacggtgtagttacgttgttacggtacggtacggtacggtacggtaccggtacgtaccgtcggtaccgtaccgttaccggtacggtaccgacccgtacccggtaccgtacccgtcccgttcccccgtccggtccttcccgg

SEQ ID NO: 75117 - DNA, 492 bp, Homo sapiens
  misc_feature: GYAE6OF02I8JAU.49.20.B09.1.454.CMB.1.raw
  modified_base (352)..(352): a, c, t, g, unknown or other
  misc_feature (352)..(352): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcagggacccctgagcgattctctggctccagctcagggacaacngtcaccttgaccatcagtggagtccggccagaggacgaggctgactattactgtcagtccgcagacagcagtgcagttatgtcgtattcggcggaggactacgctgaccgtctagtcacgccaaggctcgcccctggtcc

SEQ ID NO: 75118 - DNA, 493 bp, Homo sapiens
  misc_feature: GYAE6OF02IYI3B.49.20.B09.1.454.CMB.1.raw
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttanaaagctttgagaggccctnacgggacccctgagcgattctctggctcagctcagggacaacagtcaccttgaccatcagtgagtccggcagaggacgaggctgactattactgtcagtccgcagacagcagtgcagttatgtcgtattcggcgagggactacggctcgaccgtcgtagtcacgccaaggctcgccccgtggtcc

SEQ ID NO: 75119 - DNA, 497 bp, Homo sapiens
  misc_feature: GYAE6OF02G3XJO.49.20.B09.1.454.CMB.1.raw
  modified_base (311)..(311): a, c, t, g, unknown or other
  misc_feature (311)..(311): n is a, c, g, or t
  modified_base (353)..(353): a, c, t, g, unknown or other
  misc_feature (353)..(353): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaaagactttgagaggccctnagggacccctgagcgattctctggctcagctcagggacaacngtcaccttgaccatcagtggagtccggcagaggacgaggctgactattactgtcagtccgcagacagcagtggcagttatgtcgtagttcggcggagggactacgctgaccgtctaggtcagcccgaaggctcgcccctggtcc

SEQ ID NO: 75120 - DNA, 798 bp, Homo sapiens
  misc_feature: GYAE6OF02JAQHW.49.20.B09.1.454.CMB.1.raw
tcagagtcgagagacacgaccggtgctcgatttagtgtagtgtgaaggggcggtgtgggtccacggaggcagaactactgggtggtcttccacctagtggcctggatccctctacttactccccctcctcgactctcctgcactagggctctagagggtccctccttatgagtactggacaccaggtcaccctcggtgtctgtgtccgtcgaggacagggacgggccagggactcgacctggcgtcctggcgatgcattgccaaaacatatggcttactggtacctagacacgaggccgaggccagggccccctggttcgttcggtgagttttactaaacgacgtttcgaagggaggtccccgtacggtacggggtaccccgtggtaggtcggttagttttcgtccgttggggaccttaccgtagactacccgtaaggggtaccaaccgaggttaccgaacccgtttaggaacccgtagttaccgtacggtacgggtaacggtccccgggtcccgaacgggaacgggaccggtaacgggtaccgtaggtaaccttaagttttaaacctttggttacccttacgttacccgggcctaacgggaaccgaacggtccgtaggtaggggtaccggtacggttaaacgttcggtaccggttaacgttacggggtccggggtaacggggttaaccggttaaccgggtcgttaccggtacccgggttaacccggttaacggggtccgaacggtacccccggaacgggtaccggttacccggtccccccggtaggggtttaccccg

SEQ ID NO: 75121 - DNA, 501 bp, Homo sapiens
  misc_feature: GYAE6OF02HC6F6.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggcccctgtcttggtgatttataaagactttgagaggccctcagggacccctgagcgattctctggctcagctcagggacaacagtcaccttgaccatcagtggagtccggccagaggacgaggctgactattactgtcagtccgcagacagcagtggcagttatgtcgtagttcgggcggagggactacggctgaccgtcctaggtcacgcccgaaggctcgcccccgtggtcc

SEQ ID NO: 75122 - DNA, 494 bp, Homo sapiens
  misc_feature: GYAE6OF02IQDHL.49.20.B09.1.454.CMB.1.raw
  modified_base (482)..(482): a, c, t, g, unknown or other
  misc_feature (482)..(482): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggaccctgagcgattctctggctccagctcagggacaacagtcaccttgacccatcagtggagtccggcagaggacgaggctgactattactgtcagtccgcagacagcagtggcagttatgtcgtagttcggcggaggactacgctgaccgtcctaggtcagcccaaggcncgccccgtgtcc

SEQ ID NO: 75123 - DNA, 508 bp, Homo sapiens
  misc_feature: GYAE6OF02G2ANH.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagctttgagaggccctcgagggacccctgagcgattctctggctccagctcagggacaacagtcaccttgaccatcagtggagtccggcagaggacgaggctgactattactgtcagtccgcagacagcagtgctagttatgtcgtagttcgggcggagggtactacggcgtacgaccgtccgtaggtcacgcccgaaggcctcgccccgtggtcc

SEQ ID NO: 75124 - DNA, 494 bp, Homo sapiens
  misc_feature: GYAE6OF02GZCOQ.49.20.B09.1.454.CMB.1.raw
  modified_base (442)..(442): a, c, t, g, unknown or other
  misc_feature (442)..(442): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggcccctgtcttggtgatttataaagactttgagaggccctcagggacccctgagcgattctctggctccagctcagggacaacagtcaccttgaccatcagtggagtccgaccagaggacgaggctgactattactgtcagtccgcagacagcagtgcagttatgtcgtatcggnggagggactacgctgaccgtcgtaggtcacgccaaggcctcgcccctggtcc

SEQ ID NO: 75125 - DNA, 806 bp, Homo sapiens
  misc_feature: GYAE6OF02H08EV.49.20.B09.1.454.CMB.1.raw
tcagagtcgagagacacgaccggtgctcgatttagtgtagtgtgaagggggctgggtgggtcccaggacggcgagtaacctctgggtgttctcacctatggcctggatcccgtctacttctccccctcctcactctctcgcacgaggtcgtctgaggcctcgttactgtagctgttaacgacacgtcaccctcggtgtctgtgtccttcgagggacacgggacgggcctagggtactccgacccgttggggcccttcgtgggccgtacttcggcctagttcgacccgaaaacccggtattaagtcggtccttttaacttttcgggtaaaccctaaacgtcctaagggaaacggtcccggggcccaacgggtcccccggttcggtccggtttagggtcgtacgttaggggtaaaggtaaaacggacgtaacgtttgggacgtaacgggaccccttacgtaacggggtaacttccccgtaggtacgggacggtaacgtttcctctacgggccttaccgtacgggttccgaacggggtacccgtaaacggggtacgaacccgtagtttccgggaccctaattccgacggtagggacgtaccgaacgggcaaaggaacggacgaggtcgtagtacttattacttagtacaacgtcaacgacgaactaaccgacgttacgggtaacttagtcgttcgtttacgtaacttcggacgtaaccgaacgggtaccggaacccgggttccgtacggggttaccacggttacccgtaacggtacccctaaccccgtaacgttccgtacctaacccgg

SEQ ID NO: 75126 - DNA, 499 bp, Homo sapiens
  misc_feature: GYAE6OF02FW2FH.49.20.B09.1.454.CMB.1.raw
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttaactggtaccagcagaggccaggccaggcccctgtcttggtgatttataaaagactttgagaggccctcagggacccctgagcgattctctggctccagctcagggacaacagtcaccttgaccatcagtggagtccggcagaggacgaggctgactattactgtcagtccgcagacagcagtgcagttatgtcgtattcggcggagggactacggctgaccgtccgtaggtcagcccaaggctcgccccctggtcc

SEQ ID NO: 75127 - DNA, 489 bp, Homo sapiens
  misc_feature: GYAE6OF02IU09M.49.20.B09.1.454.CMB.1.raw
  modified_base (330)..(330): a, c, t, g, unknown or other
  misc_feature (330)..(330): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaagccgggccaggcccctgtgttggtgatgtataaagacactgagaggccctgagggatccctgagcgattcnctggctccgaggtcagggacaacggtcacattggccatcagtggagtccaggcagaggacgaggctgactattattgtacaatcaacagacacattggtacttatgtcttagactgcgacaggtcaccgtctggcagcccaggcccaaccactcgctac

SEQ ID NO: 75128 - DNA, 529 bp, Homo sapiens
  misc_feature: GYAE6OF02IUUPN.49.20.B09.1.454.CMB.1.raw
  modified_base (238)..(238): a, c, t, g, unknown or other
  misc_feature (238)..(238): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtcggtgtccccaggacaaacggccaggataacctgctctggagatgcattgaccaaaaaaatntgcttgttggtaccagaagaagtcaggccaggccccggtgttgctcatctatgacgacagaaaacgaccctccgggatccctgagagattctctggctccacctcacgggaccatggccacgttgactatcaggcggggcccagggtggaggatggaaggtgactactattgttactcaccagacaccagtagaaatcacagagaatagttcggcggagggaccagctgaccgtctaggtcagcccgaaggcctcgcccctcggtccacgtctcgtcccgccctcctctcc

SEQ ID NO: 75129 - DNA, 497 bp, Homo sapiens
  misc_feature: GYAE6OF02HF0FY.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcagggacccctgagcgattctctggctccagctcagggacaacagtcaccttgaccatcagtggagtccggccaggaggacgaggctggactattactgtcagtccgcagacagcagtgcagttatgtcgtattcggcggaggactacgctgaccgtctaggcagcccgaaggctcgcccctgtacccg

SEQ ID NO: 75130 - DNA, 518 bp, Homo sapiens
  misc_feature: GYAE6OF02I9RUC.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttataaagtactttgagacggccctcgacgggacccctgagcgattctctggctccagctcgagggacaacgagtcaccttgaccatcagtggacgtccggccaggaggacgaggctgactattactgtcagtccgcacgacagcagtcgctagttatgtcgtagttcgggcggaggactacggcgtacgaccgtcgtaggtcacgcccgaggcctccggccccgtggtcc

SEQ ID NO: 75131 - DNA, 521 bp, Homo sapiens
  misc_feature: GYAE6OF02IDR1V.49.20.B09.1.454.CMB.1.raw
  modified_base (234)..(234): a, c, t, g, unknown or other
  misc_feature (234)..(234): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcagagccaggccaggcccctgtcttggtgattttanaaagactttgagaggccctcgagggacccctgagcgattcnctgctcagctcgaggacaacagtcaccttgaccatcagtggagtccggcagaggacgaggctgactattacgtgtcagtccgcagacagcaggtgctagttatgtcgtagttcgggacggtagggacgtacggcgtcggaccgtaccgtaggtccgacgacccgaaggtccctcggtcccccgtggtaccc

SEQ ID NO: 75132 - DNA, 505 bp, Homo sapiens
  misc_feature: GYAE6OF02GCTLE.49.20.B09.1.454.CMB.1.raw
  modified_base (413)..(413): a, c, t, g, unknown or other
  misc_feature (413)..(413): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagctttgagaggccctcagggacccctgagcgattctctggctccagctcaggacaacagtcaccttgaccatcagtggagtccggcaggaggacgaggctgactattactgtcagtccgnagacagcagtgcagttatgtcgtagttcggcggagggactacggctcgaccgtccgtaggtcacggcccaaggcctcgcccccgtcggtacc

SEQ ID NO: 75133 - DNA, 498 bp, Homo sapiens
  misc_feature: GYAE6OF02IEVQL.49.20.B09.1.454.CMB.1.raw
  modified_base (289)..(289): a, c, t, g, unknown or other
  misc_feature (289)..(289): n is a, c, g, or t
  modified_base (382)..(382): a, c, t, g, unknown or other
  misc_feature (382)..(382): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttanaaagactttgagagggcctcagggacccctgagcgattctctggctcagctcagcgacaacagtcacgtttgaccatcagtggacgtccgggnagagacgaggctgacttattactgtacagtcatcagacagtagtggctacttctgttcgtattcggcggagggaccaagctgaccgtctaggtcacgcccaaggctcgcccctcgg

SEQ ID NO: 75134 - DNA, 516 bp, Homo sapiens
  misc_feature: GYAE6OF02HRQIA.49.20.B09.1.454.CMB.1.raw
  modified_base (233)..(233): a, c, t, g, unknown or other
  misc_feature (233)..(233): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaanatatgcttactggtaccagcagaggccaggccaggcccctgtcttggtgatttataaagctttgagaggccctcgacgggacccctgagcgattctctggctccagctcgagggacaacagtcaccttgaccatcagtggagtccggcagaggacgaggctgactattactgtcagtccgcacgacagcagtggactagttatggtcgtacgttcgggcggagggactacggcgtacgtaccgtccgtaggtcgacgccgaaggcctcgcccccgtcggtccg

SEQ ID NO: 75135 - DNA, 504 bp, Homo sapiens
  misc_feature: GYAE6OF02GH6OF.49.20.B09.1.454.CMB.1.raw
  modified_base (353)..(353): a, c, t, g, unknown or other
  misc_feature (353)..(353): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacgaccaggatcacctgctctggcgatgcattgaccaaaaacaatatgcttactggtaccagcagaggccaggccaggcccctgtcttggtgatttataaagctttgagaggccctgacgggaccctgagcgattctctggctccagctcagggacaacngtcaccttgaccatcagtggagtccggcagaggacgaggctgactattactgtcagtccgcagacagcagtggctagttatgtcgtagttcgggcgggaggactacggctgaccgtctaggtcacgcccaaggcctccgccccgtcggtcc

SEQ ID NO: 75136 - DNA, 538 bp, Homo sapiens
  misc_feature: GYAE6OF02JLDZW.49.20.B09.1.454.CMB.1.raw
  modified_base (284)..(284): a, c, t, g, unknown or other
  misc_feature (284)..(284): n is a, c, g, or t
  modified_base (312)..(312): a, c, t, g, unknown or other
  misc_feature (312)..(312): n is a, c, g, or t
  modified_base (333)..(333): a, c, t, g, unknown or other
  misc_feature (333)..(333): n is a, c, g, or t
  modified_base (355)..(355): a, c, t, g, unknown or other
  misc_feature (355)..(355): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatccacctgctctggcgatgcattgaccaaaaacatatgcttactggtaccagcagaggccaggccaggcccctgtcttggngtatttaataagactttgagaggccctnacgggacccctgagcgattcnctggctcagctcgaggacaacngtcaaccttgaccatcagtggacgtccggccaggaggacgaggctagacttattctgtccagtccgcagacagcgagtggctagttatgttacgtagttcgggcgggtaggtacctacggccgtacgaccggttccgtacggtccacggcccgaacggtcctacccggcccccgttggtaccc

SEQ ID NO: 75137 - DNA, 519 bp, Homo sapiens
  misc_feature: GYAE6OF02IKT0D.49.20.B09.1.454.CMB.1.raw
  modified_base (356)..(356): a, c, t, g, unknown or other
  misc_feature (356)..(356): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagtctttgagaggccctcgacgggacccctgagcgattctctggctccagctcgagggacaacngtcaccttgaccatcagtggacgtccggccagaggacgaggctagacttattactgtcagtccgcagacagcagtggctagttatgtcgttaagttcggcggtaggacgtacggctacggaccgtccgtaggtccacggcccgaaggcctcgccccctggtcc

SEQ ID NO: 75138 - DNA, 707 bp, Homo sapiens
  misc_feature: GYAE6OF02J25T3.49.20.B09.1.454.CMB.1.raw
  modified_base (290)..(290): a, c, t, g, unknown or other
  misc_feature (290)..(290): n is a, c, g, or t
tcagagtcgagagacacgaccggtgctcgatttagtgtagtgtgaaggggcgtgtgggtccgaggaggcagaactctgggtgtctcaccatggcctggatccctctacttcctccccctcctcactctctgcacaggctctgaggcctcctatgagctgacacagtcaccctcggtgtctgtgtcctcaggacagaccggccaggatccacctgctctggcgatgcattgccaaaacaatatgcttactggtaccagccagacggccaggccaggccccctgtcgttggngtaatttaacgtaaagtacgttttgaggtacggtccccttcgaacggggtaccccctggacgcgtaatttccgcgtcgggtcctccgaagcccttacgaacggggtaacctaaaccgacgttacccgaaccctttcggaaccctaagtcccgaggttcgggaccggttccccgggacccgaacgggtaacggaaccgggacgggtacctaaggtaccttaacttaacgtcggtaccgtaacggtcccgtacaacggaacacggtaccgaggttggaccttaggtttaactggttaccgttaagttccgggacggtacgggaccttaccggtaccgtcgtacccggttacccgttacgggtacctacccggacccggaacggttcccggtcccggtaccccccgtcgggttaaccccg

SEQ ID NO: 75139 - DNA, 503 bp, Homo sapiens
  misc_feature: GYAE6OF02GLZ4L.49.20.B09.1.454.CMB.1.raw
  modified_base (490)..(490): a, c, t, g, unknown or other
  misc_feature (490)..(490): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccgaccagaggacgaggctgactattactgtcagtccgcagacagcagtggctagttatgtcgtattcgggcggagggactacgcgtgaccgtcgtaggtcacgcccgaggccncgccccgtggtcc

SEQ ID NO: 75140 - DNA, 493 bp, Homo sapiens
  misc_feature: GYAE6OF02IVCWR.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcagggacccctgagcgattctctggctcagctcagggacaacagtcaccttgaccatcagtggagtccggcagaggacgaggctgactattactgtcagtccgcagacagcagtggcagttatgtcgtattcggcggaggactacggctgaccgtctaggtcacgccaaggctcgcccctggtcc

SEQ ID NO: 75141 - DNA, 503 bp, Homo sapiens
  misc_feature: GYAE6OF02HL735.49.20.B09.1.454.CMB.1.raw
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctnagggacccctgagcgattcnctggctccagctcagggacaacagtcaccttgaccatcagtggagtccggcagaggacgaggctgactattactgtcagtccgcagacagcagtgcagttatgtcgtagttcgggcggagggtactacgctcgaccgtccgtaggtcacgcccgaaggcctacgcccctggtcc

SEQ ID NO: 75142 - DNA, 535 bp, Homo sapiens
  misc_feature: GYAE6OF02G4DNK.49.20.B09.1.454.CMB.1.raw
  modified_base (423)..(423): a, c, t, g, unknown or other
  misc_feature (423)..(423): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgattttataaagactttgagacggccctgacgggacccctgagcgattctctggctcagctcgagggacaacagtcaccttgaccatcagtggacgtccggcaggaggacgaggctagacttattactgtcgagtccgnacgacagacgagtcggctagttatcggtacgttagttcgggacggtagggacgtacggcgtcgacccgtccgtacggtcacgcccgtaaggtcctcggtccccgtggtaccg

SEQ ID NO: 75143 - DNA, 503 bp, Homo sapiens
  misc_feature: GYAE6OF02GRDTK.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagactttgagaggccctcagggacccctgagcgattctctggctcagctcgaggacaacagtcaccttgaccatcagtggagtccggcaggaggacgaggctgactattactgtcagtccgcagacagcagtgctagttatgtcgtatcgggcggaggactacggctacgaccgtcgtacggtcacgcccgaaggcctcgccccctggtcc

SEQ ID NO: 75144 - DNA, 555 bp, Homo sapiens
  misc_feature: GYAE6OF02HFI1M.49.20.B09.1.454.CMB.1.raw
  modified_base (234)..(234): a, c, t, g, unknown or other
  misc_feature (234)..(234): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaanatatgcttactggtaccagcagaggccaggccacgcccctgtcttggtgatttaataaagtactttgagacggccctcgacgggacccctgagcgattctctggctcagctcgagggacaacagtcaccttcgaccatcgagtggacgtccggaccgaaggaggacggaggctagacttattactgtacaatcaacagacacctattacggtacttatcgttacttaccgggaactcggacgaccgtacggtcctacccggtccgttgggtaccaacggacccgaaggaccccaacccgcttcgacctactccgttcccgg

SEQ ID NO: 75145 - DNA, 524 bp, Homo sapiens
  misc_feature: GYAE6OF02HJ3LW.49.20.B09.1.454.CMB.1.raw
  modified_base (314)..(314): a, c, t, g, unknown or other
  misc_feature (314)..(314): n is a, c, g, or t
  modified_base (359)..(359): a, c, t, g, unknown or other
  misc_feature (359)..(359): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttaactggtaaccagcagaggccaggccaggcccctgtcttggtgatttaataaagactttgagaggccctnacgggacccctgagcgattctctggctcagctacgagggacaacngtcaaccttgaccatcagtgagtccggcagaggacgaggctgactattactgtcagtccgcagacagcagtcgactacgttatggttcgtagttcggcgggaggactaccggcgtgtacccggtcgtaggtcacggcccaaggccctcggccccctcggtacccg

SEQ ID NO: 75146 - DNA, 510 bp, Homo sapiens
  misc_feature: GYAE6OF02HXC2S.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgattttataaagactttgagaggccctcagggacccctgagcgattctctggctccagctcagggacaacagtcaccttgaccatcagtggagtccggcaggaggacgaggctgactattactgtcagtccgcagacagcagtgcagttatgtcgtattcgggcggagggactacggctcggaccgtccgtaggtcgacgtcccaaggcctcgcccccgtggtacccg

SEQ ID NO: 75147 - DNA, 495 bp, Homo sapiens
  misc_feature: GYAE6OF02IBE90.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcatgcattgccaaaaacaatatgcttactggtaccagcagaggccaggccaggcccctgtcttggtgattttataaagactttgagaggccctcagggacccctgagcgattctctggctccagctcagggacacagtcaccttgaccatcagtggagtccggcagaggacgaggctgactattactgtcagtcgcagacagcagtggcagttatgtcgtagttcggcggagggactacgcgtgaccgtcctaggtcacgcccaaggctcgcccctgtcc

SEQ ID NO: 75148 - DNA, 509 bp, Homo sapiens
  misc_feature: GYAE6OF02IXY4I.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaaacagtcaccttgaccatcagtggagtccggccagaggacgaggctgactattactgtcagtccgcagacagcagtggcagttatgtcgtagttcggcggagggactacggcgtgtaccgtccgtaggtcgacgcccgaaggcctcggccccctggtccc

SEQ ID NO: 75149 - DNA, 501 bp, Homo sapiens
  misc_feature: GYAE6OF02HGMFF.49.20.B09.1.454.CMB.1.raw
  modified_base (289)..(289): a, c, t, g, unknown or other
  misc_feature (289)..(289): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttanaaagctttgagaggccctcgacgggacccctgagcgattctctggctcagctcagggacaacagtccaccttgacccatcagtggagtccggcagaggacgaggctgactattacgtgtcagtccgcagacagcaggtgctagttatgtcgtagttcggacggagggactacggctcgaccgtctaggtcacgccagcctcgccccgtgtcc

SEQ ID NO: 75150 - DNA, 543 bp, Homo sapiens
  misc_feature: GYAE6OF02IUEHF.49.20.B09.1.454.CMB.1.raw
  modified_base (355)..(355): a, c, t, g, unknown or other
  misc_feature (355)..(355): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgtatttataaagactttgagaggccctcgacgggacccctgagcgtatctctggctcagctcaggacaacngtccacttgacctatcagtggacgtccggacaggacggacgaggctagactattactgtcagtcatcagacagtagtggctacttcttgtcgttagtcgggcggacgggaccaaggcctacggaccggtaccgtacgggtacaaccggtacccgaacgggtccgtacccggtcccccgttcggtaccc

SEQ ID NO: 75151 - DNA, 516 bp, Homo sapiens
  misc_feature: GYAE6OF02IZVY0.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtcttggtgatttataaagactttgagaggccctcacgggacccctgacgcgattctcgtggctccagctcgaggacaacgacgtcaccttgaccatcagtgagtccggcagaggacgaggctgactattactgtacacgtcgacacgacagcgagcggactagttagtcgtacgtagttacgggcggaggacgtacgcgtagaccgtcgtaggtacagcccgaagcctcgcccctggtacc

SEQ ID NO: 75152 - DNA, 669 bp, Homo sapiens
  misc_feature: GYAE6OF02I5OFG.49.20.B09.1.454.CMB.1.raw
  modified_base (280)..(280): a, c, t, g, unknown or other
  misc_feature (280)..(280): n is a, c, g, or t
  modified_base (287)..(287): a, c, t, g, unknown or other
  misc_feature (287)..(287): n is a, c, g, or t
tcagagtcgagagacacgaccggtgctcgatttagtgtagtgtgaaggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggccctgtcttggngatttanaaagtctttgagacggccctagacgggacccctggagccgatttctcgtcggccctagcgtccgaggaacgaacacgtaccgtaccttacggtaccaactcgtaggtacgggtacggtacccggccgaacgggaacgggaaccggaacgggacgtagtaaccgttaacttaacgttacggtacgtacgtacccggacgacgaacgtacgacggtaaggtacggtacgtaagttacgttacggttcggttaacggttaccggggcggtaacggggtaccgtacggtaccgtccgggaaccggttacccggtaggttaccgaaccggtacccggtaaccgggccgttaccgggtccccccgttaccggggttaccctaacccgg

SEQ ID NO: 75153 - DNA, 555 bp, Homo sapiens
  misc_feature: GYAE6OF02IRC41.49.20.B09.1.454.CMB.1.raw
  modified_base (289)..(289): a, c, t, g, unknown or other
  misc_feature (289)..(289): n is a, c, g, or t
  modified_base (359)..(359): a, c, t, g, unknown or other
  misc_feature (359)..(359): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctgggcatgcattcgaccaaaaacaatatgcttactggtaccagcagaggccaggccaggccctgtctggtgatttanaaagtcttgagagcctcgagggaccctgagcgattctctggctcagctcaggacaacagtcaccttgacntcagtgacgtccgccgagacggagacggctgacttattactcgtcagtccgacacgacacgcgagtaggctaaggtttatgttacgtagttcgggacgggagggtaccgttacggccgttacggtaacccggtaccgttagggtaccgacggaccccgtaaagggtcccgtccggtaccccccggtcggttacccg

SEQ ID NO: 75154 - DNA, 503 bp, Homo sapiens
  misc_feature: GYAE6OF02GBPH4.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcacgggacccctgagcgattctctggctcagctcagggacaacagtcacttgaccatcagtggagtccggcagaggacgaggctgactattactgtcagtccgcagacagcagtggctagttatgtcgtagttcgggcggaggactacggctcgaccgtccgtaggtcacgcccgaaggcctcgccccgtggtcc

SEQ ID NO: 75155 - DNA, 520 bp, Homo sapiens
  misc_feature: GYAE6OF02FUS66.49.20.B09.1.454.CMB.1.raw
  modified_base (357)..(357): a, c, t, g, unknown or other
  misc_feature (357)..(357): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcgacgggacccctgagcgattcctctggctccagctcgagggacaacgngtcaccttgaccatcagtggacgtccggcaggaggacgaggctagactattactgtcagtccgacagacagcagtgctagttatgtcgtagttcgggcggaggacgtacggctacggaccgtccgtaggtcacgcccgaaggtcctcggcccccgtggtcccg

SEQ ID NO: 75156 - DNA, 495 bp, Homo sapiens
  misc_feature: GYAE6OF02F3QME.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacgacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggcagaggacgaggctgactattactgtcagtccgcagacagcagtgcagttatgtcgtattcggcggaggactacgctgaccgtcctaggtcagcccaaggctcgcccctggtcc

SEQ ID NO: 75157 - DNA, 716 bp, Homo sapiens
  misc_feature: GYAE6OF02JX3RC.49.20.B09.1.454.CMB.1.raw
  modified_base (295)..(295): a, c, t, g, unknown or other
  misc_feature (295)..(295): n is a, c, g, or t
  modified_base (304)..(304): a, c, t, g, unknown or other
  misc_feature (304)..(304): n is a, c, g, or t
tcagagtcgagagacacgaccggtgctcgatttagtgtagtgtgaaggggcgtgtgggtccaggaggcagaactctgggtgtctcaccatggcctggatccctctacttctcccctcctcactctctgcacaggctctgaggcctcctatgagctgacacagtccaccctcggtgtcctgtgtcctcgaggacaggaccggccagggactccgacctgcctctggccgatgcattcgaccaaaaacatatgcttactgtaccagcagaggccaggccaggcccctgtccgttggngtatttaanaaagtacttttggaacgcggtaccctcgacggggacccctgaagccgtattccgtcgtcggcctccgagtcctcggaacgggtaaccaaacgcgttaccgtaccttcggaacctacgtacgtacggtcggtaacggttccccgggaccgacgggacgggaaccggacggtaccgtcgtaaccttaagttaaccgtcggtaccgtaccgtcccgacgaacggaaccgacgtacgtacgggtacggtaccgtaagggtttaacgttcgggttaccggttaaaggtttccggggaccgggtacggggtaccgttaacccgggcgtttaccgggaacccggtttaccccggttaaggtacccgttacggaaccccggtaacggtcccgtacccggtcccccgttaccggttacccg

SEQ ID NO: 75158 - DNA, 505 bp, Homo sapiens
  misc_feature: GYAE6OF02I0PJ4.49.20.B09.1.454.CMB.1.raw
  modified_base (356)..(356): a, c, t, g, unknown or other
  misc_feature (356)..(356): n is a, c, g, or t
  modified_base (451)..(451): a, c, t, g, unknown or other
  misc_feature (451)..(451): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagacggccctcacggggacccctgagcgattctctggctccagctcgagggacaacngtcaccttgaccatcagtggagtccggcagaggacgaggctgactattactgtcagtccgacagacagcagtggctagttatgtcgtagttcggnggaggactacgctcggaccgtctaggtcacgccgaaggcctcgccccgtggtcc

SEQ ID NO: 75159 - DNA, 905 bp, Homo sapiens
  misc_feature: GYAE6OF02FL4YV.49.20.B09.1.454.CMB.1.raw
tcagagtcgagagacacgaccggtgctcgatttagtgtagtgtgaaagggggacgtcgtgggtcccagggaggccagaactcttgggtgtctcaccatggcctgggatccctctacttctccccctcctacactcctctggctacgaggctctgagggttccctccgttatcgagtactgaccactagtcaaccctcggtgtctgtgtccgtcacggggacagtacgggtcccaagggacggttccaccgtggccttctggcgatcgcatttgccaaaaactacttatgcttactggtaccagcagaggccgaggccaaggccccctgtcgttgggtcgtagttttagtaaaggtaccttttggaacggtaagggtccccttacgtaacgggggtaaccccccttgggaacggtaccggaactttaccttacgttggggtccgttacccgtacggtccgttaccggaacgggggtaactaaaaccgtacggttacctaaccccgttttcggaaaccccgtaagtacccgaacggttacgggaaacggttaccccgggacccgtaacgggtaacggggtaaaccggtaacggggtaccgttacgggtaaaccgtttaaacggtttaaacccgttacgggtttacccgtaaacgggttaccccgggtaaccggtaaaccgggaaaccgaaacgggaccgttaacgggttaggggtaccgtaagggtttttaacgttgggtttacccggttaagtttacccggggtaccggggttaacggggttaaccgtttaaccgggtacccgttacgggtaaccccggttacccgttaacgggttaccggtaaccggtaccccggtaaaccgggtcccgttacccgggtacccccccggttccgggttacccccg

SEQ ID NO: 75160 - DNA, 508 bp, Homo sapiens
  misc_feature: GYAE6OF02GWWVC.49.20.B09.1.454.CMB.1.raw
  modified_base (288)..(288): a, c, t, g, unknown or other
  misc_feature (288)..(288): n is a, c, g, or t
  modified_base (352)..(352): a, c, t, g, unknown or other
  misc_feature (352)..(352): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtctggtgatttanaaagactttgagaggccctgacggacccctgagcgattctctggctccagctcgagggacaacngtcaccttgaccatcagtgagtccgcagaggacgaggctgactattactgtacagtccgcagacaggcagtgcagttatgtacgtattcgggcggagggactacgcgtcgaccgtccgtaggtcgacgacccgaaggccgtcgccccgtacggtcc

SEQ ID NO: 75161 - DNA, 513 bp, Homo sapiens
  misc_feature: GYAE6OF02F221E.49.20.B09.1.454.CMB.1.raw
  modified_base (309)..(309): a, c, t, g, unknown or other
  misc_feature (309)..(309): n is a, c, g, or t
  modified_base (412)..(412): a, c, t, g, unknown or other
  misc_feature (412)..(412): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctnagggacccctgagcgattctctggctcagctcaggacaacagtcaccttgaccatcagtggagtccggccagaggacgaggctgactattactgtcagtccgnagacagcagtggcagttatgtcgtagttcggcggagggactacggcgtcgaccggttccgtaggtccgacgcccgaaggccgtcggtcccccgtggtaccc

SEQ ID NO: 75162 - DNA, 604 bp, Homo sapiens
  misc_feature: GYAE6OF02GFS8G.49.20.B09.1.454.CMB.1.raw
tcagagtcgagagacacgaccggtgctcgatttagtgtagtgtgaagggggcgtggtgggtccaggaggcagaactctgggtgtctcaccatggcctgggactccctctacttctccccctcctcactctctgcacaggctctgaggcctcctatgagctgacacagtccaccctcggtgtctgtcgtcctcaggacagacggccaggatcacctgctctggcgatgcattgaccaaaaacatatgacttactaggtaccagtactagaggccaggccaggacccctggtcttggtagtatttataaaaggtacttttggagtagggcccctcgacgggtaccccctggtacgcgtaattccgtctgggtcctaccgagtctcgagggacaacgagtcctaccttagacctaattcacgtggacgtcccggactacggaggacgaggtcctagactaagttactgtctagtccgacacgacagacaggtacgctaagtttagtcgtacgttagttcgggacggacgggtactaccggtcgtacgaccggttcctaacgggtacctacggcccgaacgggcctaccggtaccccgtcggtacccg

SEQ ID NO: 75163 - DNA, 519 bp, Homo sapiens
  misc_feature: GYAE6OF02I0D3E.49.20.B09.1.454.CMB.1.raw
  modified_base (289)..(289): a, c, t, g, unknown or other
  misc_feature (289)..(289): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttanaaagctttgagaggccctcacggggacccctgagcgattctctggctccagctcgaggacaacagtcaccttgaccatcagtggacgtcggcaggacggacgagctgactattactgtcgacgtccgcagacagacagtggcgtagttatgttacgtgttcgggcggtaggactacggtctacgacccgtcgtaggtcacgcccgaaggccgtcgtcccccgtggtaccc

SEQ ID NO: 75164 - DNA, 503 bp, Homo sapiens
  misc_feature: GYAE6OF02HQKCM.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggcccctgtcttggtgatttataaagacttttgagaggccctcacgggacccctgagcgattctctggctccagctcaggacaacagtcaccttgaccatcagtggagtccggccagaggacgaggctgactattactgtcagtccgcagacagcagtgcagttatgtcgtattcggcggagggactacggctcggaccgtccgtaggtcacggcccaaggcctcgcccctggtacc

SEQ ID NO: 75165 - DNA, 508 bp, Homo sapiens
  misc_feature: GYAE6OF02G5F09.49.20.B09.1.454.CMB.1.raw
  modified_base (289)..(289): a, c, t, g, unknown or other
  misc_feature (289)..(289): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaacaatatgcttactggtaccagcagaggccaggccaggcccctgtcttggtgatttanaaagtctttgagaggccctcgacgggacccctgagcgattctctggctcagctcgaggacaacagtcacttgaccatcagtggagtccggcaggagacgaggctagactagttactgtcacgtccgcagacagcagtgcagttatggtcgtagttcggacgggtaggtactacgcgtgaccggtctaggtcacgcccaaggcctccgccccgtcggtcc

SEQ ID NO: 75166 - DNA, 519 bp, Homo sapiens
  misc_feature: GYAE6OF02IMTDK.49.20.B09.1.454.CMB.1.raw
  modified_base (234)..(234): a, c, t, g, unknown or other
  misc_feature (234)..(234): n is a, c, g, or t
  modified_base (310)..(310): a, c, t, g, unknown or other
  misc_feature (310)..(310): n is a, c, g, or t
  modified_base (420)..(420): a, c, t, g, unknown or other
  misc_feature (420)..(420): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaanatatgcttactggtaccagcagaagccgggccaggcccctgtgttggtgatgtaataaagacactgagaggccctnagggactccctgagcgattctctggctccaggtcagggacaacggtcacagttggccatcagtggagtccaggcagaggacgaggctgacttattattgtacaatcaaanagaacacctattaggtacttatcgttcttacggaactgcgaaccaaggtccaccgtctgggtcacggacccaaggcccaaccccgtactcggtcctacg

SEQ ID NO: 75167 - DNA, 520 bp, Homo sapiens
  misc_feature: GYAE6OF02IU43Y.49.20.B09.1.454.CMB.1.raw
  modified_base (238)..(238): a, c, t, g, unknown or other
  misc_feature (238)..(238): n is a, c, g, or t
  modified_base (363)..(363): a, c, t, g, unknown or other
  misc_feature (363)..(363): n is a, c, g, or t
  modified_base (376)..(376): a, c, t, g, unknown or other
  misc_feature (376)..(376): n is a, c, g, or t
  modified_base (419)..(419): a, c, t, g, unknown or other
  misc_feature (419)..(419): n is a, c, g, or t
  modified_base (450)..(450): a, c, t, g, unknown or other
  misc_feature (450)..(450): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatccacctgctcgtggcgatgcattgacccaaaaanaatatgacttactggtaccagcagaggccaggccaggcccctgtcgttggtgtatttataaagctttgagacggccctgacgggaccctggagcgtattctctaggctcagctcgacggacaacngtcacgttgaccntcagtggacgtccgacgagacggacgaggctagactagttacngtacagtccgacagacagacagtgctagttngtcgtagtcgacggagacgacgctacgacgtccgttagcgtacgccgtagcgtccgtaccccgtgtaccg

SEQ ID NO: 75168 - DNA, 610 bp, Homo sapiens
  misc_feature: GYAE6OF02J0SWG.49.20.B09.1.454.CMB.1.raw
tcagagtcgagagacacgaccggtgctcgatttagtgtagtgtgaaggggcgtgtgggtccgaggaggcagaactctgggtgtctcaccatggcctggatccctctacttctcccctcctcactctctgcacaggctctgaggcctcctatgagctgacacagtcaccctcggtgtctgtgtcctcgaggacagacggccaggactcgacctgctctggcattgctattgaccaaaacatatgcttactggtaccagcagacgccaggccaggcccctgtccgttggcgtatttataaagtactttggagaggccctagacgggacccctggacgcgtattcctcgtcggcctaccgagctccgtaggggaaccaacgaggtaccaccttagacctatcgtagtcggacgttcccggccgtaaggacggaaccggaggtcgtagtaacgtacgttactacgtacgtacgtaccgtcacgacgtacgacgtacggtcgggcctaaggtttacgcgttacggtagttccggggacggaggtaccgtacggccgtacggtccgtaccgtagggtaccacggaccgtacggtcgtaccgcccccggtgtacccg

SEQ ID NO: 75169 - DNA, 641 bp, Homo sapiens
  misc_feature: GYAE6OF02H783K.49.20.B09.1.454.CMB.1.raw
  modified_base (231)..(231): a, c, t, g, unknown or other
  misc_feature (231)..(231): n is a, c, g, or t
  modified_base (286)..(286): a, c, t, g, unknown or other
  misc_feature (286)..(286): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagacggccaggatcacctgctctggcgatgcattgccaaaanatatgcttaactggtaccagcaggacgcagccacgccctgtctggtgtatttaanaagtctttgagacggccctagacggaccctgacgcgtattctcgtcggctccgagtcctacgaagggaacctaacgacgtacctaccgtttacgaacctacgtacgtaggtacgggtacggtaccccgggaccgaagggaacgggtaacggacgggtcctaggtaacttaacgttacgttcgtacgtacggttcccgacgaacgacgacgacgtaggtcggacgtagtttagtcggttacgttacggttcgggacgggacgggtaaccgttacggcgttaccggtacccggtaccgttacggtaccgacggtaccccggaaggtcccgtacccggtccccccgttaggtaccccg

SEQ ID NO: 75170 - DNA, 501 bp, Homo sapiens
  misc_feature: GYAE6OF02FVAZT.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcacgggacccctgagcgattctctggctccagctcagggacaacagtcaccttgaccatcagtgagtccggcagaggacgaggctgactattactgtcagtccgcagacagcagtgcagttatgtcgtagttcggcggaggactacgctgaccgtcgtaggtcacgcccgaaggtcctcgcccccgtggtccc

SEQ ID NO: 75171 - DNA, 505 bp, Homo sapiens
  misc_feature: GYAE6OF02FRIAE.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcagggacccctgagcgattctctggctccagctcagggacaacagtcaccttgaccatcagtggagtccggcagaggcgaggctgactattactgtcagtccgcagacagcagtggcagttatgtcgtagttcgggcggagggactacggctgacccggtcctaggtcacgcccgaaggcctcgcccccgtggtccc

SEQ ID NO: 75172 - DNA, 510 bp, Homo sapiens
  misc_feature: GYAE6OF02H94VX.49.20.B09.1.454.CMB.1.raw
  modified_base (284)..(284): a, c, t, g, unknown or other
  misc_feature (284)..(284): n is a, c, g, or t
  modified_base (456)..(456): a, c, t, g, unknown or other
  misc_feature (456)..(456): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtntattttataaagtctttggagacggccctcgacgggacccctgagcgattctctggctccagctcgacggacaacagtcaccgttgaccatcagtggacgtccggcagaggacgaggctgactattactgtcacgtccgcagacagcagtgctagttatgtcgtagttcggngaggactacgctcgaccgtcgtacgtcacgaccgaggtcctcgtcccctgtacc

SEQ ID NO: 75173 - DNA, 499 bp, Homo sapiens
  misc_feature: GYAE6OF02GG318.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccagccccctgtcttggtgatttataaagactttgagaggccctcagggacccctgagcgattctctggctccagctcagggacaacagtcacattggccatcagtggagtccaggcagaggacgaggctgactattattgtcaatcaaacagacaccattggtacttatgtcttcgaactgcgaccaaggtcaaccgtcctgggtacagcccaaggcccaacccactcgctac

SEQ ID NO: 75174 - DNA, 899 bp, Homo sapiens
  misc_feature: GYAE6OF02JYZTS.49.20.B09.1.454.CMB.1.raw
tcagagtcgagagacacgaccggtgctcgattagtgtagtgtgaagggtctgtgggtccaggaggcagaactctggtgtctcaccatggcctggatccctctacttctcccctcctcactctctgcacaggctctgacgcctctatgagctgacactagtccacccgtggtgtctgtcgtcctacgagggacaggaccggccaggactccacctcggtcctcgtggacctaagtcgacctaagttacgaaccctaaaactattacgttcgtacctttaccgtacggtaccgaggaccgacggaccgggacccgaacggcccgtaacgggtcccccttgtttaccgtttagggtacggttaattttaaagtaaaacggtacgttttacggaacggacgggtccccttacggaacggggtaaccccctggaacgtcgtactttccgtcgtacggtcctaccaggacctaccggaacggggaacctaaaccgtacggtaccctaaccctttcggaacctacgtaccgtaaggttaccgggaccggttaccccgggaacgaacggggtaacgggaaaccggtacgggttaccgttacgtaaccgttttaacgtttaaccgttacggtttaaccgaaccgggttaccccgacggtaacggaaccggtaacgtaccgggtaacggtttacggggtaaccggtttaacggttttaaacggttccggtttaacgggtttaaccgggttttacccgggggaaccggggtaccgggttaaacccgttcccggtaacccggttacccggtaaccccgggttaacccggttaccggttaaccggacccggtaccccggtaaaccgggtcccccgtttacccggtcccccccgggttaggtttaaccccccg

SEQ ID NO: 75175 - DNA, 489 bp, Homo sapiens
  misc_feature: GYAE6OF02F2HTZ.49.20.B09.1.454.CMB.1.raw
  modified_base (446)..(446): a, c, t, g, unknown or other
  misc_feature (446)..(446): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaagccaggccaggcccctgtcttgatcatttataaagactttgagagggcctcagggacccctgagcgattctctggctccagctcagcgacaacagtcacgtttgaccatcagtggagtccgggcagaggacgaggctgactattactgtcagtcatcagacagtagtggcacttctgtcgtattcggnggagggacaagctgaccgtctaggtcagcccaggctcgccccg

SEQ ID NO: 75176 - DNA, 703 bp, Homo sapiens
  misc_feature: GYAE6OF02JE8Q0.49.20.B09.1.454.CMB.1.raw
  modified_base (288)..(288): a, c, t, g, unknown or other
  misc_feature (288)..(288): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacaatatgcttactggtaccagcagagccaggccaggcccctgtctggtgatttanaaagtactttgagacggccctcgacggaccctgacgcgattctctgtctccagctcgaggacaacacgtcaaccttagaccctatcgaggtcggacgtccgggacctacggaacgggaccggaacgggtcctacggtaaccgttaaacgttttaccgtggtttacccgtaacgggttccccgtacgaaccggtaaccgaacggaccgtaacggttcgggacccgttaaggttttaacgtcgggttacggtttaaacgggttccggggtacccggggtacggggttaaaccgttaccgggtaccggttaccgggaaccccggtttaccccgggttaacgggtttacccgaacggttaccccccgggaaagggttccccgtttacccgggtacccccccgttaccggggttcccccg

SEQ ID NO: 75177 - DNA, 507 bp, Homo sapiens
  misc_feature: GYAE6OF02GLQCF.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcagggacccctgagcgattctctggctccagctcagggacaacagtcaccttgaccatcagtggacgtccggcagaggacgaggctgactattactgtcagtccgcagacagcagtggctagttatgtcgtattcgggcggaggactaggctaggaccgtccgtaggtcacggcccaaggcctcggtccccctggtcc

SEQ ID NO: 75178 - DNA, 504 bp, Homo sapiens
  misc_feature: GYAE6OF02HKUG7.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttataaagactttgagaggccctcgacgggacccctgagcgattctctggctcagctcagggacaacagtcaccttgaccatcagtggacgtccggcagaggacgaggctgactattactgtcagtcgcagacagcagtgctagttatgtcgtagttcggcggagggactacggctcgaccgtctaggtcacgcccgaaggctcgccccgtcgtacc

SEQ ID NO: 75179 - DNA, 531 bp, Homo sapiens
  misc_feature: GYAE6OF02I1SKI.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtccttggtgtatttataaaagactttgaggacggccctcgacgggacccctgacgcgtattcctctggctccagctcgagggacaacagtccaccttgacctatcagtggacgtccggccagaggacgaggctgactattactgtcacgtccgcagacagcgagtgcgtagttagttgtcgttagtcggcggagggactaccgctcgaccgtccgtaggtcgacgcccgaaggccgtccgcccccgttggtaccc

SEQ ID NO: 75180 - DNA, 501 bp, Homo sapiens
  misc_feature: GYAE6OF02HAEGH.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcagggacccctgagcgattctctggctcagctcagggacaacagtcaccttgaccatcagtggagtccggccagaggacgaggctgactattactgtcagtccgcagacagcagtggcagttatgtcgtagttcgggcggagggactacggctgaccgtcgtaggtcacgcccgaaggctcgccccgtggtcc

SEQ ID NO: 75181 - DNA, 533 bp, Homo sapiens
  misc_feature: GYAE6OF02HH81P.49.20.B09.1.454.CMB.1.raw
  modified_base (175)..(175): a, c, t, g, unknown or other
  misc_feature (175)..(175): n is a, c, g, or t
  modified_base (260)..(260): a, c, t, g, unknown or other
  misc_feature (260)..(260): n is a, c, g, or t
  modified_base (284)..(284): a, c, t, g, unknown or other
  misc_feature (284)..(284): n is a, c, g, or t
  modified_base (292)..(292): a, c, t, g, unknown or other
  misc_feature (292)..(292): n is a, c, g, or t
  modified_base (364)..(364): a, c, t, g, unknown or other
  misc_feature (364)..(364): n is a, c, g, or t
  modified_base (383)..(383): a, c, t, g, unknown or other
  misc_feature (383)..(383): n is a, c, g, or t
  modified_base (452)..(452): a, c, t, g, unknown or other
  misc_feature (452)..(452): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtntctgtgtcctcaggacagacggccaggatcacctgctctggcgatgcattgaccaaaaacaatatgcttaactggtaccagcagngccaggccaggcccctgtctggtntatttaanaaagtactttgaggacgccctcgacggacccctgagcgtaattctctggcctacagcctcgaaggacaacgngtccacttgaccatcgagnggacgtccggcaggaggacgagctagacttagttactgtcacgtccgacagacagcgagtcgctagttntcggtatagttcgggacggaggactcgtcgtcgaccgtcgtacggtccacgcccgaagtcccgtacgtccccgtgtacccg

SEQ ID NO: 75182 - DNA, 503 bp, Homo sapiens
  misc_feature: GYAE6OF02I2YX1.49.20.B09.1.454.CMB.1.raw
  modified_base (460)..(460): a, c, t, g, unknown or other
  misc_feature (460)..(460): n is a, c, g, or t
  modified_base (490)..(490): a, c, t, g, unknown or other
  misc_feature (490)..(490): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagacggccctcgagggatccctgagcgattctctggctccaggtcagggacaacggtcacattggccatcgagtggagtccgaggcaggaggacgaggctgacttattattgacaatcaacagacacctattgtacttatgtctcggaactgcgacaggtcnccgtctgggtcacgcccaaggcccaacccnctcgtccactccg

SEQ ID NO: 75183 - DNA, 525 bp, Homo sapiens
  misc_feature: GYAE6OF02I1EW8.49.20.B09.1.454.CMB.1.raw
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttanaaagtactttgagaggccctgacgggacccctggagcgattctctggctccagctacgaggacaacngtccacttgaccatcagtggacgtccggcagaggacgaggcgtgactattactcgtcacgtccgcgacgacgagcgagtggcgtagttagtgttcgtagttcggacggacggtacgtacggtcgtcggaccgtccgtacgtcacgccgaaggctcgccccgtcgtcc

SEQ ID NO: 75184 - DNA, 697 bp, Homo sapiens
  misc_feature: GYAE6OF02JE5TP.49.20.B09.1.454.CMB.1.raw
  modified_base (282)..(282): a, c, t, g, unknown or other
  misc_feature (282)..(282): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcgatgcattgaccaaaaacatatgcttacgtggtaccagcagagccaggccagccctgtcttggngtatttagaaagtctttgagacggccctagacgggtaccctggacgtcgtattccgtcgtcgggtaccttccgagtcctaccgaacgggaacctaaacgacggttacccaaccgtttacggaaccctaagttccgaacgggtacggaaccggttcccgggacccgaagggaacgggaaccggagggtaccgtacggtaaccttaagtttaacgtacgttaccgaacggttacccggactaacggaaccgaggtaccaggttacggacgttaaggtttatcggttacgttaaggttccggggacgggtacgggtaaccgtacggtacccgttacggtaacccggttaccggacgggttaccaacccgggacccgtacggtcccggttacccggtccccccggttacgggtaacccc

SEQ ID NO: 75185 - DNA, 517 bp, Homo sapiens
  misc_feature: GYAE6OF02JBJAW.49.20.B09.1.454.CMB.1.raw
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggcaggcccctntcttggngtactttataaaagactttagagacggccctacgacgggaaccccctgacgcgattctctgctccagctcagggacaacgagtcaccttgaccatcacgtggacgtccggccagaggacgaggctagactattacngtcagtccncagacagcagtgctagttatgtcgtatcggcggaggactcggacctaggaccgttccgacggttcacgtacccaaggctcgccccgtgtccg

SEQ ID NO: 75186 - DNA, 507 bp, Homo sapiens
  misc_feature: GYAE6OF02HIQSY.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagactttgagaggccctcacgggacccctgagcgattctctggctcagctcgagggacaacagtcaccttgaccatcagtggacgtccggccagaggacgaggctgactattactgtcagtccgcagacagcagtggctagttatgtcgtagttcgggcggagggactacgctcggaccgtcgtaggtcacgcccgaaggcctcgcccctcggtcc

SEQ ID NO: 75187 - DNA, 544 bp, Homo sapiens
  misc_feature: GYAE6OF02JPVBP.49.20.B09.1.454.CMB.1.raw
  modified_base (356)..(356): a, c, t, g, unknown or other
  misc_feature (356)..(356): n is a, c, g, or t
  modified_base (427)..(427): a, c, t, g, unknown or other
  misc_feature (427)..(427): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataagtactttgagaggcccctagacgggacccctgacgcgattctctggctcagctcgaggacaacngtcaccttgaccatcagtggacgtccggcaggaggacgaggctgactattactgacacgtccgacagacgngcgagtgactagttatacgttcgtagttcgggacggaggtactaccggtcgtacggacccgttccgtaacggttccgaacggtcccgaacggtcctaccggtcccccgtggtacccg

SEQ ID NO: 75188 - DNA, 500 bp, Homo sapiens
  misc_feature: GYAE6OF02F30A2.49.20.B09.1.454.CMB.1.raw
  modified_base (309)..(309): a, c, t, g, unknown or other
  misc_feature (309)..(309): n is a, c, g, or t
  modified_base (444)..(444): a, c, t, g, unknown or other
  misc_feature (444)..(444): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctnagggacccctgagcgattctctggctccagctcagggacaacagtcaccttgaccatcagtggagtccggccagaggacgaggctgactattactgtcagtccgcagacagcagtgcagttatgtcgtattcggnggaggacgtacgctcgtaccgtccgtagtcgacgccgaacggctcgcccctggtcc

SEQ ID NO: 75189 - DNA, 942 bp, Homo sapiens
  misc_feature: GYAE6OF02J250C.49.20.B09.1.454.CMB.1.raw
  modified_base (260)..(260): a, c, t, g, unknown or other
  misc_feature (260)..(260): n is a, c, g, or t
tcagagtcgagagacacgaccggtgctcgatttagtgtagtgtgaaggggctgtgggtccaggaggcagaactctgggtgtctcaccatggcctggatccctctacttcctcccctcctcactctctgcacaggctctgacggcctcctatgagctgacacagtccacccgtcggtgtctgtgtcctacaggacagaccggccaggactccacctgcctcgtaggcgatcgctattcgacccaaaaacatactgcttacnggtaccagcagacgccaggccacggcccctgttccgttggtacgtaattttaagtaaaacgtactttaggaacggacggtcccccgttacggaaccggggtacccccttggaacggtaccggtaacttttcctccgttcggggtacccttacccggaacggtcccgttacggaaaacgggggaaccctaaaaccgtaccgggttacccctaacccgttttaccggaaaccccgttaagtttacccggaacgggttaccggggtaacccgggtttaccccccggggaaacccggtaaacgggggaacggggtaaacccggggaacgggttacccggttaacggtaaaccgttttaaccgttttaacccggttaccgggtttaacccggtaaccggtttacccccgggaccgtaaaccgggtaaacccggaacggtacccggtaacgggtttaccggggaaccgtttaacgggtttttaaacgttacccggggtttaaccggttaacggttttacccggggggaacccggggttacggggtaaccccgttacccgggtaccggtttaacccgggtaaccccggtttaacccgggttaaccgggtacccggtacccgggtaacccccggaaaccggggttccccgtccccggttacccccccgggtttacggtttaaccccccgg

SEQ ID NO: 75190 - DNA, 606 bp, Homo sapiens
  misc_feature: GYAE6OF02HS3M7.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaacaatatgcttactggtaccagcagaggccaggccacggccctgtcttggtgaattttaataaagtacgttttgaaggtacggccctcgacgggacccctgagcgattctctggcctccagcctacgaacgggactaacacgtccaccttgaccactacaggtcggagtcccggacaggacggacgaggctagtaacttattacgtcgtactacgtccgcaacgacacgacgacgtcggactagtttagtggttacgttacgttacgggacgggtacgggtacgttaccggtgtaccggtaaccgttccgttaacgggtccgaaccggacccggtaaggtcccgttacccggtaccccccgttcggttaaccccg

SEQ ID NO: 75191 - DNA, 529 bp, Homo sapiens
  misc_feature: GYAE6OF02GY05E.49.20.B09.1.454.CMB.1.raw
  modified_base (235)..(235): a, c, t, g, unknown or other
  misc_feature (235)..(235): n is a, c, g, or t
  modified_base (442)..(442): a, c, t, g, unknown or other
  misc_feature (442)..(442): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcagaggccaggccaggcccctgtcttggtgtatttataaagtctttgagacggccctacgacgggacccctgagcgattctcgtggctccagctcagggacaacagtcaccttgaccatcagtggacgtccggacaggaggacgaggctagactattacgtgtcagtcgcagacagcagtgctagttntgtacgtagtcgggacggagggtactacggcgtacgacccgtccgtaggtccacggcccgaaggccgtccggcccccgtcggtaccc

SEQ ID NO: 75192 - DNA, 671 bp, Homo sapiens
  misc_feature: GYAE6OF02JOGTN.49.20.B09.1.454.CMB.1.raw
tcagagtcgagagacacgaccggtgctcgatttagtgtagtgtgaaggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattcgaccaaaaacatatgtcttactggtaccagcagaggccaggccacggcccctgtcttgggtcgtatttaataaagtactttggaagacggtccctacgacgggtacccctgaacggcgtattccgtcgtcgggaccttccgagtccgtacgaacgggaactaaaccgtagttcccaaccgtttcgaaccctagttaccgaggttacgggtaccgttccgggacccgaagggaacgggaacggacgggacgttacggaaacttacgttaccgttacgttaaccgacggttcccgacgaagacgtaacggacgaagggttacgaccgttaagtttacgttcggttacgttaaggtttaccgggacggtagggtacctacggccttacggaccgttaaccgtacggtccgacggtacccaaggtcccgtaccggtccccgtcggttacccg

SEQ ID NO: 75193 - DNA, 751 bp, Homo sapiens
  misc_feature: GYAE6OF02JYUOV.49.20.B09.1.454.CMB.1.raw
  modified_base (177)..(177): a, c, t, g, unknown or other
  misc_feature (177)..(177): n is a, c, g, or t
tcagagtcgagagacacgaccggtgctcgatttagtgtagtgtgaaggggcgtggtgggtccgaggaggcgagaactctgggtgtctcaccatggcctggatccctctacttctcccctcctcactctctgcacaggctctgaggcctcctatgacgctgacacagtcaccctggtntctgtgtcctcaggacagacggccaggactcgacctgcctctggcgatgcagttcgaccaaaaacataatgcttactggtaccagcagaggccaggccaggcccctgttcgtggtcatttaataaagtacgtttgagtacggccctagaccgggacccctggacgcgtattcctgtcggtctccgagtccgtcgaacggggactaaacgcgttaccaacccgtttcggaaccctagttacgtaacggtacggacggttacccggaccgtacgggtaaacgggaccgggtaacggcgtacggtaaacgttactttaaccgttaggtacgtaaccggtaccgtaccgaaggtaccgaacggtaccggtaaggtcggtaccggtaaggtttaacgttcgggttaccgttaacgggtttccggggtaaccggggtaggggtaacccggttaaccgggtcccgttaaccgggtacccggttacccggttaacgggttaacccggtaacccggtaccccgggtaaaaccggggttacccgttcccgggtacccccccccgggttagggttaaccccccgg

SEQ ID NO: 75194 - DNA, 515 bp, Homo sapiens
  misc_feature: GYAE6OF02GG95O.49.20.B09.1.454.CMB.1.raw
  modified_base (289)..(289): a, c, t, g, unknown or other
  misc_feature (289)..(289): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttanaaagactttgagaggccctcgagggacccctgagcgattctctggctccagctcagggacaacagtcaccttgaccatcagtggagtccggcagaggacgaggctgacttattactgtcacgtccgcagacagcagtggctagttatgtacgtagttcgggcggagggactacggctacggaccgtccgtaggtcgacgcccgaaggccgtccgccccgtcggtcc

SEQ ID NO: 75195 - DNA, 529 bp, Homo sapiens
  misc_feature: GYAE6OF02HMLNE.49.20.B09.1.454.CMB.1.raw
  modified_base (337)..(337): a, c, t, g, unknown or other
  misc_feature (337)..(337): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgattttaataaagtacttttgagaggcccctgacgggacccctgacgcgattcnctggctccagctcgagggaacaacagtcaccttgaccatcagtggacgtccggacgagacgggacgaggctagactattactgtcacgtccgacagacagcagtgcagttatgtcgtagttcggacggtaggactacggctacggaccgtacgtaggtacgacgcccgaggtcctccggccccgtggtaccc

SEQ ID NO: 75196 - DNA, 507 bp, Homo sapiens
  misc_feature: GYAE6OF02F9MVQ.49.20.B09.1.454.CMB.1.raw
  modified_base (401)..(401): a, c, t, g, unknown or other
  misc_feature (401)..(401): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggccccctgtcttggtgatttataaagactttgagaggccctcagggacccctgagcgattctctgctccagctcagggacaacagtcaccttgaccatcagtgagtccggcagaggacgaggctgactattacngtcagtccgcagacagcagtggcagttatgtacgttattcgggcggtagggactacggcgtgacccgtccgtacggtccagcccgaaggcctcgccccgtcggtcc

SEQ ID NO: 75197 - DNA, 527 bp, Homo sapiens
  misc_feature: GYAE6OF02HG778.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaacatatgcttactggtaccagcagaggccaggccaggcccctgtcttggtgatttaataaagactttgagaggccctcagggacccctgagcgattctctggctccagctcaggacaacagtcaccttgaccatcagtggagtccggcagaggacgagctgactattactgtacagtccgcagacagcaggtgcagttatgtcgtagttcgggacggagggtactacggcgtacgacccggttaccgtacggttacgacggacccgaacggtccgtccggccccccgtggtacccg

SEQ ID NO: 75198 - DNA, 605 bp, Homo sapiens
  misc_feature: GYAE6OF02HWWC5.49.20.B09.1.454.CMB.1.raw
  modified_base (235)..(235): a, c, t, g, unknown or other
  misc_feature (235)..(235): n is a, c, g, or t
  modified_base (293)..(293): a, c, t, g, unknown or other
  misc_feature (293)..(293): n is a, c, g, or t
  modified_base (332)..(332): a, c, t, g, unknown or other
  misc_feature (332)..(332): n is a, c, g, or t
  modified_base (343)..(343): a, c, t, g, unknown or other
  misc_feature (343)..(343): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcgatgcattcgaccaaaanatatgcttactggtaccagcagagccaggccaggccctgtcttggtgatttataaaanctttagacgacggtccctgacggaccctgacgcgattcnctcggctcganctacgaggaacatagtacacgttcgacatcagtggacgtccggacagacgacggagctgaaccgtattaccgtgtactacgtccgcgtaagaccgacgacctaggtaggaccgtaagtttaacgttcggtacgttaacggttccgggacgggaacgggtaccgttaaccggccggttacgtaacccggttacccgtaacgggttcccgaacggtaccccgtaaacgggtcccgtacccggtcccccccgtcgggttaacccc

SEQ ID NO: 75199 - DNA, 526 bp, Homo sapiens
  misc_feature: GYAE6OF02FSVMM.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttataaagtactttgagaggccctgacgggacccctgagcgattctctggctccagctcgagggacaacgagtcaccttgaccatcagtggacgtccggcaggaggacgaggctagacttattactgtcagtccgcagacagcagtggctagttagtgtacgtagttcgggcggtaggactcggcgtggacccgtccgtaggtcacggcccgaaggtcctccgtccccgtcggtacccg

SEQ ID NO: 75200 - DNA, 504 bp, Homo sapiens
  misc_feature: GYAE6OF02GBK2J.49.20.B09.1.454.CMB.1.raw
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (353)..(353): a, c, t, g, unknown or other
  misc_feature (353)..(353): n is a, c, g, or t
  modified_base (448)..(448): a, c, t, g, unknown or other
  misc_feature (448)..(448): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggccccctgtcttggtgatttataaagctttgagaggccctnagggacccctgagcgattcnctggctccagctcagggacaacngtcaccttgaccatcagtggagtccggcagaggacgaggctgacttattactgtcagtccgcagacagcagtgctagttatgtcgtagttcgggnggtagggactacggctgaccgtcctaggtcacgcccgaaggctcgcccctggtccc

SEQ ID NO: 75201 - DNA, 575 bp, Homo sapiens
  misc_feature: GYAE6OF02HA5K9.49.20.B09.1.454.CMB.1.raw
  modified_base (419)..(419): a, c, t, g, unknown or other
  misc_feature (419)..(419): n is a, c, g, or t
  modified_base (490)..(490): a, c, t, g, unknown or other
  misc_feature (490)..(490): n is a, c, g, or t
  modified_base (536)..(536): a, c, t, g, unknown or other
  misc_feature (536)..(536): n is a, c, g, or t
tcagagtcgagagacacgaccggtgctcgatttagtgtagtgtgaagggggtcgttggtgggtccagggaggcagaactctgggttgttctcaccgtatggcctggataccctcgtacttctcccccctcctcactctctgcacgaggctctgaggccttcctatggaggcctgacacgtagtcacccgtcggtgtctgtgtcctgaggacagaccggccaggactccacctgctctggccatgcattgaccaaaactatatgtcttactggtaccagcagtagccacggccacggccccttgtctgggtcagtttagaaagtacttagagtacggcctgacgggacccctgacgtcgtattcctcgtggtccttccacgtcttacgacgggaacaactacgtcctaccgttcgaaccngttacgagggtcggacggtccgggaccaggacggacgaggctaggtacttattacgtcgtcgtagtcccgnacgacagcaggtgctagttatgtacgtagtcgggcggaggctacgntcgacgtcgtagcacgaccgaggcctccgcccgtcgtcg

SEQ ID NO: 75202 - DNA, 510 bp, Homo sapiens
  misc_feature: GYAE6OF02HGR3K.49.20.B09.1.454.CMB.1.raw
  modified_base (436)..(436): a, c, t, g, unknown or other
  misc_feature (436)..(436): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttataaagactttgagaggccctcgacgggacccctgagcgattctctggctcagctcagggacaacagtcaccttgaccatcagtggagtccggcagaggacgaggctagactattactgtcacgtcgacagacagacagtgcagttntgtcgtagttcggcggaggacgtacggctcgaccgtcgtacggtcacgtccgaaggcctcgccccgtcggtacc

SEQ ID NO: 75203 - DNA, 519 bp, Homo sapiens
  misc_feature: GYAE6OF02F83OS.49.20.B09.1.454.CMB.1.raw
  modified_base (415)..(415): a, c, t, g, unknown or other
  misc_feature (415)..(415): n is a, c, g, or t
tcagagtcgagagacacgaccggtgctcgatttagtgtagtgtgaagggggctgtgggtccaggaggcagaactctgggtgtctcaccatggcctggatccctctacttctcccccctcctcactctcttcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcagggacccctgagcgattctctggctccagctcagggacaacagtcaccttgaccatcagtggagtcggccagaggacgaggctgactattactgtcagtccgnagacagcagtgcagttatgtcgtattcgggacggagggactacgcgtcggaccgttcgtacggtacaggaccctaaggccgtcggccccccgtcggtctacccg

SEQ ID NO: 75204 - DNA, 712 bp, Homo sapiens
  misc_feature: GYAE6OF02ITD05.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtccccaggacagacggccaggatcacctgctctggagatgcattgaccaaaccgatatgcttattggtaccagcagaagccggcaggccctgtgtggtgatgtataaagacactgagacggccctgagggactcccgtagacgcgtattctcgtggcctccgaggtcgaggacaacggtcactagtcggactatcgaggtggacgtccgagggactaggacggaacggacggtcgtacggaactttaagtttagtttacggtaacctaaacgttacgaaaccgtaggtaaacccgtaaccgttaaggttttaaccggttaacttttaacgttacggttttaacccgtttaaccgggttaaaaccgttacgggtaaccccggtaaacccggttaaacgggttaccccggtaaaccccgggtttcccggttacggggggtttaacccaaccgggtaacccccgtaaaacccgggtacccccctaaaacccccgtacccgttaccggttaccccgtaacccttttaacccccgg

SEQ ID NO: 75205 - DNA, 517 bp, Homo sapiens
  misc_feature: GYAE6OF02HBS6Y.49.20.B09.1.454.CMB.1.raw
  modified_base (291)..(291): a, c, t, g, unknown or other
  misc_feature (291)..(291): n is a, c, g, or t
  modified_base (425)..(425): a, c, t, g, unknown or other
  misc_feature (425)..(425): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttanaaagactttgagacggccctgacgggacccctgacgcgattctctggctccagctcgaggacaacagtcaccttgaccatcgagtggacgtccggaccaggaggacgaggctgacttattactgtacagtccgnagacagcagtgactagttatgtcgtagttcgggacggagggactacggctgaccgtcgtaggtcacgccgaaggccgtcgtcccctcggtcc

SEQ ID NO: 75206 - DNA, 517 bp, Homo sapiens
  misc_feature: GYAE6OF02HREXZ.49.20.B09.1.454.CMB.1.raw
  modified_base (289)..(289): a, c, t, g, unknown or other
  misc_feature (289)..(289): n is a, c, g, or t
  modified_base (454)..(454): a, c, t, g, unknown or other
  misc_feature (454)..(454): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttanaaagtactttgagacggccctcacggggacccctgagcgattctctggctccagctcgagggacaacagtcaccttgaccatcagtggacgtccggcagaggacgaggctagactattactgtcagtccgcagacagcagtgctagttagtgtcgtaagttcggngggtaggactacggctcggaccgtccgtacgtcacgcccaaggtcctccgccccgtcggtacc

SEQ ID NO: 75207 - DNA, 628 bp, Homo sapiens
  misc_feature: GYAE6OF02ISB61.49.20.B09.1.454.CMB.1.raw
  modified_base (237)..(237): a, c, t, g, unknown or other
  misc_feature (237)..(237): n is a, c, g, or t
  modified_base (282)..(282): a, c, t, g, unknown or other
  misc_feature (282)..(282): n is a, c, g, or t
  modified_base (335)..(335): a, c, t, g, unknown or other
  misc_feature (335)..(335): n is a, c, g, or t
tcagagtcgagagacacgaccggtgctcgatttagtgtagtgtgaaggggcgtgtgggtccaggaggcagaactctgggtgtctcaccatggcctggatccctctacttctcccctcctcactctctgcacaggctctgaggcctcctatgagctgacacagtccaccctcggtgtctgtcgtcctcaggacagacggccaggactcacctgctctggcgatgcattgaccaaaaanatatgcttatgtaccagcagaagccggcacggccctgtgttaggnatgtaataaagcactgagacggccctgagggactccgtagagccgtatttccncgtcggcttccgaggtcgaacggggaacctaacgggtcaacgtagttcgggccatcgaggtggacgtccgaggcgaaggacggacggagacgtaggaacttagttacgttcgtacaaataccgaacgaacgtaaccaacctagtttacggttaacttaacgttcgttaccgttacggaacgttcgaccggtaaccgtaaacggttcccgtaaacccggtccgttaacgggtaccgtaaccggtaccccgaaaccgggaccccctaaaccccggcgttaccggtaccctaaccg

SEQ ID NO: 75208 - DNA, 506 bp, Homo sapiens
  misc_feature: GYAE6OF02GYJ7S.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgcttactggtaccagcagaggccaggccaggcccctgtcttggtgatttataaagactttgagaggccctcagggacccctgagcgattctctggctccagctcagggacaacgagtcaccttgaccatcagtggagtccggcagaggacgaggctgactattactgtcagtccgcagacagcaggtgctagttatgtcgtagttcggcggagggactacggctaggaccgtccgtaggtcacgcccgaggcctcgccccgtcggtccg

SEQ ID NO: 75209 - DNA, 506 bp, Homo sapiens
  misc_feature: GYAE6OF02G09Q5.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgccaaaaacatatgcttactggtaccagcagaggccaggccaggcccctgtcttggtgatttataaagactttgagagggcctcgacgggacccctggagcgattctctggctccagctcagcgacaacagtcacgttcgaccatcagtggagtccgggcgagaggacgaggctagacttattactgtcagtcatcagacagtagtggctacttgtgtcgtagttcggcggaggaccgaagctcgaccgtccgtaggtcacgccaacggcctcgcccctcgg

SEQ ID NO: 75210 - DNA, 1023 bp, Homo sapiens
  misc_feature: GYAE6OF02FNXRT.49.20.B09.1.454.CMB.1.raw
tcagagtcgagagacacgaccggtgctcgatttagtgtagtgtgaaggggacgtagtgggtccaggaggcagtaacgtcctgggtggtacctcaccgaactggcctggatccctctacttcctccccctctcactctcgtgccacaggcctccgtgaacggtcctccgtatgagctgaccacgagtcccacccgttcggttgtccttgtggtacctcgacggacccagaccggtccaggactccacctgactctggcgatgaccagttcgacccaaaaactagtactgccttaacgtacggtaccacgacgacgacggaccgaacggcccaacggccccccttggttaccgttttgggtacgtaacttttaagttaaaacggtaccgtttttaggaacggtaacgggtcccccttaccgtaacgggggtaccccccttaggaaccggtaccggtaacgttttccgttccgttacggggtcccgttacccgaacgggtcccgtttacccggaaacggggggtaaacccaaaaccggtaacggtttccccgaaacccgttttccggaaacccctaacgttaccgtaacgggttacgggtaacccggtttaccccggggaaccccggtaacggggtaacggggtaaacccgggtaacggggttacccgtttaacgggttaaacccgtttaacgttttaacccgttagggtttaacccgttaaacgggtttcccggaacccgtaaacggtacccgttaacgggtaccgggttaacggggtttaccgggtaccggtaacgggttttttaacggttacgggttttacccggttttaaggtttttacccggggggaaccggggttaaccggggggtaaacccgtttaaccggggtacccgtttaaccggggtaacccccggtttaacccggttaaccgggttaaaccccgtacggggttaacccccggtaaaccggggttaccccggttccccgggttaccccccccggtttaccggggtttaacccccg

SEQ ID NO: 75211 - DNA, 632 bp, Homo sapiens
  misc_feature: GYAE6OF02IBIBV.49.20.B09.1.454.CMB.1.raw
  modified_base (235)..(235): a, c, t, g, unknown or other
  misc_feature (235)..(235): n is a, c, g, or t
  modified_base (293)..(293): a, c, t, g, unknown or other
  misc_feature (293)..(293): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggatcacctgctctggcgatgcattgaccaaaanatatgcttactggtaccagcagagccaggccaggcccctgtcttggtagtattttaanaaagtctttaggacgacggcccttacgacgggacccctggacgcgtattctacgtcggctccagtctacgaagggaacacacgtcctaccgttcgaacctagtaccgaggtcggtacggtcccgggacaagggacggacgacggtctaggtaacttacgttacgtgtacacgttccgactaacgacgtagacgagtcggtacgtaagtttagtcggttacggtacgttccggggacgggtacgggtaaccgtaccggtcgtacggtacccggtccggttaacggtaccgaccggacccgtaaccgggtcccgtcccggtaccccccggtggttaccccg

SEQ ID NO: 75212 - DNA, 582 bp, Homo sapiens
  misc_feature: GYAE6OF02G1E79.49.20.B09.1.454.CMB.1.raw
  modified_base (301)..(301): a, c, t, g, unknown or other
  misc_feature (301)..(301): n is a, c, g, or t
tcagagtcgagagacacgaccggtgctcgatttagtgtagtgtgaaggggggcgtgtgggtccaggaggcagaactctgggtgtctcaccattggcctggatccctctacttctcccctcctcactctctgcacaggcttcgtgaggcctcctatgtagctgacactagtcaccctcggtgtctgtgtcctcaggacaggacggccagggatcactgctcgtggcgatgcattgaccaaaaacatatgacttactggtaaccagcagaggccaggccacggccctgtcgtggtgtatttanaacgtcgttggagcggccctgacgggccctggacgcgtattcgtcgtggcctcgagtcctacgacgggaaccaacgtcgtacctacgttcgacctatcgaggtcggacgtccggacgaggacggacgacggctacgtacttattactgtacacgtccgacacgacagacgagtcggactagttagtgttacgtagttcgggacggacggtactacggtctacggtacccgtcgtacggtcgtacggaccggtacggtccgtccggtccccgttggtacccg

SEQ ID NO: 75213 - DNA, 512 bp, Homo sapiens
  misc_feature: GYAE6OF02GC7SX.49.20.B09.1.454.CMB.1.raw
  modified_base (413)..(413): a, c, t, g, unknown or other
  misc_feature (413)..(413): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagctttgagtaggccctcagggacccctgagcgattctctggctccagctcagggacaacagtcaccttgaccatcagtggagtcggccagaggacgaggctgactattactgtcagtccgnagacagcagtgcagttatgtcgttattcgggcggagggtactacggcgtacgaccgtccgtaggtcgacgcccaagggcctcggcccccgtggtacccg

SEQ ID NO: 75214 - DNA, 558 bp, Homo sapiens
  misc_feature: GYAE6OF02IXA9I.49.20.B09.1.454.CMB.1.raw
  modified_base (375)..(375): a, c, t, g, unknown or other
  misc_feature (375)..(375): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (490)..(490): a, c, t, g, unknown or other
  misc_feature (490)..(490): n is a, c, g, or t
  modified_base (500)..(500): a, c, t, g, unknown or other
  misc_feature (500)..(500): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattcgaccaaaaacaatatgcttactggtaccagaccagaggccaggccacggcccctgttcgttggtgtatttaagtaaagtactttggagacggccctacgaccgggacccctgagtccgtattcctcgtggcctccagctcgaggacaacngtccaccgttcgaccatcagtcggacgtccggacgaggaggacgtaggctgacttattacngtacncgtccgcaacgcacgacagtggactagttatggtcgttagtcggacggnggtactcggngtacggtaccgtcgtacggtcgaacggtcccgaagggcctccggtcccctcggtaccc

SEQ ID NO: 75215 - DNA, 514 bp, Homo sapiens
  misc_feature: GYAE6OF02F1CHN.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcgagggacccctgagcgattctctggctccagctcgagggacaacagtcaccttgaccatcagtggagtccggccagaggacgaggctgactattactgtcagtccgcagacagcagtggcagttatgtcgttagttcgggcggagggactacggcgtgacccgtcgtaggtccacggcccgaaggcctcgtcccccgtcgtccc

SEQ ID NO: 75216 - DNA, 544 bp, Homo sapiens
  misc_feature: GYAE6OF02IWB09.49.20.B09.1.454.CMB.1.raw
  modified_base (290)..(290): a, c, t, g, unknown or other
  misc_feature (290)..(290): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgcttactggtaccagcagaggccaggccaggcccctgtcttggtgtatttanaaagactttgagacggcctcgacgggacccctgagcgattctctggctccagctcgagggacaacgagtaccaccttagaccatcagtggacgtccggccaggacggacgacggctagactattactgtcagtccgcagacagacagtggactagttattggtacgttagttcgggacgggacgggactacggctaccggaccgtccgtaggtccgacgtccccgaagggcctaccggtcccccgtggtacccg

SEQ ID NO: 75217 - DNA, 542 bp, Homo sapiens
  misc_feature: GYAE6OF02IF53G.49.20.B09.1.454.CMB.1.raw
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaaacaatatgcttactggtaccagccagaggccaggccaggcccctgtcttggtgatttataaagactttgagaggccctcagggacccctgancgattcnctggctccagctcaggacaanagtcacttgaccatcagtggacgtccggcaaggaggacgaggctagactaattactgtacgacgtccgacagactacggcagtggactaaggtttactggtacgttacgttcgggacggagggtacgtacggctacggaccgtccgtacggtcgacgccgaaacggtccgtaccggcccccgtggtaccc

SEQ ID NO: 75218 - DNA, 606 bp, Homo sapiens
  misc_feature: GYAE6OF02ILE4G.49.20.B09.1.454.CMB.1.raw
  modified_base (235)..(235): a, c, t, g, unknown or other
  misc_feature (235)..(235): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaanatatgacttactggtaccagcagacggccaggccacggcccctgtcgttggtatattttaataaagtactttgacgtacggtccctcgacgggacccctggacgcgtattctcgtcggctccgagctacgacgggaacaacgacgtccaaccttgaaccagttaccgtaggtacggacggtcccggacgacggacggacgagggctgacttaattacgtgtacgacgtcgacaagacagacgaggtcgctaagttagtcgttacgtacgttcgggacggtagggtaccgtacggtcgtaccggtaccgttaccgttacggtcaccggaccccgtaacgggtccttacccggtccccccgttacggtacccg

SEQ ID NO: 75219 - DNA, 529 bp, Homo sapiens
  misc_feature: GYAE6OF02IL1T1.49.20.B09.1.454.CMB.1.raw
  modified_base (283)..(283): a, c, t, g, unknown or other
  misc_feature (283)..(283): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagagccagccaggcccctgtcttggtntatttaataagtactttgagacggccctcgacgggacccctgagcgtattctcgtgctcagctcgagggacaacagtccaccttgaccatcagtggacgtccggcagaggacgaggctgacttattactgtcagtccgcagacagcagtggactagttatgtcgttagttcgggacggaggacctcggctcggaccggttcctacggtccacggacccgaacggtccgtccgcccccgttcggtcc

SEQ ID NO: 75220 - DNA, 694 bp, Homo sapiens
  misc_feature: GYAE6OF02G31UE.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagacaggacgacgacgcgaccgtcctgttcgtggtattattaaagtaacgttgttagaggaccgtcctacggacccggtaccgtaggacgacgtacttcgtacgtcgtcctacgcgtcctacggaacggaaccaacgtaccgtaccgttaaccgttaccgaacctacgtacggtaacgggtacgggtacccgggtcccccgggaacgaaacggggaaccgggaacgggacgggtaccgttaacggtaaaccgtttaacgtttaccggttcgtaaccggtaccggtacccgaacggaacgtacgaacgacgtaggtacgggtacgttaagtttcgtacgttacggttacgggtacgggacgggtacggtacctacggtcggtaccggtaccgtacgtacggtcgaaccgtaccggacgtcccgtcccggtccccgtcgtacccg

SEQ ID NO: 75221 - DNA, 506 bp, Homo sapiens
  misc_feature: GYAE6OF02FVS7M.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagctttgagaggccctgagggacccctgagcgattctctggctcaggtcagggacaacggtcacattggccatcagtggagtccaggcagaggacgaggctgactattatgtcaatcaacagacaccattcgtacttatgttcttcggaactgacgacaggtccaccgtcgtcggtcacgacccgaaggcccaacccactcgccacgtctaccg

SEQ ID NO: 75222 - DNA, 555 bp, Homo sapiens
  misc_feature: GYAE6OF02FUWY6.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgtatttataaagtactttgagaggccctcacgggacccctgagcgattctctggctccagcctcgagggacaacagtcaccttgaccatcagtggacgtccggcaggaggacgaggctagacttattacgtggttcggtccgcgagacagcaggtggctagttgtgttcgtagttcgggacgggagggtacgtacggcgtacggacccgttccgtaggtaccgacggacccgtaacgggtccgtccggtccccccgttacgggtccctacccg

SEQ ID NO: 75223 - DNA, 632 bp, Homo sapiens
  misc_feature: GYAE6OF02JT5BQ.49.20.B09.1.454.CMB.1.raw
  modified_base (263)..(263): a, c, t, g, unknown or other
  misc_feature (263)..(263): n is a, c, g, or t
tcagagtcgagagacacgaccggtgctcgatttagtgtagtgtgaagggggcgtggtgggtccgaggaggcagaactctgggtgtctcaccatggcctggatcctctacttctcccctcctcactctctgcacagctctgaggcctcctatgagctgacacagtcaccctcggtgtctgtcgtcctcaggaccagacggccaggatcacctgctctaggcgatgcattcgaccaaaaacatatgcttaactggtaccagcagngccaggccaggcccctgttcgtcggtgatttagtaaagtactttgagacggtcctcgacggtacccctgacgcggtattcgtactggtcctcagtcgtaccgacgggtacaacgacgtccgtactttaccgaactacttcgacggtcggtaccggtacccgggcaacgggcggaacgggacggacgtgtaaccgtaacttaccgtagtactacggtacccgtagacgaacgcgacgtacggtcgacggttaagttacgtggtacgttacggttacgggcgggtacgggacgttaccggacgtcgtaacccggtcgttaccgggtcaggtaccccgaaggtcccgttcccggaccccgttcggtaccccg

SEQ ID NO: 75224 - DNA, 591 bp, Homo sapiens
  misc_feature: GYAE6OF02HNXON.49.20.B09.1.454.CMB.1.raw
  modified_base (490)..(490): a, c, t, g, unknown or other
  misc_feature (490)..(490): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacaggacggccaggactcacctgctcgtggcgatgcattgaccaaaaacatatgcttactggtaccagcagacggccaggccacggcccctgtcgttggtagtattttaagaaaagtacttttgaggacggtccctacgaacggggtacccctggacgcgtacttctcgtcggctccgagcctcgaacgggacaaactagtccaccgttgaacctagtacgagtacggacgtcccgggacgaacggacggacgaggctaggacttaacgttacgtgcgtacgtccgacagacagcgtaggngcgtagttatggtacgtagttcgggcggaggaccgtacggtcgtacgtaccggtcgttacggtccacggtacccgaggtccgtccgtcccccgtgtacccg

SEQ ID NO: 75225 - DNA, 534 bp, Homo sapiens
  misc_feature: GYAE6OF02F4ZWZ.49.20.B09.1.454.CMB.1.raw
  modified_base (360)..(360): a, c, t, g, unknown or other
  misc_feature (360)..(360): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcatgcattgaccaaaaacaatatgcttactggtaccagcagaggccaggccaggcccctgtcttggtgatttataaagtctttgagtacggccctcgacgggacccctgacgcgtattctctggctccagctcgagggacaacgngtcaccttgaccatcagtgacgtccggcaggagacgaggctgactattacgtgtactagtccgctagacgagcagtgcgtagttagtgtacgtagttccggaggtaggacgtacgtcgtacggtaccgtccgtaggtacgacgcccgaaggtcctccggtccccgtacggtccc

SEQ ID NO: 75226 - DNA, 505 bp, Homo sapiens
  misc_feature: GYAE6OF02GX4JD.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggccccctgtcttggtgatttataaagactttgagaggccctcagggacccctgagcgattctctggctccagctcagggacaacagtcaccttgaccatcagtgagtccggccaggaggcgaggctgactattactgtcagtccgcagacagcagtgcagttatgtcgtattcgggcggagggctacggctcgaccgtccgtaggtcacgcccgaaggcctcggcccccgtggtccc

SEQ ID NO: 75227 - DNA, 516 bp, Homo sapiens
  misc_feature: GYAE6OF02IDZCM.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgattttataaagacttttgagaggccctcgacgggacccctgagcgattctctggctcagctcgaggacaacagtcaccttgaccatcagtggacgtccggcagaggacgaggctgactattactgtcacgtccgcacgacagacgagtggctagttatgtacgtagttcgggcggagggactacggctacgaccgtccgtaggtccagccaaggcctgacccccgtggtacc

SEQ ID NO: 75228 - DNA, 600 bp, Homo sapiens
  misc_feature: GYAE6OF02JGXBU.49.20.B09.1.454.CMB.1.raw
  modified_base (280)..(280): a, c, t, g, unknown or other
  misc_feature (280)..(280): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagagccaggccacggccctgtcttggngtatttaataaagtctttgaggacgccctcgacggggacccctggacgcgtacttcgtcgtcggcctcagctacgaacggtacaaacgcgtacctaccgtcgaaccagtacgtacggtcggtacggtccggaccgaaggtacgggacggtacggtcgtacgtaacttacgttaacgtcgtacacggtccgtacagaacacggacaggtcggctaacgttataggttacgtacgttcgggacgggaggtaaccgtacggtccggtacgaccgtacgtacggtcgaaccggccgtaaggccgtaccgtccccggtgtacccg

SEQ ID NO: 75229 - DNA, 563 bp, Homo sapiens
  misc_feature: GYAE6OF02GN40L.49.20.B09.1.454.CMB.1.raw
  modified_base (293)..(293): a, c, t, g, unknown or other
  misc_feature (293)..(293): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaaccagcagagccaggccaggcccctgtcttggtgtatttaanaaagtctttgagacggccctcacgggacccctgagcgattctctggcctcagctcgaaggacaacgagtccaccttgacctatcagtggtacgtccggccaggacggacgacggctagactattacgtgtacacgtccgacgtagactagcgaggtcgacgtaagttagttcgtcgttacgttcggcgggtacgggactaccggtcgtacgtacccggttccgtaacggtccacggcccgtaacggtcctccggtcccccgtcggtaccc

SEQ ID NO: 75230 - DNA, 538 bp, Homo sapiens
  misc_feature: GYAE6OF02GIHAC.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttataaagtactttgagaggccctcgacgggacccctgagcgattctctggctccagctcgagggacaacagtcaccttgaccatcagtggacgtccggcaggaggacgaggctgacttattacgtgtcacgtccgcagacagcagtgactagttatgtacgtagttcgggacgggtacgggaccgaaggtcgtacggtacccggtccgtacggtcacggcccgaagggcctccggtcccccgtggtaccc

SEQ ID NO: 75231 - DNA, 603 bp, Homo sapiens
  misc_feature: GYAE6OF02JOH4A.49.20.B09.1.454.CMB.1.raw
  modified_base (131)..(131): a, c, t, g, unknown or other
  misc_feature (131)..(131): n is a, c, g, or t
  modified_base (187)..(187): a, c, t, g, unknown or other
  misc_feature (187)..(187): n is a, c, g, or t
  modified_base (294)..(294): a, c, t, g, unknown or other
  misc_feature (294)..(294): n is a, c, g, or t
  modified_base (461)..(461): a, c, t, g, unknown or other
  misc_feature (461)..(461): n is a, c, g, or t
tcagagtcgagagacacgaccggtgctcgatttagtgtagtgtgaaggggcgtgtgggtccaggaggcgagaactctgggtgtctcaccatggcctggatccctctacttcctcccctcctccactctctncacaggctctgagcctcctatgagctgacacagtcaccctcggtgtctgtgtcctnaggacagacggccaggactccacctgctctgggcatgctattcgacccaaaaacatatgacttactcggtaccagcaggacgccaggccacggcccctgtcgttggngaatttaagaaagtctttgaggacggtccctcgaacgggtcccctaggacggaccgtattcctccgtaggccctcgagccgttagaacgggtacaacgtgtccctaacttcgaacctagtcgagtacggacgtccgacgacgaggacgagctgactagtactgacgngtccgcacgacagcagtcgactagttacgtgtacgtaagttcgggacggtaggtaccgtaccggtacgtacgtacccggtacgttacgggacctaaccgggcccggtaaacggtcccggttccgacccccggttagtacccg

SEQ ID NO: 75232 - DNA, 569 bp, Homo sapiens
  misc_feature: GYAE6OF02ILZXX.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacaatatgcttactggtaccagcagaggccaggccaggcccctgtcttggtgatttagtaaagactttgaggtacggccctcgacgggacccctgacgcgtattctctggctccagctcgacgggacaacgagtcctaccttcgaccatcgaggtacggacgtccggccgaggaggacgaggctacgactattacgtcgtacgacgtccgcacgacagctaggtgacgtagttagtcgtcggttagttcgggacggagggtaccgtaacggcgtacgtacccggttaccgtacggtcacggcccgaacggtccgtccgtacccccgtcggtaccc

SEQ ID NO: 75233 - DNA, 564 bp, Homo sapiens
  misc_feature: GYAE6OF02GT8RP.49.20.B09.1.454.CMB.1.raw
  modified_base (186)..(186): a, c, t, g, unknown or other
  misc_feature (186)..(186): n is a, c, g, or t
  modified_base (294)..(294): a, c, t, g, unknown or other
  misc_feature (294)..(294): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggatcacctgctcgtggcgatgcattgaccaaaaacatatgcttactggtaccagcagaggccaggccacggcccctgtcttggtgtatttaanaaagtactttgagacggccctcgacgggacccctgacgcgtattctcgtggcctccagcctcgaagggacaaacacgtaccaccttgaaccatcgagtcggacgtcccggaccgaggaggacgaggctgaacttagttacctgtcgacgttccgcgacgacacgcagtggctagtttatgtacgttagttcgggacggtaggacgtacggcgtacggtacccggtccgtacggtccgacggcccgaaggtccgtcgtcccccgtgtaccc

SEQ ID NO: 75234 - DNA, 527 bp, Homo sapiens
  misc_feature: GYAE6OF02GV8SD.49.20.B09.1.454.CMB.1.raw
  modified_base (234)..(234): a, c, t, g, unknown or other
  misc_feature (234)..(234): n is a, c, g, or t
  modified_base (430)..(430): a, c, t, g, unknown or other
  misc_feature (430)..(430): n is a, c, g, or t
tcagagtcgagagacacgaccggtgctcgatttagtgtagtgtgaagggggcgtgtgggtccaggaggcagaactctgggtgtctcaccatggcctggatccctctacttctccccctcctcactctctgcacaggctctgaggcctctatgagctgacacagtccaccctggtgtctgtgtcctcaggacagacggccaggatcacctgctctggcatgcattgaccaaaaanatatgcttactggtaccagcagaggccaggccaggcccctgtcttggtgatttagtaaagactttgagacggccctcgacgggacccctgacgcgtattctctggctccagcctcgagggacaacacgtcaccttcgaccagtcaggtcggacgtccggacagacggacgaggctgactattactcgtcagtccgnagacagcagtgctagttatgtcgtagttcgggacggaggacctacggctcggtaccgtcgtacggtcacgcccgaaggctccggccccgtggtaccc

SEQ ID NO: 75235 - DNA, 603 bp, Homo sapiens
  misc_feature: GYAE6OF02I1P9C.49.20.B09.1.454.CMB.1.raw
  modified_base (237)..(237): a, c, t, g, unknown or other
  misc_feature (237)..(237): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtgtctgtgtcctcaggacagacggccaggatcacctgctctggacatgcattcgacccaaaaanatatgacttactggtaccagcagagccaggccaggcccctgtcttggtgtactttataaagtactttgagacggccctcgaacggggaccccttgacggcgtaattctcgtggccttacgagcctcgaagggaacaaactacgtaccaccttcgaaccatcgaagtcggacgtccggaccgtagacgggacgacggcgtagaaccttattacttagtacgtaggtacccgacgaggtaaccaggacgtacggtggactagtttagtcgtacgttagtcgggtaccggagggtaccttacggcgtacggaccgttccgtaggtccgaacgcccgtaaaggcccgtaccgtcccccgtaggttacccg

SEQ ID NO: 75236 - DNA, 517 bp, Homo sapiens
  misc_feature: GYAE6OF02HCIXE.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagactttgagacggccctcgacgggcccctgacgcgtattctcgtggctccagctcgagggacaacagtcaccttgaccatcagtggacgtccggccaggaggacgaggctgactattactgtcagtccgcagacagcgagtgctagttatgttcgtagttcgggcggagggactacggctcggaccgtcgtaggtcacgacccgagccgtcgcccccgtgtccc

SEQ ID NO: 75237 - DNA, 745 bp, Homo sapiens
  misc_feature: GYAE6OF02JVJUY.49.20.B09.1.454.CMB.1.raw
  modified_base (183)..(183): a, c, t, g, unknown or other
  misc_feature (183)..(183): n is a, c, g, or t
  modified_base (238)..(238): a, c, t, g, unknown or other
  misc_feature (238)..(238): n is a, c, g, or t
tcagagtcgagagacacgaccggtgctcgatttagtgtagtgtgaagggggctgtgggtcaggaggcagaactctgggtgtctcaccatggcctggatccctctacttctcccctcctcactctctgcacaggctctgaggcctcctatgagctgacacagtcaccctggtgtctgtgtcctnaggacagacggccaggatcacctgctctggcatcgctattgaccaaaaacatatntacttacgtggtacagcaggacggaccgaggccacggcccgtcgtccgttaggtacgtatttaacgtaaaagttaccgtttagacggtacggaccccgttacgaaccggggtacccctggtaacggcgtacgtttccgtcgtcggtaccttaccgacgtccgtacgtaacggggaacctaaaccgacgttacctaccttaccggtaaccaatccgtaggttacggaccgggtaccggaccgtaagggaccggaacggtacgggaactaggtaaccgttaagtttacgtacgttaccggtacgttacccggacgtacgaacgtacgaaccggtacggttacgggacgttaacgtttacgttgggtaccgtttaacggttaccgggtacgggtacggggttacgtaccggtaacggttacggtaacccggttaccggttaacggggtcctaaacccgggtccggtaaaccgggtcccggtacccggttcccccggttaaccggttcccg

SEQ ID NO: 75238 - DNA, 550 bp, Homo sapiens
  misc_feature: GYAE6OF02F4EFI.49.20.B09.1.454.CMB.1.raw
  modified_base (282)..(282): a, c, t, g, unknown or other
  misc_feature (282)..(282): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacgccaggatcactgctctggcatgcattcgaccaaaaacatatgcttactggtaccagcagaggccaggccaggcccctgtcttggtntatttataaagtctttgagacggccctacgacgggacccctgacgcgtattctctggcctcgagctacgaggacaacgagtaccaccttgaccctatcgaaggtggacgtccggacaggacggacgacggctgaacttattacgtgtacgcgttaccgcacgacagcgagtcggactaggtttatggtcgttagttcgggacggtaggactacgcgtacgaccgtcgtacggtcacggcccgaacggtcctccgtccccgtgtacccg

SEQ ID NO: 75239 - DNA, 534 bp, Homo sapiens
  misc_feature: GYAE6OF02JOZLB.49.20.B09.1.454.CMB.1.raw
  modified_base (285)..(285): a, c, t, g, unknown or other
  misc_feature (285)..(285): n is a, c, g, or t
  modified_base (328)..(328): a, c, t, g, unknown or other
  misc_feature (328)..(328): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagcggccaggatcacctgctctggcatgcattgaccaaaacatatgcttactggtaccagcagagccaggccaggcccctgtctggtgatttanaaagtctttgagaggccctagacggacccctgacgcgtattcncgtggctccagctcgagggacaacgtgtccactgaccatcagtggacgtccggacagaggacgaggctacgtactagttaccgtgtacgacgtccgagacgacaggcagtgcgtaagttgcgttcgtagttcggacgggacggacgtacggtcgtacgtaccgtcgtagtccacggccaacggtcctaccggtccccgtcgtaccc

SEQ ID NO: 75240 - DNA, 536 bp, Homo sapiens
  misc_feature: GYAE6OF02FGB6A.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtaccagcagaggccaggccaggcccctgtcttggtgatttataaagactttgagaggccctcgagggacccctgagcgattctctggctccagctcgagggacaacagtcacttgaccatcagtggagtccggcagaggacgaggctgacttattactgtcagtccgcagacagcagtcggcagtttatgtcggttagttcgggacggtacgggacgtacggctacggtacccggtccgttacggtacacggacccgaaggtcccgtccgcccccggttcggttaccc

SEQ ID NO: 75241 - DNA, 531 bp, Homo sapiens
  misc_feature: GYAE6OF02FODJR.49.20.B09.1.454.CMB.1.raw
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
  modified_base (445)..(445): a, c, t, g, unknown or other
  misc_feature (445)..(445): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgccaaaaacatatgcttactggtaccagcagaggccaggccaggcccctgtcttggtgtatttaataaagactttagagacggccctcgacgggacccctgagcgattctcgtgctacagtctacgaggacaacagtctaccgttgacccatcagtggacgtccgccagaggacgaggctgactattacngtcagtccgnacgacagcagtggcagtttangttacgtagttcgggacggagggacctacggcgtacgacccgtacgtaggtcacggtcccgaaggcctccggccccgtcggtaccc

SEQ ID NO: 75242 - DNA, 657 bp, Homo sapiens
  misc_feature: GYAE6OF02IM2GV.49.20.B09.1.454.CMB.1.raw
  modified_base (159)..(159): a, c, t, g, unknown or other
  misc_feature (159)..(159): n is a, c, g, or t
  modified_base (269)..(269): a, c, t, g, unknown or other
  misc_feature (269)..(269): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggccctcctatgagccanacagtcaccctcggtgtctgtcgtcctcaggacgacgacggccgaggtagtcaccctgctcgtaggcggatgctatacgaccaaaacaatatcgcttacctaggaccacngacgaggccgaccggtcaccggtccccgtcgtgtttggtagtaattttaattaaaagacgttttacagggaaccgcccgtaccgtaaccggggaacccttcgaggaccgtatttctttccgcggtcctaaccacgactcgaagggaacccaaacgtaacgtcctaacccttcggtacaacttgtaaacgcgggacggtacccggaccgacggaagggacgacgggtacttcgaacgtaactttacgcgttacgcgttaccgacgacgaagcgagacgtaggccttaagttagttcgacggttgaccgggtcgggtaacgacgttacgtccgacggtaccgtaccgtagtacgcgtaacccggatcggccctccccgtacggtctaccg

SEQ ID NO: 75243 - DNA, 593 bp, Homo sapiens
  misc_feature: GYAE6OF02G62LU.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcacccgtcggtgtctgtcgtcctcgaggacagacggccaggatccacctgctcgtggcgatgctattcgaccaaaaacatatgcttactggtaccagcaggacggccaggccacggcccctgtcgttggtgtattttaagtaaagtctttggaacgacggcccctacgacggggacccctggacgcgtattcctcgtcggcctccagctcgacgggacaacgacgtccaccttcgacctatcgagtggacgtccggcaggacggacgaggctagactattacgtgtacacgtccgcgagacagctaggtgacgtagtttagtggttcgtacgttcgggacggagggtacctacggtcttaccggacccgttacgtacggttaccgacggtaccccgacggtccgtaccggtcccccgttacggtacccg

SEQ ID NO: 75244 - DNA, 672 bp, Homo sapiens
  misc_feature: GYAE6OF02IQUGA.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacaatatgtcttactggtaccagcagagccgagccacggccctgtcttggtgtatttataaagtactttgagtacgccctcgacggacccctgagcgtattctcgtcggtcctccgagctcgaacgggacaaacgtagtacctaccgttacggaacctacgtacgaaggtacgggtacggtacccgggaccgaacgggaacgggaaccggacggtccgtaacgtaacgttacgttaacgttacggtaccgtacggttacccgccgaacgtaaccgagaccgtaggtcgggtacgtagttaacgtacggttcggttaacgttacggggaccgggtacgggttaaccgtacggtccgttaccggtacccgggttaccgttacggttaccgaccggtacccggaaacggtcccgtaccggtcccccggttcggtaccccgg

SEQ ID NO: 75245 - DNA, 531 bp, Homo sapiens
  misc_feature: GYAE6OF02JCDGB.49.20.B09.1.454.CMB.1.raw
  modified_base (335)..(335): a, c, t, g, unknown or other
  misc_feature (335)..(335): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtagtatttataaagtactttgagacggccctgacgggaccctgacgcgattcnctgctccagctcgagggacaacgagtcaccttgacctatcagtggacgtccggacaggacggacgaggctgactagttactgtcacgtccgcagacgagcgagtcgactagttatgtcgtagttcggaggacggacgtacggcgtacgtaccgtcgtacggtcacgacccgtacggctccgtccccgtcggtaccg

SEQ ID NO: 75246 - DNA, 495 bp, Homo sapiens
  misc_feature: GYAE6OF02GUL36.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggccccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtgcagttatgtcgtattcggcggtaggactacgctgaccgtctaggtcagcccaaggcctgcccctggtcc

SEQ ID NO: 75247 - DNA, 677 bp, Homo sapiens
  misc_feature: GYAE6OF02H4N2R.49.20.B09.1.454.CMB.1.raw
  modified_base (284)..(284): a, c, t, g, unknown or other
  misc_feature (284)..(284): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccacggccctgtctggtnatttataagtctttgagacggccctcgacgggaccctgagcgtattctcgtcggctccgagcctacgaagggaaccaaacgtacgtacctaaccgttcgaaccctaagtcgaggtacgggtaccggtcccgggaccgaagggaacgggaacggacgggccgtacgtaacgtttaacgttaccgttgttaccgacggttcccggactaacggaacgacggaccgtacgggttcggtaccgttaaggtttacgttcggttacggtttaacggttccggggtacgggtacggggtaccgttaccggtacggttaccggtacccggttaccgttaacggtccgaaccggaccccggtaacggtcccgtacccggtccccccggttacggttaccccg

SEQ ID NO: 75248 - DNA, 525 bp, Homo sapiens
  misc_feature: GYAE6OF02GRPCL.49.20.B09.1.454.CMB.1.raw
  modified_base (428)..(428): a, c, t, g, unknown or other
  misc_feature (428)..(428): n is a, c, g, or t
  modified_base (457)..(457): a, c, t, g, unknown or other
  misc_feature (457)..(457): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttaataaagtactttggagaggccctcgacggggacccctggagcgattctctggctccagctcgaggacaacagtcaccttgaccatcagtcggagtccggcagaggacgaggctgactattactgtcagtccgcagacngacagtgctagttatgtcgtagttcgggnggagggactacggcgtacggaccgtccgtaggtccacgcccgaaggcctccggtcccccgtggtaccc

SEQ ID NO: 75249 - DNA, 587 bp, Homo sapiens
  misc_feature: GYAE6OF02HLFU7.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttaagtaaagtactttagagaggacctcgacgggtacccctgagcgtattctctggctccgagcctacgacgggacaacgagtccaccttcgacctagtcagtggacgtccggacaggaggacgaggctgacttattactgtactagtccgacacgacgagacgagtcggactagtttatggttacgttacgttccggggacgggtagggtaaccttaccggcgttaccggacccgttccgtaacgggttccgacggtaccccgaaacggtcccgtcccggtcccccgtcgggtaccccg

SEQ ID NO: 75250 - DNA, 524 bp, Homo sapiens
  misc_feature: GYAE6OF02G27Q7.49.20.B09.1.454.CMB.1.raw
  modified_base (303)..(303): a, c, t, g, unknown or other
  misc_feature (303)..(303): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttataaagctttgagnggccctcgacgggacccctgagcgattctctggctcagctcgagggacaacgagtcaccttgacctatcagtggacgtccggcgagaggacgaggctagacttattactgtcagtccgacagacagacagtgctagttatgtcgtacgttcgggacggtagggactacggctacgtaccgtccgtacggtcacgcccgaaggccgtccggcccctggtccc

SEQ ID NO: 75251 - DNA, 517 bp, Homo sapiens
  misc_feature: GYAE6OF02I9AQH.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagctttgagaggtccctcacgggacccctggacgcgtattctcgtggctccagctacgagggacaacgagtcaccttgacccatcagtggagtccgcgagaggacgaggctgactattactgtcagtcgcagacagcaggtgctagttatgtcgtagtcggcggaggactacggctacgaccgtcgtaggtcacgcccgaaggcctacggtcccccgtcgtaccg

SEQ ID NO: 75252 - DNA, 518 bp, Homo sapiens
  misc_feature: GYAE6OF02HUF7Z.49.20.B09.1.454.CMB.1.raw
  modified_base (242)..(242): a, c, t, g, unknown or other
  misc_feature (242)..(242): n is a, c, g, or t
  modified_base (481)..(481): a, c, t, g, unknown or other
  misc_feature (481)..(481): n is a, c, g, or t
  modified_base (483)..(518): a, c, t, g, unknown or other
  misc_feature (483)..(518): n is a, c, g, or t
tcagagtcgagagacacgaccggtgctcgatttagtgtagtgtgaaggggggctgtgggtccaggaggcagaaactctgggtgtctcaccatggcctggatccctctacttcctcccctcctcactctctgcacaggctctgacgcctctatgagctgacacagtcaccccgtggtgtctgtcgtcctgaggacagacggcaggactcactgcctgtggcatgctagttcaaaccaaaaaanaatatgtacttaacgtaggtaaccagacgaaggacggacgaacggccacggtcccctgttcgttggtattaaatttaagtaaaagtcttttaggaacgacggtacccgtagaaccgggtaccccgttaggacgtacgtaacgtttccgtacgtcgggtcctacccgagttaccgaccggaaaagggtaaaccaaaccggtacgttacctaaacccgttaccgaacttaacgtacggtanannnnnnnnnnnnnnnnnnnnnnnnnnnnnnnnnnnn

SEQ ID NO: 75253 - DNA, 654 bp, Homo sapiens
  misc_feature: GYAE6OF02JPHIZ.49.20.B09.1.454.CMB.1.raw
  modified_base (166)..(166): a, c, t, g, unknown or other
  misc_feature (166)..(166): n is a, c, g, or t
  modified_base (191)..(191): a, c, t, g, unknown or other
  misc_feature (191)..(191): n is a, c, g, or t
  modified_base (221)..(221): a, c, t, g, unknown or other
  misc_feature (221)..(221): n is a, c, g, or t
  modified_base (332)..(332): a, c, t, g, unknown or other
  misc_feature (332)..(332): n is a, c, g, or t
  modified_base (420)..(420): a, c, t, g, unknown or other
  misc_feature (420)..(420): n is a, c, g, or t
  modified_base (561)..(561): a, c, t, g, unknown or other
  misc_feature (561)..(561): n is a, c, g, or t
  modified_base (622)..(622): a, c, t, g, unknown or other
  misc_feature (622)..(622): n is a, c, g, or t
tcagagtcgagagacacgaccggtgctcgatttagtgtagtgtgaaggggcgtggtgggtccgaggaggcgagaactctgggtgtcgtcaccatggcctggatccctctacttctcccctcctcactctctgcacaggctctgaggcctcctatgagctgaccacngtcaccctcggtgtctgtcgtcctnaggacaggacgccaggatcacctgccttcngggcctatcgctaacttcggacccaaaaaacattaagttcgacctttacgtacggtaccagcctaaggacggccgaggcccgagggtccccccttaggttccttagggttntaatttttaaacgaaagtaccgttttaggaacggtaacgggtccccctaggtaaccggggtacccctaggacgtacggacttcgttcncggtacctcgtacgcttcgaacgggtactaacagtcctaccttcggacctagtccgacggtggacgtccggcaagggacggacgaggtctacgaacttattcgttgtaccacgttccgacgacgactcggacaggggtacnctaggttactaggtcgttacgcggggccgaagggtccacggtcgtagtaccgtgacgtacncggacccgtggacctccggtacccgtgtaccg

SEQ ID NO: 75254 - DNA, 588 bp, Homo sapiens
  misc_feature: GYAE6OF02JSCCI.49.20.B09.1.454.CMB.1.raw
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (325)..(325): a, c, t, g, unknown or other
  misc_feature (325)..(325): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggcagacggccaggatcacctgctctggcatgcattgaccaaaaacatagtgcttactggtaccagcagaggccaggccaggccctgtctgngtatttanaagtcttgagacggcctgacggaccctgacgcgattcncgtggctcgagctcgaacggacaactacgtcctaccgttgacctatcgagtcggacgtccgacgaggacggacgaggctagacttagttactcgtacgtacgtccgactacggacgacggtacgaggttcggacgttaaggtttacgttcggttaacgtacggtttccggggacgggtagggtaccgtacggtcgtacgtacccggttccgtaacggtccgaacgtacccgaacggtccgttcccggaccccgtacggttccc

SEQ ID NO: 75255 - DNA, 594 bp, Homo sapiens
  misc_feature: GYAE6OF02HAPWL.49.20.B09.1.454.CMB.1.raw
  modified_base (364)..(364): a, c, t, g, unknown or other
  misc_feature (364)..(364): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacatatgcttacgtggtaccagcagaggccaggccacggcccctgtcttggtgtatttaataaagtctttgagacggccctgacgggacccctgacgcgtattctcgtggcctcagctcgaggacaacgngtcaccttgaccatcgagtcggacgtccggcaggacggacgaggctagacttattacgtgtctagtccgcaagacaggcgtaggtcggactagtttaagtcggttacgttacgttcgggacgggtacggtaaccgttaccggtcgtaccggtacccggttaccgtaacgggttaccgaaccggtaccccggaacggtcccgttacccggtcccccgttacggttaccccg

SEQ ID NO: 75256 - DNA, 589 bp, Homo sapiens
  misc_feature: GYAE6OF02HFJWZ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagacggccaggccacggcccctgtcttggtgtatttataaagtactttgagacggccctcgacgggacccctgacgcgtattctcgtggcctcagctacgaggacaacagtccaccttagaccatcagtggacgtccggacaggacggacgacgggctacgacttacgttacgtgtaccgtacgtcccgacgaacgacgagaccgtaggtcggacgtagtttacgtggttacgttagttcgggacggacgggacgttaccggcgttaccggacccgttcgtacggtaccaccggtacccgaaggtcccgtcccggtcccccgtacggtacccg

SEQ ID NO: 75257 - DNA, 761 bp, Homo sapiens
  misc_feature: GYAE6OF02HJA1W.49.20.B09.1.454.CMB.1.raw
  modified_base (240)..(240): a, c, t, g, unknown or other
  misc_feature (240)..(240): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtgtctgtcgtcctcgaggacagacggccaggactcacctgctcgtggcatgctattgaaccaaaaanatatcgtcttacgtggtaccagcaagacggccaggccacggcccctgttcgttggtagtatttaagtaaagtactttagagacggtccctacgacgggacccctggacgtcgtattcgtccgtggccttaccgagtccgtacggaaacggggaacctaaaaccgtacgttaccctaacccgtttacgaaaccccgtaacgttaccgtaacgggttacgggtaaccgggttaccccgggacccggaaagggtaaccggggaaaccgggtaacgggtaccgttaacggtaaccgtttaacggtttaaccgtttcggttaccgtaaccggttaccgaccgtaacggaaaccgacggtacgaacgggtcggaacgttaacggtttagttacggttacggttacggttaccggggacgggtacgggtaccgtaccggtcgttaccggtaacccggttaccgttaccggtaccgaccggtaacccgtaaccggtcccggttacccggtcccccgttacggttacccg

SEQ ID NO: 75258 - DNA, 536 bp, Homo sapiens
  misc_feature: GYAE6OF02I6B36.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagagccaggccaggcccctgtcttggtgtatttataaagctttgagacggccctgacgggacccctgagcgattctctggctccagctcgagggacaacgacgtctaccttgaccatccgaggtcggacggtccggccaggacggacgaacggctgacttacttacgtgtcagtccgacagacagcgagtcgactagttatgtcgtagtcgggaggaggactacgctacgccgtcgtacggtccgacgacccgaacgggctccggtccccgttggtaccc

SEQ ID NO: 75259 - DNA, 611 bp, Homo sapiens
  misc_feature: GYAE6OF02HSJCR.49.20.B09.1.454.CMB.1.raw
  modified_base (174)..(174): a, c, t, g, unknown or other
  misc_feature (174)..(174): n is a, c, g, or t
  modified_base (235)..(235): a, c, t, g, unknown or other
  misc_feature (235)..(235): n is a, c, g, or t
  modified_base (239)..(239): a, c, t, g, unknown or other
  misc_feature (239)..(239): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtntctgtgtcctcaggacagacggccaggatcacctgctctggcgatgcattcgaccaaaaanatangcttactggtaccagcagaggccaggccacgccctgtcttggtgtatttataaagtactttgagacggccctcgacgggacccctggacgcgtacttcgtcgtcggcctccgagtccgtacgaaggggaaccaaacgtacgtaccaaccgttgaaccaatcgtaaggtggtaacggtcccggaccaagggtacgggacgaggcctagtaacttaacgttacgtcgtacgtacgtccgacacgacacgacctaggtgacgtagttacgttcggtcgttagttcgggacggtacggtcctacggtcgtacgtaccggtaccgtacggtcgaccggtacccgaaggtcccgtaccggtcccccgtcggttacccg

SEQ ID NO: 75260 - DNA, 538 bp, Homo sapiens
  misc_feature: GYAE6OF02IV8GP.49.20.B09.1.454.CMB.1.raw
  modified_base (213)..(213): a, c, t, g, unknown or other
  misc_feature (213)..(213): n is a, c, g, or t
  modified_base (234)..(234): a, c, t, g, unknown or other
  misc_feature (234)..(234): n is a, c, g, or t
  modified_base (429)..(429): a, c, t, g, unknown or other
  misc_feature (429)..(429): n is a, c, g, or t
  modified_base (451)..(451): a, c, t, g, unknown or other
  misc_feature (451)..(451): n is a, c, g, or t
tcagagtcgagagacacgaccggtgctcgatttagtgtagtgtgaagggggctgtgggtccaggaggcagaactctgggtgtctcaccatggcctggatccctctacttctcccccctcctcactctctgcacaggctctgaggcctcctatgagctgacacagtcaccctggtgtctgtgtcctcaggacagacggccaggatcacctgctntggcatgcattgaccaaaaanatatgcttactggtaccagcagaggccaggccacggcccctgtcttggtgtatttaataaagtctttgagacggccctcgacgggacccctgagcgtattctctggcctccagctacgagggacaacgacgtcaccttgacctatcgagtggacgtccggcaggaggacgagctgactattactgtcagtccganacgacagacgagtgactagttntacgtcgttagtcgggacggaggtactacggcgtacggtaccgtccgtaggtcacggtccgaaggtcctccgtccccgtcggtaccg

SEQ ID NO: 75261 - DNA, 607 bp, Homo sapiens
  misc_feature: GYAE6OF02H4XLT.49.20.B09.1.454.CMB.1.raw
  modified_base (232)..(232): a, c, t, g, unknown or other
  misc_feature (232)..(232): n is a, c, g, or t
  modified_base (283)..(283): a, c, t, g, unknown or other
  misc_feature (283)..(283): n is a, c, g, or t
  modified_base (351)..(351): a, c, t, g, unknown or other
  misc_feature (351)..(351): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagcggccaggatcacctgctcgtggcatgcattgaccaaaanatatgacttactggtaccagcagacggccaggccacggccctgttctggtnatttaataaagtctttgagcggtccctcgaccgggacccctggacgtcgtattcctcgtggcctcganctacgaggaccactagtcaccttgacctatcgagtcggacgtccggacaggacggacgaggtctacggtacttaagttcgtcgtacgacggtccgacacgacagccgtagggttcgacgtaacggtttacgttcggttacggttacgttaccggggacggtacgggtactaccggtcgtaccggtacccgttaccgtacgggtacccgaccggtacccggaacggtcccttcccggtacccccggttagtaccccg

SEQ ID NO: 75262 - DNA, 585 bp, Homo sapiens
  misc_feature: GYAE6OF02H9XK2.49.20.B09.1.454.CMB.1.raw
  modified_base (233)..(233): a, c, t, g, unknown or other
  misc_feature (233)..(233): n is a, c, g, or t
  modified_base (295)..(295): a, c, t, g, unknown or other
  misc_feature (295)..(295): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaanatatgcttacgtggtaccagacagacggccaggccacggcccctgtcttggtatattttaanaaagtctttagagacggccctcgacgggacccctgagcgatttctcgtcggctccagctacgaacgggacaacacgtcctaccgtgaacctatcaggtggcgtccggacaggacggacgaggctgtacttacttacttcgtcacgtccgacgagacgtagacgagtcggactagttatcggtaggtacgttacgggcgggtacgggtactacggtccgttacggacccgttacgttacggtaccgacgtacccggaacggtcccgttccggccccccggttcgtaccccg

SEQ ID NO: 75263 - DNA, 603 bp, Homo sapiens
  misc_feature: GYAE6OF02HAW2P.49.20.B09.1.454.CMB.1.raw
  modified_base (175)..(175): a, c, t, g, unknown or other
  misc_feature (175)..(175): n is a, c, g, or t
  modified_base (292)..(292): a, c, t, g, unknown or other
  misc_feature (292)..(292): n is a, c, g, or t
  modified_base (373)..(373): a, c, t, g, unknown or other
  misc_feature (373)..(373): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtntctgtgtcctcaggacagacggccaggatcacctgctctggcgatgcattgaccaaaaacatatgcttactggtaccagcagaggccaggccaggcccctgtcttggtgtatttaanaaagtactttgagacggccctcgaacgggacccctggacgcgtattcgtctgggcctccagtcctacgaggggaacaaacncggtaccaccgttcgaacctatacgaggtcggacggtccggaccgaaggaagggaccgaggtctagtaacttacgttaacgtcgttacacgtccgacacgacgagcgagtggattagttacttgttacgtagttcgggcgggtagggaccgtacggcgtacggacccggttccgtaacggtccgaccggaccgaacggtcccgtacccggtcccccgttaccggtacccg

SEQ ID NO: 75264 - DNA, 524 bp, Homo sapiens
  misc_feature: GYAE6OF02IQMXN.49.20.B09.1.454.CMB.1.raw
  modified_base (290)..(290): a, c, t, g, unknown or other
  misc_feature (290)..(290): n is a, c, g, or t
  modified_base (429)..(429): a, c, t, g, unknown or other
  misc_feature (429)..(429): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagagccaggccaggcccctgtcttggtgatttanaaagtactttgagaggccctcgacgggacccctgagcgattctctggctccagctcagggacaacagtccaccttgaccatcgagtggacgtccggcaggaggacgaggctagactattactgtcacgtccgacagacngcagtcacgtagttagttgtcgttagttcggacggagggactacggctacggaccgtctaggtccacggacccaggcctcgcccccgtcggtccg

SEQ ID NO: 75265 - DNA, 523 bp, Homo sapiens
  misc_feature: GYAE6OF02HWX0F.49.20.B09.1.454.CMB.1.raw
  modified_base (292)..(292): a, c, t, g, unknown or other
  misc_feature (292)..(292): n is a, c, g, or t
  modified_base (361)..(361): a, c, t, g, unknown or other
  misc_feature (361)..(361): n is a, c, g, or t
  modified_base (449)..(449): a, c, t, g, unknown or other
  misc_feature (449)..(449): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgtatttanaaagtctttgagacggccctcgacgggacccctgacgcgtattctctggctccagctcgaggacaacgngtcaccgttgaccatcgagtcggagtccggcaggaggacgaggctgactattactgtacacgtccgcaagacgagcagtgactagttntgtcgtagtcggaggaggactacgctacgaccgtcgtacggtcacgacccaggtccgtaccgccccgttggtcc

SEQ ID NO: 75266 - DNA, 783 bp, Homo sapiens
  misc_feature: GYAE6OF02IH2UZ.49.20.B09.1.454.CMB.1.raw
  modified_base (232)..(232): a, c, t, g, unknown or other
  misc_feature (232)..(232): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgagcctctatgagctgacacagtcacctcggtgtctgtgtcctcaggacagacggccaggatcacctgctctggcgatgctattgaccaaaaanatatgcttactggtaccagcagaggcaggccaggcccctgtccttggtcgtaagtttaagtaaagtactttggagtacggtccctcgaacggggtacccccttggaacggtccggtaatttccgtcgttacgggccttacccgaaggtcctttacggaacgggggaaccctaaacgaacgttacccgtaacccgtttacggaaccctaacgttaccgtaacggttacggggtaaccggttaccccgggtacccggaaagggaacggggtaaaccggaggggtaccgttacggtaaccgtttaaacgtttaaccgttcggttaccgtaaccggttcccgaccgaacggaaccgtaacgggacgtaacgggtacgggtaaccgtaggttttaacgttcggttaccgttaacggttttaccgggaccggggtaacgggtaaccggttaaccggtaccgttaccgggtacccgggttaccgttaaccgggtaccgtaaccggtacccggtaaaccgggtcccgttaccggtccccccccgttaggttaacccccg

SEQ ID NO: 75267 - DNA, 684 bp, Homo sapiens
  misc_feature: GYAE6OF02JZ6QC.49.20.B09.1.454.CMB.1.raw
  modified_base (185)..(185): a, c, t, g, unknown or other
  misc_feature (185)..(185): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagaccggccaggatcacctgcctctggcgatgcattcgaccaaaacatatgtacttactggtaccagacaggacggccaggacccgacggccccccgttgttccgttgggtacgtattttaaagtaaacgtacgtttagacggtacggtccccgtccgaacggggtaacccccgtggacggtacggtactttccgtccgtacgggtcctccgacggtctacggacgggtaaccaacgtacgtcctaccttacgacctactcgtaggtcggtaacggtcccggtaccgaacgggacggaacgacggtacgtactacgttacgttacgtcgtacgtacgccgtacacgacgtagacgacgtacggacttagtactggttacggttacggtacggacgggtacgggtaccttacggtccgtacggttacccgtacggtaccgtcgtaaccggacccgtaaccggtccgtccccggttaccccggtcggttaaccccg

SEQ ID NO: 75268 - DNA, 593 bp, Homo sapiens
  misc_feature: GYAE6OF02GOU7L.49.20.B09.1.454.CMB.1.raw
  modified_base (293)..(293): a, c, t, g, unknown or other
  misc_feature (293)..(293): n is a, c, g, or t
  modified_base (432)..(432): a, c, t, g, unknown or other
  misc_feature (432)..(432): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgctattgaccaaaaacatatgcttactggtaccagcagaggccaggccaggcccctgtcttggtgtatttaanaaagtactttggagtacggccctacgacgggacccctgacgcgtattctcgtggcctccgagtcctacgacgggaacaacgacgttaccaccgttagacctatcaggtggacggtccggacgaggacggacgaggtcgngacttattacgtgtcgacgtccgacacgacgacgcgtacggtggacgttaagttagtcggtacgttagtacgggacgggtaggtacctacgggtctaccggtaccggtccgtacggtacgacggacccgtaacggtccgtccggtacccccgtcgtacccg

SEQ ID NO: 75269 - DNA, 576 bp, Homo sapiens
  misc_feature: GYAE6OF02F6FHB.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacaatatgcttaactggtaccagcagaggccaggccaggcccctgtcttggtgtatttataaagtactttgagaggccctcgacgggacccctgagcgtattctctggctccagctcgagggacaacgtacgtcaccgttgacccatcgagtacggacgtccggaccgagacggacgacggctagaacttattactgtacacgtccgtacagacacgacgtaggtggacgtagttagtgttacgttagttcgggcgggtaggtacgtacggtcgtacgtaaccgttccgtaacggtccgacggaccccgaaggtccctaccggtccccccgttaggtacccg

SEQ ID NO: 75270 - DNA, 536 bp, Homo sapiens
  misc_feature: GYAE6OF02I0DD6.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctaaggcctcctatgagctgacacagtcaccctcggtgtctgtgtcctcaggacagacggccaggatcacctgctctggcgatgcattgccaaaaacaatatgcttactggtaccagcagaggcaggccaggcccctgtcttggtgatttataaaagactttggagaggccctcgacgggacccctgagcgattctctggctccagctcagggacaacagtcaccttcgaccatcagtggacgtccggcagaggacgaggcgtgactattactgtcgacgtccgcgagacagcagtggctagttagtcgttcgtagttcgggcggtagggacgtacgcgtcggacccgttacgtaggtccgacgcccgaaggtcctccggcccccgttcggtcctaccg

SEQ ID NO: 75271 - DNA, 543 bp, Homo sapiens
  misc_feature: GYAE6OF02GHN5F.49.20.B09.1.454.CMB.1.raw
  modified_base (233)..(233): a, c, t, g, unknown or other
  misc_feature (233)..(233): n is a, c, g, or t
  modified_base (288)..(288): a, c, t, g, unknown or other
  misc_feature (288)..(288): n is a, c, g, or t
  modified_base (392)..(392): a, c, t, g, unknown or other
  misc_feature (392)..(392): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcatgcattgaccaaaaanatatgcttactggtaccagcagaggccaggccaggcccctgtcttggtgatttanaaagtactttgagtaggccctgacgggacccctgagcgattctcgtggctcagctcgaggacaacagtcacttgacatcagtggagtccggccaggacggacgngctgactattactgtcacgtccgcagacacgcagtcgctagttagtgtacggttagttcgggacgggtacgggacttacggcgtacggtacccgttaccgttacggtaccgacggccccgaacggcgttcccggcccccgttcggtacccg

SEQ ID NO: 75272 - DNA, 674 bp, Homo sapiens
  misc_feature: GYAE6OF02H215I.49.20.B09.1.454.CMB.1.raw
  modified_base (231)..(231): a, c, t, g, unknown or other
  misc_feature (231)..(231): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctcaggacagacggccaggatcactgctctggcatgcattagaccaaaanatatgcttactggtaaccagcagacggccaggccacggtcccctgtcgttgtagtacttttaagaaagtacttttggaacgtacggtccctacgacgggtacccctaggtacgcgtacttctcgtcgtctcgagcctacgacgggaaccaacgtacgtacctacccgttacgaacctaagtaccgtaaggtcggtaccggttccccgggaccgaagggtaacgggaaccggtacgggtacccgtaggttaaccttaacgtttaccgttacgtaccgtaccggtaccgacgaacgacgacgacgtaggtcgtacgtagtttagtcggttacgtacggttacgggacggacggtaccgtaacggtcgtaccggttaccgtccgttaacggtaccgtacgggacccgtaacggtcccgtaccggtccccccgttacgggttacccc

SEQ ID NO: 75273 - DNA, 542 bp, Homo sapiens
  misc_feature: GYAE6OF02G9FMC.49.20.B09.1.454.CMB.1.raw
  modified_base (175)..(175): a, c, t, g, unknown or other
  misc_feature (175)..(175): n is a, c, g, or t
  modified_base (186)..(186): a, c, t, g, unknown or other
  misc_feature (186)..(186): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtntctgtgtcctnaggacagacggccaggatcacctgctctggcatgcattcgaccaaaaacatatgcttactggtaccagcagaggcaggccaggcccctgtcttggtgatttataaagtactttgagaggccctcgacgggacccctgagcgtattctctggctccgagctcgagggacaacgacgtcacttcgaccatcgagtggacgtccggccgagaggacgaggctgactattactgtcgagtccgacagacagacagtcgctagttatcgtacgtagttcgggacggaggtacctacggtcgtacgtaccgttcgtacggtacacggacccgaacggccgtaccgcccccgttacggtcccg

SEQ ID NO: 75274 - DNA, 731 bp, Homo sapiens
  misc_feature: GYAE6OF02HM4HH.49.20.B09.1.454.CMB.1.raw
  modified_base (177)..(177): a, c, t, g, unknown or other
  misc_feature (177)..(177): n is a, c, g, or t
  modified_base (236)..(236): a, c, t, g, unknown or other
  misc_feature (236)..(236): n is a, c, g, or t
tcagagtcgagagacacgaccggtgctcgatttagtgtagtgtgaagggggctgtggggtccagggaggcagaactctgggtgtctcaccatggcctggatcccgtctacttctccccctctcacgtctctgcacaggctctgaggcctcctatgagctgacacagtcaccctggtntctggtgtcctgaggaccagacggccaggatcacctgctctggcatgcattgaccaaanatatgcttactggtacagcagaggccaggccaggcccctgtcgttcggtgacttttagaaagtacgtttgagtacggccctgacgggtacccctgacgcgacttctcgtggcctccgagtctacgtacgggacaacgacgtacctaccgttagaccacttacgacggtacggtacggttcccgggaccgaagggaaccgggacggaacgggtaccgttacgaccgtttaacggttaaccgttacgggtacgtacggttacccggtacgtaacggtaacgtaacgtaccgtacgggttacgggaccgttaacggttttaacggttacggtttaccggttaacgggttttcccgggtaacgggggtacgggttaaccgttacccgggttccggttaccggaacccggtttaacccgggttacgggtttacccgacccgggttacccggaaccgggttcccgttaccgggttccccccccggttaggttaacccccgg

SEQ ID NO: 75275 - DNA, 541 bp, Homo sapiens
  misc_feature: GYAE6OF02G3P08.49.20.B09.1.454.CMB.1.raw
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtcttggtgatttaataaagctttggagacggccctgacgggcccctgagcgattcnctggctcagctgaggacaacngtcacttgaccatcagtggagtccggcaggaggacgaggctacgactagttacgtgtacgagtcccgatagacaggcgtagtcggtactagtttatcggttcgtagttcgggacggtagggactaccggcgtacggtaccgtaccgtagtacgaccgaccgtacggccgtcccggtccccgtggtaccc

SEQ ID NO: 75276 - DNA, 710 bp, Homo sapiens
  misc_feature: GYAE6OF02GP7YY.49.20.B09.1.454.CMB.1.raw
  modified_base (149)..(149): a, c, t, g, unknown or other
  misc_feature (149)..(149): n is a, c, g, or t
  modified_base (309)..(309): a, c, t, g, unknown or other
  misc_feature (309)..(309): n is a, c, g, or t
tcagagtcgagagacacgaccggtgctcgatttagtgtagtgtgaagggggacgtagtgggtccaggaggcagtaacgtcctggggtggtacctcaccgaactgggccctggatccctctacttcctccccctctcactctcgtgccanaggtcctcgtgaacggtcctcgttatggacgctgaccacgacgtccctacccgttcggttgtcctggtagggtacctcgacggacctaggaccggtccaggacgtccaaccgttgaccttctgggtcgatggacctagttcgacccaaaaacgtgttacnggtaccttacgtacggtaccagccgagtacggccgacggcccacggtcccctgttacgttggtgtatttataacgtacgtttgagcggtccctacgacgggaccctgacgcgtacttcgtcgtggtcctccgaggtcgtacgacgggtaacaacgtcgttaccaccttcgacctatcgtaggtggacgtaccggcgaggacggacgaggtcgtagtacttagttacgtgtacgtacgtccgactacgacgtaggcgtaggtcgtacgtagttacgttcgtcggttaggttccgggacggggtacgggtaccgtacggtccggtacggtaccggttaccgttacgggtaccgaccgggttacccggtacgggtccctaccgggtcccccgtacggttacccg

SEQ ID NO: 75277 - DNA, 528 bp, Homo sapiens
  misc_feature: GYAE6OF02GC4AP.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagctttgagaggccctcacgggacccctgagcgattctctggctcagctcgaggacaacagtcacttgaccatcagtggagtccggcagaggacgagctagactattactgtcaggtccgcagacagcagtggactagttagtgtcgttacgtcgggacggtagggaccgtacgcgtacggacccgtccgtaggtaccgacgacccgaggtccgtccggtcccccgtcgggttaccc

SEQ ID NO: 75278 - DNA, 593 bp, Homo sapiens
  misc_feature: GYAE6OF02HM6QZ.49.20.B09.1.454.CMB.1.raw
  modified_base (235)..(235): a, c, t, g, unknown or other
  misc_feature (235)..(235): n is a, c, g, or t
  modified_base (294)..(294): a, c, t, g, unknown or other
  misc_feature (294)..(294): n is a, c, g, or t
  modified_base (455)..(455): a, c, t, g, unknown or other
  misc_feature (455)..(455): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcgatgcattgaccaaaanatatgcttactggtaaccagcagaggccaggccacggcccctgtcttggtgtattttanaaagtactttgagacggccctacgacgggacccctaggagtcgacttctcgtggcctccagctcgaagggacaacgacgtccaccgttagacctatcgagtggacggtccggccgaagaggacgacggtactagtacttaattacgtgtacgacgtaccgnacgactagaccgtagtggcttagttacgttggttacgtagttcgggaggtacgggtacgtaccggtacgttccggtacccggtacgttacgggccgacggcccgaacgggtcccgtcccggacccccgtggttacccg

SEQ ID NO: 75279 - DNA, 540 bp, Homo sapiens
  misc_feature: GYAE6OF02FMALY.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaaacaatatgcttactggtaccagcagaggccaggccaggcccctgtcttggtgtatttataaagtctttagagaggccctcgacgggacccctgagcgattctcgtggctccagcctgacgggacaacgagtcaccttcgaccatcaggtggacgtccggaccaggacggacgaggctagacttattacgtgtcacgtcgacagacagcgagtggactagttatggtcgtagtcgggacggtacgggcgtacgcgttacggacccgtcgtaggtccacggacccgaaggccgtcgcccccgtggtaccc

SEQ ID NO: 75280 - DNA, 511 bp, Homo sapiens
  misc_feature: GYAE6OF02FXC3M.49.20.B09.1.454.CMB.1.raw
  modified_base (353)..(353): a, c, t, g, unknown or other
  misc_feature (353)..(353): n is a, c, g, or t
  modified_base (416)..(416): a, c, t, g, unknown or other
  misc_feature (416)..(416): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttataaagactttgagaggccctcagggacccctgagcgattctctggctcagctcagggacaacngtcaccttgaccatcagtggacgtccggccagaggacgaggctgactattactgtcagtccgnagacagacagtggcagttatgtcgttagttcgggcggtagggactacggcgtgaccgtcgtaggtcagcccgaaggccgtccgccccgtcggtcc

SEQ ID NO: 75281 - DNA, 548 bp, Homo sapiens
  misc_feature: GYAE6OF02FLGSI.49.20.B09.1.454.CMB.1.raw
  modified_base (246)..(246): a, c, t, g, unknown or other
  misc_feature (246)..(246): n is a, c, g, or t
  modified_base (338)..(338): a, c, t, g, unknown or other
  misc_feature (338)..(338): n is a, c, g, or t
  modified_base (374)..(374): a, c, t, g, unknown or other
  misc_feature (374)..(374): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttacnggtaccagcagaggccaggccaggcccctgtcttggtgtaatttataaagtctttagagacggccctcgacgggacccctggacgcgattcncgtggctcagctcgaggacaacgagtcacctgaccntcagtggacgtccggacgagaggacgaggctgactattacgtcgtcgagtccgacgagacagcgagtgactagttatcgttacgtacgttcgggacggtagggactacggtcgtacggacccggtccgtaggtaccacggacccgaacggtcctaccggacccccgtcggtacc

SEQ ID NO: 75282 - DNA, 651 bp, Homo sapiens
  misc_feature: GYAE6OF02G2193.49.20.B09.1.454.CMB.1.raw
  modified_base (238)..(238): a, c, t, g, unknown or other
  misc_feature (238)..(238): n is a, c, g, or t
  modified_base (293)..(293): a, c, t, g, unknown or other
  misc_feature (293)..(293): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggactcacctgctcgtggcgatgcattcgaccaaaaanatatgcttactggtaccagcagaggccaggccaggcccctgtctggtgatttaanaaagtactttgagtacggccctcgaacggacccctggagacgtattcctcgtacggcctaccgacgtctacggaaggaacctaaacgtacgtacctaaccgttcgaaaccctaagtaccgtaacggtcgggaccggtacccggaacggaacgggaacgggtacggtaacggtcgtaacgtaaccgtttaacgttaacgtcgtaccgtaaccgtccgacgtaacggacgtaacgaccgtagggtacggtaccgttaggttacgtttcggtacgttaacggttcgggacgggtacgtacgtacgtcgtacgtccggtacgtggtaccgcgaccggtacgcggtaccctccggtcgtaccg

SEQ ID NO: 75283 - DNA, 615 bp, Homo sapiens
  misc_feature: GYAE6OF02ILBUJ.49.20.B09.1.454.CMB.1.raw
  modified_base (235)..(235): a, c, t, g, unknown or other
  misc_feature (235)..(235): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaanatatgcttactggtaccagcagaggccaggccacggcccctgtcgttggtgttatttaagtaaagtactttgaggacggtccctcgacgggacccctgacgcgtacttctcgtcgcctccgacgcctacgacgggaacaacgacgtacctaccttcgacctatcgagtggacgtcccggaccgaaggaggaacggacggctacggtactaagtttacctagtaccgtaggttccgacgtaacggacgtacggactacggtaggctaaggttacgttggttacgttagttacgggaccgggaggtaccgtacggctacggtaccggtaccgtacggtccacggacccgaaggtcccgtacccgtccccggtacggtacccg

SEQ ID NO: 75284 - DNA, 562 bp, Homo sapiens
  misc_feature: GYAE6OF02HTHZU.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttaataaaagacttttgagacggcccctcgaacggggaccccctgacgcgtattctcgtggcctccagctacgaaggggaccaaacgtagtaccaccttcgaaccactacaggtcggacgtcccgggcaggaggacgaggctagactattactgtcacgtccgacagacagcagtggctagttatgtcgtagttcgggcggagggtacctacggcgtacgaccggtccgtacggtacgacgacccgaaggtcccttcggcccccgttcggtacccg

SEQ ID NO: 75285 - DNA, 529 bp, Homo sapiens
  misc_feature: GYAE6OF02HN33H.49.20.B09.1.454.CMB.1.raw
  modified_base (438)..(438): a, c, t, g, unknown or other
  misc_feature (438)..(438): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacatatgcttaactggtaccagcagaggccaggccaggccccctgtcttggtgtattttaagtaaagactttgagaggccctcgacgggacccctgagcgattctctggctcagctcgaggacaacagtcaccttgaccatcagtggacgtccggcaggagacgagctgactattactgtcagtccgacagacagcagtgcagtttntgtcgtaagttcgggacggagggtactacggctcggtaccgtccgtaggtccgacgtacccgaaggtcccgtccgtacccccgtggtaccc

SEQ ID NO: 75286 - DNA, 559 bp, Homo sapiens
  misc_feature: GYAE6OF02G7RNU.49.20.B09.1.454.CMB.1.raw
  modified_base (487)..(487): a, c, t, g, unknown or other
  misc_feature (487)..(487): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcttggtgtatttaataaagctttgagacggccctcgacgggaccctgacgcgtattctcgtggcctcgagctcgaggacaacgcgtcaccttgacccatcgagtcggacgtccggacaggaggacaggctgactattactgtcacgtccacagacagcagtagcgtagtttagcgttacgtaagttcgggacggagggtacgtaccggngttccgacccggttccgtacggttacaccggtcccgtaaaggcccgtacccgtcccccgtacggttaccccg

SEQ ID NO: 75287 - DNA, 541 bp, Homo sapiens
  misc_feature: GYAE6OF02H2G0W.49.20.B09.1.454.CMB.1.raw
  modified_base (288)..(288): a, c, t, g, unknown or other
  misc_feature (288)..(288): n is a, c, g, or t
  modified_base (324)..(324): a, c, t, g, unknown or other
  misc_feature (324)..(324): n is a, c, g, or t
  modified_base (334)..(334): a, c, t, g, unknown or other
  misc_feature (334)..(334): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaaacaatatgcttactggtaccagcagaggcaggccagcccctgtctgtgatttanaaagcttgagagcatcgagggaccctgagcgattcnctggctaccngctcgaggacaacagtccacttcgaccatacgagtggacgtccggaccgagaggacgaggctagaacttatacgttgtactagtccgacagacagacaggtggactaagttagtacgtcgtacgttcgggacgggagggacgtacggccgtaggtaacccgtccgtaggtaccacggacccaagggtcctccggtcccccgtaccgg

SEQ ID NO: 75288 - DNA, 560 bp, Homo sapiens
  misc_feature: GYAE6OF02HIDVG.49.20.B09.1.454.CMB.1.raw
  modified_base (437)..(437): a, c, t, g, unknown or other
  misc_feature (437)..(437): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagagccaggccaggcccctgtcttggtgtatttataaagactttgagaggccctcgacgggacccctgagcgacttctcgtggcctccagtcctcgagggacaactagtcaccttgaccatcagtggacgtccgtacgaggaggacgaggactagacttattactgctacgtccgcacgtacngacaggtcggactagttatgtacggttagtcgggacggacgggaccttacggccgtacggtaccgttccgtacggtaccgacggtacccgaaggtcccgtaccggtcccccgtacgggtaccc

SEQ ID NO: 75289 - DNA, 665 bp, Homo sapiens
  misc_feature: GYAE6OF02IKE7O.49.20.B09.1.454.CMB.1.raw
  modified_base (298)..(298): a, c, t, g, unknown or other
  misc_feature (298)..(298): n is a, c, g, or t
tcagagtcgagagacacgaccggtgctcgatttagtgtagtgtgaaggggcgtgtgggtccaggaggcagaactctgggtgtctcaccatggcctggatcctctacttctcccctcctcactctctgcacaggctctgaggcctcctatgagctgacacagtcaccctcggtgtcctgtgtcctcaggacagacggccaggatcacctgctctggcgatcgcattgaccaaaaacatatgcttactggtaccagcagaggccaggccacggcccctgtccgtttggtagtattttaanaaacggtcttttagacgtacggtcccctagaaccggggtacccctggacgtcgtaattcctcgtggccttaccgagtcctacgacgggaacaactacgttccaaccgtttcgaaccctatccgaacggttcggacggttcccgggaccgtaagggaccgggaacggacgggccttacggaacttacgttaacgtggttaccgacggtcccgtaccaggaacacggcgtacggtaggactagtttagtggttacgttacgttcgggacgggtagggtaacgtccggtacgttacggacccggttccgtaacgggttccgacggtaccccggaaggtcccgttaccggtccccccggtaggttaccccg

SEQ ID NO: 75290 - DNA, 657 bp, Homo sapiens
  misc_feature: GYAE6OF02G5ZC9.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacaggacggccaggatcacctgctcgtggcgatgctattcgaccaaaaacaatatgtcttacgtggtaccagcaggacggccgacggcccacgggcccccttgttccgttgggtagtaattttaagtaaaacggtacgtttggaacggtacggtccctacgaccggggtacccctggaacgcgtattccgtacgtcggcctcgagtcctacgacgggaacaacgtacgtctaccgttcgaccgtagtacgaggtacggacggtcccggacgaacggacggaacggacggtacgtacgaacgttacgttacgtcgtcgtaacgtccgatacgacaggtcgaggtcggactaggttacgtcgttacgttacgttcgggacgggtacggtaccgtacgggtcttacggtaccgtccggttacggtaccgaccggtacccggacggcccgtacccggtccccgttacgtcccg

SEQ ID NO: 75291 - DNA, 684 bp, Homo sapiens
  misc_feature: GYAE6OF02HAF7A.49.20.B09.1.454.CMB.1.raw
  modified_base (174)..(174): a, c, t, g, unknown or other
  misc_feature (174)..(174): n is a, c, g, or t
  modified_base (185)..(185): a, c, t, g, unknown or other
  misc_feature (185)..(185): n is a, c, g, or t
  modified_base (242)..(242): a, c, t, g, unknown or other
  misc_feature (242)..(242): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtntctgtgtcctnaggacagacggccaggactccacctgctcgtggcgatgactattcgaacccaaaaanaatatgtactttacgtggtaccagcgaagacggccacggccacggcccctgtcttggtgtatttaagtaaagtcgtttggacgacggccctacgaccggccctaggacgcgtacttctcgtacgcctcacgctacgacggaacaacgagtcctacttacgacctagtacgacggtggtacggtccggacaaggacggacggacggtcgtagtacttaacgtttaacgtcgttaccgacggtccgaacgtaacggacgaacggacgtagggtacggtacgttacggttttagttacggttcggttaacggttaccggggaccggggtaacgggtaccgttaacgggtcccggttaccggtaacccggttccggttaaccgggtaccctaacgggaccccgtaagggtccccgttaccccggtcccccggttaccgggttaccc

SEQ ID NO: 75292 - DNA, 520 bp, Homo sapiens
  misc_feature: GYAE6OF02H7MNL.49.20.B09.1.454.CMB.1.raw
  modified_base (336)..(336): a, c, t, g, unknown or other
  misc_feature (336)..(336): n is a, c, g, or t
tcagagtcgagagacacgaccggtgctcgatttagtgtagtgtgaagggggctgtgggtccaggaggcagaactctggggtgtctcaccatggcctggatccctctacttctccccctcctcactctctgcacaggctctgaggcctcctatgagctgacacagtcaccctcggtgtctgtgtcctcaggacagacggcaggatcacctgctctggcgatgcattgaccaaaaacaatatgcttactggtaccagcagaggccaggccaggcccctgtcttggtgattttaataaaagacttttgagaggcccttcagggacccctgagcgattcnctggctccagctcgagggacaacagtcaccttgaccatcagtggagtccggcagaggacgaggctgactagttactgtcacgtcgcaagacagcagtggctagttatgtgtagttcggcggagggactacggctacgaccgtccgtaggtcacggacccaaggcctcgtcccccgtggtacccg

SEQ ID NO: 75293 - DNA, 652 bp, Homo sapiens
  misc_feature: GYAE6OF02GC6OG.49.20.B09.1.454.CMB.1.raw
tcagagtcgagagacacgaccggtgctcgatttagtgtagtgtgaagggggctatgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcactgctctggcatgcattcgaccaaaacatatgacttacgtggtaccagcaagacggccgaggccgacggcccctgtcgttggtagtaatttaagtaaagtacgtttaggaggtaaccggcccctacgaacgggacccctggacgcgtattcctcgtcgtcctccgacgcctacgaacgggaaccaaacgtacgtaccctaccttcgaaccctagtaccgtaaggtacgggacgtcccgggaccgaagggacggacgacgggctaggaacttacgttacgtgttacacggtccgacgaacgacgacgacgtaggtcggtacgtaagttagttcggttacgttaggttccgggacgggtacgggtacgttacggcgtacggtacccgttccgtaggttacccgacggtacccggtaacggtccctacccggtcccccgtcggtacccg

SEQ ID NO: 75294 - DNA, 641 bp, Homo sapiens
  misc_feature: GYAE6OF02IU13I.49.20.B09.1.454.CMB.1.raw
  modified_base (186)..(186): a, c, t, g, unknown or other
  misc_feature (186)..(186): n is a, c, g, or t
  modified_base (203)..(203): a, c, t, g, unknown or other
  misc_feature (203)..(203): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggntccacctgctctggacgatggccattgacccaaaaacattatgtcttactggtaaccagacaggaggccaacggccacggcccctgtcttggtgatttaagtaaagtcgtttagacgaggtccctagacggaccctgagcgtacttctctggctcagcctcgacgggacaacgagtcaccgttgaccctataccgaggtacggtacgtcccggaccgagacgggaacgtacgggcctagaacttaagttaccgttacgtaccgaacgttcccgacaaggaaccgagtacgtaacggtcggacgtaacggttacgttacggtacgttaacgttaccgggacgggtagggtaaccgtaaccggtcgtaccggtacccgttaccggtaacggttccgaacgtacccggtaaggtcccggtaccgtcccccgttcgtacccg

SEQ ID NO: 75295 - DNA, 711 bp, Homo sapiens
  misc_feature: GYAE6OF02I79VS.49.20.B09.1.454.CMB.1.raw
  modified_base (185)..(185): a, c, t, g, unknown or other
  misc_feature (185)..(185): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggactcacctgacctcgtggcgtatcgctattcgaccaaaaacgaatatgctttactaggtaaccagcaagacggtccaggccacggccccttgttccgtttggtacgtacttttaaagtaaacgtacgttttcggaagtacgggtcccccttacggaaccggggtaacccccttggaacggtaccggtaaacttttccgtcgttcgggaacccttccgaacgtccgttacggaacggggtaaacaaaccgtacggtactacccgtttagaccctatcgagtacgggtacgttccggacagggtaacggacggtacggtacctaggtaaccttaacgttaacgttcggtaccgtacggtaccgtaccgaacgtaacgacggacgtacgggtacggagttacgtttaagtcggttacgtacggttcggacgggtacggtacgtcgtaccgtacgtaaccgttacgtacggaccgacgacccgaaggtccgtcccggtccccgttaggtacccg

SEQ ID NO: 75296 - DNA, 616 bp, Homo sapiens
  misc_feature: GYAE6OF02J3EV7.49.20.B09.1.454.CMB.1.raw
  modified_base (240)..(240): a, c, t, g, unknown or other
  misc_feature (240)..(240): n is a, c, g, or t
  modified_base (285)..(285): a, c, t, g, unknown or other
  misc_feature (285)..(285): n is a, c, g, or t
  modified_base (425)..(425): a, c, t, g, unknown or other
  misc_feature (425)..(425): n is a, c, g, or t
  modified_base (600)..(600): a, c, t, g, unknown or other
  misc_feature (600)..(600): n is a, c, g, or t
tcagagtcgagagacacgaccggtgctcgatttagtgtagtgtgaaggggctgtgggtccaggaggcagaactctgggtgtctcaccatggcctggatccctctacttctcccctcctcactctctgcacaggctctgacggcctcctatgagctgacacagtcaccctcggtgtctgtcgtcctcaggtaccagaccggcctaggactccactgctcgtggcatgcattgcccaaacgntatgcttatgaccagcagaacgccggcacggccctgtgttcggtntatgtaataagactaacgtgacgacggtccctagacgggtactcccgtgacgtcgactttccgtcgtacggtccgtaccgacggtcgaacgggacaaccggtcagtacgttacggcctacgtcgaggtggacgtcgacgngtaacgagggaccggaagtcgttacgtaacgtttattcgtacggttacaacgttccgaaaactaccggaactaccgtaactttacgggtacttacgttccgttacgtacggtacgacgtacgaaccgttacgtaccgtaccgtgtacggtccacgtacccgaagccccgaacccngtacggtcctaacccg

SEQ ID NO: 75297 - DNA, 588 bp, Homo sapiens
  misc_feature: GYAE6OF02IEG6J.49.20.B09.1.454.CMB.1.raw
  modified_base (234)..(234): a, c, t, g, unknown or other
  misc_feature (234)..(234): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggcaggatcacctgctctggcgatgcattgaccaaaaanatatgcttactggtaccagcagacgccaggccacggcccctgttcttggtgtaattttaagtaaaagtacttttgaagcggtccctcgaacgggtacccctgaacgtcgattctcgtcggctccagcctacgacgggaacaacgacgtactaccgttgacctatcgaggtcggacggtccggacgaggaggaacgaggtctagaacttacgttactcgtcgacgtccgacagacacgcgaggtcgactagttagtgttacgtacgttcgggcggacggtaccgtacggcgtacgtacccgtacgttacgtacgaccgtaccggaacggtccgtaccgtcccccgtggttacccg

SEQ ID NO: 75298 - DNA, 538 bp, Homo sapiens
  misc_feature: GYAE6OF02IJ7YA.49.20.B09.1.454.CMB.1.raw
  modified_base (185)..(185): a, c, t, g, unknown or other
  misc_feature (185)..(185): n is a, c, g, or t
  modified_base (288)..(288): a, c, t, g, unknown or other
  misc_feature (288)..(288): n is a, c, g, or t
  modified_base (358)..(358): a, c, t, g, unknown or other
  misc_feature (358)..(358): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctnaggacagacggcaggactcacctgctctggcatgcattgaccaaaaacatatgcttactggtaccagcaagagccaggccaggcccctgtctggtgtatttanaaagtctttgagacggcctcgacgggacccctgacgcgtattctctcggcttccagctcgaggacaacgngtacacgttgaccatcagtggacgtccgacaggagacgacggctagaactacttatcgtcacgtccgcgaacgacgagacagtcggctagttactgtcgttacgttcggacggacgggtactacgctacgaccgttcgtaggtaccacgccgaaggtcctaccggtccccgtggtacccg

SEQ ID NO: 75299 - DNA, 526 bp, Homo sapiens
  misc_feature: GYAE6OF02FVL1D.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgccaaaaacatatgcttactggtaccagcagaggccaggccaggccccctgtcttgggtgtatttataaagactttgagaggccctcacgggacccctgagcgattctctggcctccagctcgagggaccaaacagtcaaccttgaccatcagtaggcgtccggcagacggacgaggctagacttattactgtcagtccgcagacagcagtgctagttatgtcgttagtcggcggtaggactacggcgtggtaccgtccgtaggtacacgacccgaaggccgtccgtcccccgtggtacccg

SEQ ID NO: 75300 - DNA, 599 bp, Homo sapiens
  misc_feature: GYAE6OF02I5VYA.49.20.B09.1.454.CMB.1.raw
  modified_base (186)..(186): a, c, t, g, unknown or other
  misc_feature (186)..(186): n is a, c, g, or t
  modified_base (481)..(481): a, c, t, g, unknown or other
  misc_feature (481)..(481): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggatcacctgctcgtggcatgcattcgaccaaaaacatatgtacttacgtggtaccagcagacggccgaggccacggcccctgtcgttggtgtatttaagtaaacgtactttaggacggacggtccctacgacgggtacccctggacgcgtacttcctcgtcggccttaccgagtcctacggaacgggaacaacgtcgtacctaccgttgaccctatcgaggtggacgtccggaccgaggacggacgacggtctagacttattacgtcgcgtacgtccganacggacagcgtaggtcgcgtagttatggttacgtagttcgggacggtaggacgtcggtcgtacggtacccggtcgtacggtccgacggaccgtaacggcctcccggcccgttcgtccg

SEQ ID NO: 75301 - DNA, 680 bp, Homo sapiens
  misc_feature: GYAE6OF02JKX7V.49.20.B09.1.454.CMB.1.raw
  modified_base (289)..(289): a, c, t, g, unknown or other
  misc_feature (289)..(289): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacaggacggccaggactcacctgctctggcgatcgcattcgaccaaaacatatgtcttactggtaccagcagacggccaggccacgccctgtcttggtnatttataagtactttgagacggccctacgacgggaccctgacgcgtattcgcttcggcctccgacgtcctacggtacgggaacaacgtacgtacctaccttacgacctatccgaagtcggacgtccgggaccgaaggtacggaccggtaggtaccgtaggtaacttagttaccgttaaggtcctaacgggttccgacgtaacggaccgtagaccggtaggtaccggtacttaacggtttaacgtcgggttacggttaacgttccggggtacgggtacggggttaacctccgggtaccggttaccggtacccggttcccggttaagggtacccgtaaccggtaccccggaacggtacccggttccccggtacccccggttacgggttacccg

SEQ ID NO: 75302 - DNA, 583 bp, Homo sapiens
  misc_feature: GYAE6OF02IZSJV.49.20.B09.1.454.CMB.1.raw
  modified_base (245)..(245): a, c, t, g, unknown or other
  misc_feature (245)..(245): n is a, c, g, or t
  modified_base (286)..(286): a, c, t, g, unknown or other
  misc_feature (286)..(286): n is a, c, g, or t
  modified_base (358)..(358): a, c, t, g, unknown or other
  misc_feature (358)..(358): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcgaggacagacggccaggatcacctgctctggcgatgcattgaccaaaacatatgcttanggtaccagcagagccaggccaggccctgtctggtgatttanaaagtctttgagacggcctgacgggacccctggacgcgattcgtctaggcctccagtcctcgagggaacaanacgtacaccgttgacctatcagtcggagtccgacagaggacgtacgctacgactattacgtgtacacgtaccgacacgacgaggacagtacgacgtaagttagtcggtacgtacggttcggacgggtagggtaccgtacggtaccgtccggtaacccggtccgtaacggttaccgaacggtacccggtaacggtaccgtcccggtaccccgttaggttccccggg

SEQ ID NO: 75303 - DNA, 510 bp, Homo sapiens
  misc_feature: GYAE6OF02FO841.49.20.B09.1.454.CMB.1.raw
  modified_base (438)..(438): a, c, t, g, unknown or other
  misc_feature (438)..(438): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgatttataaagctttgagaggccctcgagggacccctgagcgattctctggctccagctcgagggacaacacgtcaccttgacctatcgagtggacgtccggcaggaggacgaggctgactattactgtcagtccgcagacagcagtgcagttangtcgtagttcgggcggaggactacggctcggacccgtcgtaggtcacgcccgaaggcctcggcccctggtcc

SEQ ID NO: 75304 - DNA, 566 bp, Homo sapiens
  misc_feature: GYAE6OF02GRS0T.49.20.B09.1.454.CMB.1.raw
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
  modified_base (392)..(392): a, c, t, g, unknown or other
  misc_feature (392)..(392): n is a, c, g, or t
  modified_base (437)..(437): a, c, t, g, unknown or other
  misc_feature (437)..(437): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaaacatatgcttactggtaccagcagaggccaggccaggcccctgtcttggtcgatttataaagctttagagaggccctgacgggacccctgacgcgattctctggctcgngctcgaggacaacngtcaccttgaccatcgagtggacgtccgcagngacgngctgactattactgtcacgttccgacagacgagcgtaggtacggntaacggttaatcggttacggtaagtttccggggacggtagggtacctacggtccgtacggtacccggttccgtaagggtaccgacgtccccggaaacgggtctacccggtcccccgttcgggttacccc

SEQ ID NO: 75305 - DNA, 596 bp, Homo sapiens
  misc_feature: GYAE6OF02H4TLW.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggccaggatcacctgctctggcatgcattgaccaaaacatatgcttactggtaccagcagacggccaggccacggcccctgtcttggtagtatttaataaagtactttgagacggccctcgacgggacccctgacgcgtattctcgtcggctcgagctacgagggaacaacgtagtacctacccttcgaacctagtacgtaggtgggacggtcccggtacgaacggtacggaacggaggcgtaggaacttaacttacgtcgttacgacggttccgacgacgacaggactagtggctagttatggtacgtagttcgggaggtacgggaccgtacggcgtaccggtaccggtccgttacggtacgacgacccggaggtcccgtcggtccccccgttggtacccc

SEQ ID NO: 75306 - DNA, 607 bp, Homo sapiens
  misc_feature: GYAE6OF02H84RU.49.20.B09.1.454.CMB.1.raw
  modified_base (206)..(206): a, c, t, g, unknown or other
  misc_feature (206)..(206): n is a, c, g, or t
  modified_base (237)..(237): a, c, t, g, unknown or other
  misc_feature (237)..(237): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtccaccctggtgtctgtgtcctcgaggacaggacggccaggntcacctgctctggcatgctattgaccaaaanatatgcttacgtggtaccagacagaggccaggccaggcccctgtcttggtagtattttaagtaaagcttttagagacggccctcgacgggacccctgacgcgtattctcgtggctcgagctacgacgggaacacgactcacctacgactatacgaggtaggacgtccggacgaggacggacgaggcgtgtacgtacttacgtgtacagtccgcaacgacgacgacgtagtacgggactagtttacgtagtacggttaggttaccgggacgggtacgggtaccgtacggtcgtaccggtaccgttacccggttaacggtaccgacggaccccggtaagggtcccgtccggtaccccccgttcggtaccccg

SEQ ID NO: 75307 - DNA, 763 bp, Homo sapiens
  misc_feature: GYAE6OF02IBOX5.49.20.B09.1.454.CMB.1.raw
  modified_base (239)..(239): a, c, t, g, unknown or other
  misc_feature (239)..(239): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctggaggcctcctatgagctgacacagtccaccctcggtgtctgtcgtcctcaggacagacgcaggatcacctgctctggcgatgctattcgaaccaaaaanatatgtcttaactggtaaccagcaagacggccaggccacggcccctgtcttggtagtacttttaagaaaagtctttggaacgacggtccctacgacgggacccctggacgtcgtacttcgtacgtcgggccttaccgagtcccgtaaggaacgggaaaccaaacgtacgtacctaacccgtttacggaacccttaacgtccgtaaggtacgggtaaccggttacccggggaccgaaacggggaacgggtaaccgggaacgggtaccgttacggtaaaccgtttaaaccgttttaaccgttacggttaaccgtaaccgggttacccggaccgaaacggaaccgaacggtaacggtaacggttacggggtaaccgtaaggttttaacgttcggttaacgttaacggttaccggggacgggtacgggtaaccgtaccggtccgtacggtacccggtccgttaacggtcccgtaaccggacccggtaaacgggtcccgtcccggtacccccccgttgggttaaccccg

SEQ ID NO: 75308 - DNA, 537 bp, Homo sapiens
  misc_feature: GYAE6OF02FVPI0.49.20.B09.1.454.CMB.1.raw
  modified_base (356)..(356): a, c, t, g, unknown or other
  misc_feature (356)..(356): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccaggcccctgtcttggtgtatttataaagtctttgagacggccctgacgggacccctgagcgattcgtctggctccagctcgaggacaacngtcaccttgacccatcagtggacgtccggacaggaggacgaggctgacttattacgtgtcagtccgcacgacagcgagtggactagttatcgtcgttagttcgggacggtagggactacggcgtacggtacccggtccgtaggtccacgcccgaaggtcctccggcccccgttgggtaccc

SEQ ID NO: 75309 - DNA, 617 bp, Homo sapiens
  misc_feature: GYAE6OF02F6FYS.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgctattgaccaaaaacatatgcttactggtaccagcagaggcaggccaggcccctgtcttggtgtatttataaagtactttgaggtacggccctgacgggacccctgacgcgtattctctggcctccagtctcgaacggggaaccaaacgtagtaccaacctttcgaacctacgtacaggtacgggacggtcccgggaccgaaggacggaacggacgggacctagaacttattaacgtacgttaccgacgtccgacgtaacgacgagaccgtaggtcggacgtagtttaagtcgttacgtagttcgggacgggagggtaccgtacggtcgtacggtaccgtaccgtacggtccgacggacccggtaacggtccgtccggtcccccgtacggtacccg

SEQ ID NO: 75310 - DNA, 587 bp, Homo sapiens
  misc_feature: GYAE6OF02IJ64T.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccagtatcacctgctctggagatgcattgaccaaagcaatatgcttactggtaccagacagaagccgaggccacggcccctgtcttgatctattataaagtatttgagacggcctcgacggacccctgagcgtattctctcggctcgagctacgacgaccgaacaaaccgtacgtaccgtacggttacgaaccctatccgaaggtacgggacggtccgggacgagggaaggacggaggtactacgtaactacgtttactgtcgtagtacactacgagactaaggtagtcgacgtacgtttcgtagttacgtagttcgggcgggaacgggtaccgaagtccgtacgacccggttcgtacggtaccgacggtacccgacggtcctaccccgg

SEQ ID NO: 75311 - DNA, 700 bp, Homo sapiens
  misc_feature: GYAE6OF02F48VD.49.20.B09.1.454.CMB.1.raw
  modified_base (296)..(296): a, c, t, g, unknown or other
  misc_feature (296)..(296): n is a, c, g, or t
tcagagtcgagagacacgaccggtgctcgatttagtgtagtgtgaaggggtctgtgggtccaggaggcagaactctgggtgtctcaccatggcctggatccctctacttctccccctcctcactctctgcacaggctctgaggcctcctatgagctgacacagtccaccctcggtgtctgtgtccctcagggacagacggcccaggtactccaccctgcctctggcgatgcattgacccaaaccatatgtccttactggtaccagcacgacggcccagggcccacgggtccccctntcctttggtgtatttaacgttaaagacttacgtacggaacgggtcccgtccgtaacgggacccccgttaccggacggtaccgacgtttacctccgttcggtccgtccctacggaccgtccgaacgggaaccgaaaccaacgttccgacccttaccgtacccgactcgtacgtcgggtacggtcccggtcccgaacgacgggaccggtacgggttgtacgtacttacgttacgtccgtaacgtaccgtcgacgtacgacgtacgacgtcggtacgtaacggttagttacgttcgtaacgttcggggtccgggaacgggtaccgtacggcgtaaccgtacccggtccgttaacggtccgacgacccgtaaccggtccgtacccgtcccccggttcgtccgtacccg

SEQ ID NO: 75312 - DNA, 574 bp, Homo sapiens
  misc_feature: GYAE6OF02FZVPT.49.20.B09.1.454.CMB.1.raw
  modified_base (469)..(469): a, c, t, g, unknown or other
  misc_feature (469)..(469): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacgccaggatcacctgctctggcatgcattgaccaaaaacatatgcttactggtaccagcagaggccaggccacggcccctgtcgttggtagtatttataaagtactttagaggtacggccctcgacgggtacccctgacggcgtagttcctcgtcggtcctccagtctacgaggacaacacgtctaccgttagacccatcgagtcggacgtccggacaggtaggacgaggcgtgacttagttaactgtacacgtccgacacgactagctagtcgngtagttagtcgtacgttagtcgggacggtaggtacctcggcgtcggtacccgttcgtacggtacgacgtaccggtaacggccgtcccggtccccgtggttacccg

SEQ ID NO: 75313 - DNA, 711 bp, Homo sapiens
  misc_feature: GYAE6OF02F5T88.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtgtcctcgaggacagacggccaggatcacctgcctcgtggacgatgcattgaccaaaaactatatgcttacgtcggtaccagcgaagacggccacggccacggcccctgtcgttggtagtatttaataaagtactttaggagtacggccctacgacgggacccctgacgcgtacttctcgtggcctaccgacgtcctacggaacgggtaaccaaacgtacgtaccctaacccgtttacggaaccctacgtacgtacggttacgggtaccggtacccgggtaccggaacgggaacgggtaacggacgggtaccgtacggtaacgttaacgtttaacgttacgttacgtaccggtacccgaccgttttttaacgaaccgtaacggtacgtacggtacggtacgtaggttaacgttacggttacggttacgttaccgggtacgggtacgggtaaccgtaccggtcgtaccggtacccggtaccgttacggtaccgtacgacccgaacggtaccgtccgtaccccgtccggtacccg

SEQ ID NO: 75314 - DNA, 575 bp, Homo sapiens
  misc_feature: GYAE6OF02F7X22.49.20.B09.1.454.CMB.1.raw
  modified_base (354)..(354): a, c, t, g, unknown or other
  misc_feature (354)..(354): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgatttataaagctttgagaggccctcgacgggacccctgagcgattctctggctccagctcgaggacaacgngtccaccttgaaccatcagtcggacggtccggcaggaggacgacggctagtacttattattcgtacaatacaacgacgactacctagtttaggtactttagtcgttacgttacggaactcgaccgtaccgacggtccgtacccggttccgtacggtccgaaccggtaccccgaacgggacccctaaccccgtcgttacgtacctaccgttccgttaccccg

SEQ ID NO: 75315 - DNA, 574 bp, Homo sapiens
  misc_feature: GYAE6OF02GY0LL.49.20.B09.1.454.CMB.1.raw
  modified_base (233)..(233): a, c, t, g, unknown or other
  misc_feature (233)..(233): n is a, c, g, or t
  modified_base (531)..(531): a, c, t, g, unknown or other
  misc_feature (531)..(531): n is a, c, g, or t
tcagagtcgagagacacgaccggtgctcgatttagtgtagtgtgaaggggcgtgtgggtccaggaggcagaactctgggtgtctcaccatggcctggatccctctacttctcccctcctcactctctgcacaggctctgaggcctcctatgagctgacacagtcaccctcggtgtctgtcgtcctcaggacagacggccaggatcactgctctggcgatgcattgaccaaaanatatgcttactggtaccagcagacggccaggcccacggcccctgtcgttggtgtactttaataaagtctttagagtacggcccttagacgggtacccctggacgcgtagttcctcgtaggcctccgaagtctcgaacggacaacgcgtcacgttcgacagtcagtcgacgtccggcaggagacgacgcgtacgacttagttacctgttacgaacgtccgacacgacgtagcacggtcggctagttagtcgtcgtaagttccgggaggtaggtacgtacgtcgtacgtcccgttaccgnggttaccgacgaccgaaccggcgtacccgtcccgtacggtacc

SEQ ID NO: 75316 - DNA, 549 bp, Homo sapiens
  misc_feature: GYAE6OF02FF6FV.49.20.B09.1.454.CMB.1.raw
  modified_base (290)..(290): a, c, t, g, unknown or other
  misc_feature (290)..(290): n is a, c, g, or t
  modified_base (367)..(367): a, c, t, g, unknown or other
  misc_feature (367)..(367): n is a, c, g, or t
  modified_base (438)..(438): a, c, t, g, unknown or other
  misc_feature (438)..(438): n is a, c, g, or t
  modified_base (454)..(454): a, c, t, g, unknown or other
  misc_feature (454)..(454): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacatatgccttactggtaccagcagaggccagggccacggcccctgtccgttggtnatttaataaaagtacttttgagtaggccctcacggggacccctgacgcgattctctggctccagctcagggacaacngtcaccttgaccatcagtggagtccgcgagacggacgaggctagacttattactgtcacgtccgcagacancgagtggcagttacgngttcgtattcgggagggacgtactccggacgtacggacccgtaccgtacggtaccacggcccgtaacggtccgtacccggccccgttcggtaccc

SEQ ID NO: 75317 - DNA, 515 bp, Homo sapiens
  misc_feature: GYAE6OF02GOB1K.49.20.B09.1.454.CMB.1.raw
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (458)..(458): a, c, t, g, unknown or other
  misc_feature (458)..(458): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccaggcccctgtcttggtgatttanaaagtactttgagacggccctcgacgggacccctgagcgtattctctggctcagctcgaggacaacngtcaccttgaccatcgagtggacgtccggcaggacggacgaggctaggacttattactgtcagtccgntagacngcagtcgcagttatgtcgtagtcggnggaggactacggctggaccgtcctaggtcacggccgaaggcctcggccccgtggtcc

SEQ ID NO: 75318 - DNA, 575 bp, Homo sapiens
  misc_feature: GYAE6OF02G63TG.49.20.B09.1.454.CMB.1.raw
  modified_base (360)..(360): a, c, t, g, unknown or other
  misc_feature (360)..(360): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (448)..(448): a, c, t, g, unknown or other
  misc_feature (448)..(448): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaaccagcagaggccaggccacggcccctgtcttggtgatttataaagtctttgagacggccctagacgggacccctgacgcgattctactggcctcagctcgagggacaacngtcaccttgaccatcagtggacgtccggcaggaggacgaggctagacttattactgtacngtccgnagacagacaggtgactaagttntcggttacgtaacggttcgggacggtacgggtactaccggtcgttacggtaaccccggttccgttaacggtccgaaccggtacccggtaaggtcccggtacccggtaccccccgttacgggtacccc

SEQ ID NO: 75319 - DNA, 909 bp, Homo sapiens
  misc_feature: GYAE6OF02JBO6E.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctctcactctctgcacaggctctgaggcctcctatgagctgacacagtcaccctcggtgtctgtgtcctgaggacagacggccaggactcacctgctctaggcatgccattcgaccaaaacatatcgtcttactaggtacccagacagacggccgtacggccacggtccccctgttaccgttggtacgtattttaacgtaaagtaccgttttaggaacggtacggcccccgttacgaaaccggggtaccccctggacggtccgttaactttccgttccgtcgggtcccttaccgaacgtccgttacggaacggggaaacctaaaccggtaacgtttacccctaaacccgtttacggaaccccgtaagtttaccgaacgggtttccgggtaaaccggtttcccccggggaacccgaacggggaaccgggtaaccggggaacgggtccgttaacggtaacgttaaaccgttttaccgtacgggttaccgaaccggtttacccgaccgtaaagggtaacccgtagggtaacccgtacggggttacgggtaacccgtttaagggttttaaccgttacgggtttaacccgggtttaacggtttccccgggggggaaacgggggtaacccggggtttaaccggtaaaccccggggtttccggttaaccccggggttaaaccccgggttttacccgggttaaacggttaaccccggtaaccccgggttaacccccggtaaaccgggttcccccggttttacccccgggttaccccccccgggtttacgggtttaacccccc

SEQ ID NO: 75320 - DNA, 806 bp, Homo sapiens
  misc_feature: GYAE6OF02HWYUU.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcgaggacagacggccaggatccacctgctctggcgatgcattgaaccaaaaacaatatgctttactggttaaccagcaaggaggccgaaggccaacggccccttgttcgttggtgtaacttttaagtaaagacgttttgaggacggtcccctcgaacggggacccccttgaaggcgactttactcgtcggctccagactcgaggggaacaaacgtagtacctacccgttagaacctatcaacggttcgggaacggtcccgggtcccgaaaaaacgggtcggaaaccgggtaacgggccgttaggtaaacctttaacgtttaaaccgtttacggttaccgaaccgggtttaccccggaccgaaacgggaaccttaacgggaaccgtacgggtttaacgggaccggtaacggttttttaacggttacgggtttaccgggttaaccggttttacgggggaccgggggtaacgggggtaacccgtttaaccggggcccgtttaaccgggttaaccccgggttaaccccggtttaacggggtaccctaacccgggtacccccggaaacggggttacccccgtaccccgggtttccccccccgttacccggggttttaaccccccgg

SEQ ID NO: 75321 - DNA, 713 bp, Homo sapiens
  misc_feature: GYAE6OF02IWO9Z.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcatcgctattcgaccaaaaacatatgtcttactggtaccagacgagacgccgaggccacggtcccctgttcttggtagtatttaataagtacgtttaggacgtacggccctacgacggtaccctgacgtcgtacttccgtcgtcggcctaccgagtccgtacgaacgggactaaacgtacgtaccgtaccgttacgaaccctatacggacggtacgggtaccggtccccggtacgagggaacgggacggacggtaccgttacggtaaccttaacgtttaccgtcggttaccgtaacggttccccgtaccgaacggtaaccgacggtacccggtagggtacgggtacgttaaggttacgtaccgggtttacggttaacggtaccggggtacgggtacgggaaccggttccggtaccgttaccggtacccggttaccgtacgggtaccgacccgggtacccgaacgggtcccgtcccggtacccccgttcgggtaccc

SEQ ID NO: 75322 - DNA, 853 bp, Homo sapiens
  misc_feature: GYAE6OF02ISYPJ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccccgtggtgtctgtcgtcctgaggacacggaccggccaggactccacgtgtctccgtggcgtatgactagtaccgaaaccaaaatagtagtcgtaccttacgtacgaaccgacgtacgaacggaccggaccgaccggcccgtacccggtcccgttacggttcggtttggttaacgttttaaattttaaaacgtaaacgtttacggtttaacggaaccggtaccccggttacccgtaacccggggaacccggttaccccgtagggaccggttaccgttaccgttttccgtcggtcccgtacccgttacccgacggtacccgtaacggggaacggaaccgaaaccgttaccgttacccgttaaccgttccggaacctacgtaggtacgggtaccgggtacccggtacccggacggtaacgggacgggtaacggtacggtaccgttaaggttaacttacgtttacgtccgtaacgtaccgtaccgaccgaagtaccggtacgtacggtacgggtacgttacgttacgtttaggttaccggtttacgtaccggggttacccggggaagggtaccggtaaccgtacccggtcgggttacccggtacccgttaaccgggtccgtaaacccggacccgtaaccggtacccggtttccccggtacccccggttccccgggttacctaaccccg

SEQ ID NO: 75323 - DNA, 659 bp, Homo sapiens
  misc_feature: GYAE6OF02I7S8M.49.20.B09.1.454.CMB.1.raw
  modified_base (239)..(239): a, c, t, g, unknown or other
  misc_feature (239)..(239): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtcagtgtccccaggacagacggccaggactcacctgctctggagatgcattgacccaaaaccgntatgcttattggtaccagcagaacgccgggcacggcccctgtgttggtgatgtataagacactgagacggccctacgagggactccctgagcgtattctcgtggcctccgaggtcgacgggactaacggtcaacgtacgttcggacctatcgagtcggacgtaccgaggcgaaggacggaacgggaggaccgtaggtaaccttaagtttagtttacgtactaaactaccgtaaacgaacgaacctaaccgtaagttttacggtaacttttacgtacgtttaccgtttaccggaaacttcggaaccgtaccgtaacgggttccctaacccgggttccgtcgggttaaccgaccggtaacccccgtaaccggaccccctaaacccccgtaccgttaccggttacccctaaccgtttccccgg

SEQ ID NO: 75324 - DNA, 601 bp, Homo sapiens
  misc_feature: GYAE6OF02JFME8.49.20.B09.1.454.CMB.1.raw
  modified_base (283)..(283): a, c, t, g, unknown or other
  misc_feature (283)..(283): n is a, c, g, or t
  modified_base (311)..(311): a, c, t, g, unknown or other
  misc_feature (311)..(311): n is a, c, g, or t
  modified_base (367)..(367): a, c, t, g, unknown or other
  misc_feature (367)..(367): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaacatatgcttactggtaccagcagacggccaggccacggcccctgtcttggngtatttataaagctttgagacggccctnacgggacccctgagcgattctctcggctcagctcgaggacacagtcaccttgaccntacagtgacgtcggaccaggacggacgaggtctacgaaccttattacttcggtacacggtcccgtacgaacggtacgaacggacgtacggtacggacgtaaggttttaacgtggttacggttaacgttccggggacgggtacgggtacctacggtaccgttcggaacccgttccggttaacggtaccgacggtaccccgaacggtccgtcccggtacccccgttcgggttaccc

SEQ ID NO: 75325 - DNA, 586 bp, Homo sapiens
  misc_feature: GYAE6OF02JWNGP.49.20.B09.1.454.CMB.1.raw
tcagagtcgagagacacgaccggtgctcgatttagtgtagtgtgaaggggctgtgggtccaggaggcagaactctgggtgtctcaccatggcctggatccctctacttctctccctcctcactctctgcacaggctctgaggcctcctatgagctgacacagtcaccctcggtgtctgtgtcctcaggacagacggccaggatcacctgctctggcgatgcattgaccaaaacatatgcttactgtaccagcagagcaggccacgccctgtctggtgtattataaagtcttagacgacgtccctcgacggaccctgacgtcgacttctcgtgctcgacgctcgaggacaacgacgtccaccttcgacagtcgaagtcggcgttaccgaccgtagacggacgacggcctagacttaagtacgttgtacgtacgtccacgagaccgtacgcgtagcgtacgtaagttcgtggacgttacgtcggacgggtaggtacccgtacggtaccgttacggtacccggttaccggtacggttccggaaccgtacccggaacggtcccgttaccccggtacccccggttcccggg

SEQ ID NO: 75326 - DNA, 769 bp, Homo sapiens
  misc_feature: GYAE6OF02J06B1.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctctcactctctgcacaggttctgaggcctcctatgagctgacacagcccaccctcggtgtcagtcgtccccaggacaggaccggccaggatccaccgttggtttggagtattacgttaacgaaaggatagtggtactagttcggtaccagaccaagaacgacgacggaccacgggccccttaggttccgttgggttaggtaactaagtaaacggactaaggtaggacgtacggtcccgtagacgggtactcccgtggacgtgtacttcgtcgtcggtccaccgagtcgtacgaacggggaactaacgtacgttaccgtacggttacgaacctagtaccggtaaggttacgggaccgttaccggaaggtaccggaaacggaacgggaaccggaagggtaccgttaacggttaaaccgtttaagttaaccgtttagtaacctaacgttccgaacggacgtaaccgggtaccgtaaccgggttacggttaacggtttaccgggttcgggtaccgggtttacgggaccgggtaaccggtaccgacggtaccgtacggtacccgttaccgtacggtaccgtaccggaccgttaccgcgtccccggtacccgtcggtcctaccgtcccgttcccgttacccctaccccgttcttacccg

SEQ ID NO: 75327 - DNA, 596 bp, Homo sapiens
  misc_feature: GYAE6OF02I0MHN.49.20.B09.1.454.CMB.1.raw
  modified_base (236)..(236): a, c, t, g, unknown or other
  misc_feature (236)..(236): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggactcacctgctctggcgatgcattcgaccaaaanatatcgacttactcggtaccagcagacggccacggccacggccccgtgtccgttggtgtatttaagtaaagtacgtttgagacggccctcgacgggaccctgacgctattctctgcctacgagcctacgacgggacaacgacgtacctaccttacgaccatcgaggtacgaggtacccgcgagacgggacgacggctagacttattcgtagtcgtacgtccgcgaagacgagacgaagtggacgttagttaacgtcggttacgtaggtccgggtacgggacggtacgtacggcgttaccggaccgttccgtaacggtaccacggaccgaaccggtccgtacccgtccccgtacggtcccg

SEQ ID NO: 75328 - DNA, 541 bp, Homo sapiens
  misc_feature: GYAE6OF02F22UX.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccacggcccctgtcttggtgatttataaagtactttgagacggccctcgacgggacccctgacgcgattctctggctccgagctcgagggacaacagtcaccttgaccatcagtggacgtccggcaggaggacgaggctgacttattacgtgtacacgtccgacgagacagcgagtgactagttatgtcgttagttcgggcgggtaggactacggcgtacgtaccggtccgtaggtccgacggacccgaacggccgtcccggccccgtcggtccc

SEQ ID NO: 75329 - DNA, 518 bp, Homo sapiens
  misc_feature: GYAE6OF02IJVSW.49.20.B09.1.454.CMB.1.raw
  modified_base (292)..(292): a, c, t, g, unknown or other
  misc_feature (292)..(292): n is a, c, g, or t
  modified_base (359)..(359): a, c, t, g, unknown or other
  misc_feature (359)..(359): n is a, c, g, or t
  modified_base (427)..(427): a, c, t, g, unknown or other
  misc_feature (427)..(427): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttaanaaagtactttgagaggccctcagggacccctgagcgtattctctggcttccagctacgaggacaacngtcaccttgaccatcagtggacgtccgcagaggacgagctgacttagttacgtgtcagtccgcagacngacagtgactagttatgtgtagtcggcggaggctacggctcggaccgttccgtaggtcacgacccgaaggcgtccgacccccgtgtacccg

SEQ ID NO: 75330 - DNA, 837 bp, Homo sapiens
  misc_feature: GYAE6OF02IW0R3.49.20.B09.1.454.CMB.1.raw
  modified_base (260)..(260): a, c, t, g, unknown or other
  misc_feature (260)..(260): n is a, c, g, or t
tcagagtcgagagacacgaccggtgctcgatttagtgtagtgtgaagggggctgtgggtccaggaggcagaactctgggtgtctcaccatggcctggatccctctacttcctcccccctcctcactctctgcacaggctctgaggccctcctatgagctgacacagtccacccgttggtgtctgttcgtcctagaggacaggaccggccgaaggactccgacctgccttcgtggccgtatgactattcgaacccaaaaanatactgtacttacgtacggtaaccagacgaggacggacccgacggacccgaccggtcccccgttggttccgtttgggtagttaacgtttttaaagtaaacgggttaccgttttaggaacgggtacccgggtaccccgttaccgggaacccggggtaacccccgttaggaaccggtaccgttaacgtttcctcggttcgggtcccttacccgacgtcgtaccggaaacgggaacctaaacgtacgttaccaaccgtttacggaacctacgtacgtacgggtcggtaccggtacccggaaccggtaagggaacgggtacgggtacggtaccgttacggtaactttaacgtttacgtcgttaccgtaccgggtaccgtacgaacggaaccgtaggtaccgaggggttccgtaacgttaagttttagtaccgggtttacggttacgggtaccggggtacggggacgggttaccttaacccgggcgggtttaaccggtaacccggttcccgttagggtccccgaacccgggtacccgtaaccggggtccctaccccggttcccccgggttaccggtaccccg

SEQ ID NO: 75331 - DNA, 531 bp, Homo sapiens
  misc_feature: GYAE6OF02I34AE.49.20.B09.1.454.CMB.1.raw
  modified_base (232)..(232): a, c, t, g, unknown or other
  misc_feature (232)..(232): n is a, c, g, or t
  modified_base (435)..(435): a, c, t, g, unknown or other
  misc_feature (435)..(435): n is a, c, g, or t
  modified_base (456)..(456): a, c, t, g, unknown or other
  misc_feature (456)..(456): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcatgcattgaccaaaanatatgcttactggtaccagcagaggccaggccacggccctgtctggtgatttataaagtctttgagacggccctcgacgggacccctggagtcgtattctcgtggctaccagtcctacgaagggacaacgtagtacctaccgttcgacctatcgagtggacgtccgacagaggacgagctagactattactgtcgacgtccgngacgacgagacagtgcagttntgtacgtagtcggaggaggacgtacgcgtcgtaccgtacgtacggcacggaccaggcctccggtccccgtgtacc

SEQ ID NO: 75332 - DNA, 736 bp, Homo sapiens
  misc_feature: GYAE6OF02HOTZ6.49.20.B09.1.454.CMB.1.raw
  modified_base (234)..(234): a, c, t, g, unknown or other
  misc_feature (234)..(234): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtgtctgtgtcctgaggacagacggcaggatcacctgctcgtggcatgcattcgaaccaaaaanatatgacttacgtggtaaccagcgagacggccaggccacggcccctgtcgttggtgtaatttaagtaaaagtcgtttgaagacggtccctacgacggaccctgacgtcgtattcgcgtcggcctaccgagccgtacgaacgggtaaccaacgacgttaccaacccgtttagaaccctagtaccgtagggttacggtaaccgggttccccgggaaccgaacgggtaacggggaaccgggtacgggtaccgtacggttaaaccgtttaacgttaaccggttacgtaccgtacgggttacccgacgaaacggaaccgtacggtacggtaagggttcgggacgttaaacggtttgttacggttaccggttacggttaccggggaacggggtacgggtacccgtaccggtccgtaccgggttaaccccgtccggttaacgggtaccgaacccggtacccgggtaaacggtccccggtaacccggttccccccggtacggttaacccc

SEQ ID NO: 75333 - DNA, 625 bp, Homo sapiens
  misc_feature: GYAE6OF02G0AO5.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacaatatgcttactggtaccagcagaggccaggccacggcccctgtccgttgggtagtattttaagtaaaagtacttttggaacggtacgggcccctacgaacggggacccctggacgcgtattctcgtggcctccacgctcgagggaaccaacgacgtacctaccgttacgaccatccgaggtaggacggtcccggacgaggacggacggaggctagacttattacgtcgtcacgtccgacgaacgacagctaggtacggactagttagtcggttacgttaacggttccgggacgggacgggtaccgtaccggtacgtacggtacccgttccgtaacggtccaccggtacccgtaacggtcccgtacccggtcccccgttacggtacccg

SEQ ID NO: 75334 - DNA, 596 bp, Homo sapiens
  misc_feature: GYAE6OF02HYUT0.49.20.B09.1.454.CMB.1.raw
  modified_base (175)..(175): a, c, t, g, unknown or other
  misc_feature (175)..(175): n is a, c, g, or t
  modified_base (216)..(216): a, c, t, g, unknown or other
  misc_feature (216)..(216): n is a, c, g, or t
  modified_base (236)..(236): a, c, t, g, unknown or other
  misc_feature (236)..(236): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtcaccctggtntctgtgtcctcgaggacagacggccaggactcacctgctcnggcatgcattgaccaaaaanatatgtcttactggtaccagcagacgccaggccaggcccctgtcttggtgtatttagaaagtctttgagcgccctgacgggaccctgacgcgtattctcgtggcctccgagtcctacgaggaacacgagtcaccttgactactcagtgacgtccggacgacggtaggacgacggctacgtacttaattacgttagtcgtacgtccgacacggacacgtacgaggtgaccgtagttagttcggttacgtcggttacgggcgggaggtaccgtaccggtcgtaccggtacccggttccgttaacggtaccgaccggtaacccggaacggtacccgtccggttccccccggtaggttaccccg

SEQ ID NO: 75335 - DNA, 577 bp, Homo sapiens
  misc_feature: GYAE6OF02GFC7E.49.20.B09.1.454.CMB.1.raw
  modified_base (239)..(239): a, c, t, g, unknown or other
  misc_feature (239)..(239): n is a, c, g, or t
  modified_base (422)..(422): a, c, t, g, unknown or other
  misc_feature (422)..(422): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcgatgcattgaccaaaaacatatntcttactggtaccagacagaggccaaggccaggcccctgtcttggtgatttataaagtactttgagacggccctagaacggcccctggacgcgtattctcgtggctcagctgacggacaacgagtcaccttgacctatcgagtggacgtccggacaggaggacgaggctagtacttattacgngttcacgtccgactagacgagaccaggtcgagtagttaacgtgttacgttacgtcgggacgggtacggaaccctaggtcgtacggtacccggttacgttacggtaccgaccgtcccggtaaacggtccgttacccgcccccggttacggtacccg

SEQ ID NO: 75336 - DNA, 538 bp, Homo sapiens
  misc_feature: GYAE6OF02FKN2A.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacaatatgcttactggtacagcagaggccaggccacggcccctgtcttggtgatttataaagtactttgagaggccctcgagggaccccctggagcgattctctggctccagctcgagggacaacagtcacttgaccatcagtggacgtccggccagaggacgaggctgacttattattgtctacgtccgcagacagacgagtggcgtagttagtgtcgttagttcgggcggtagggactacggcgtcgtaccgttccgtacggtccgacgcccgtaaggcctaccggtcccccgtacggtacccg

SEQ ID NO: 75337 - DNA, 640 bp, Homo sapiens
  misc_feature: GYAE6OF02GJ1NQ.49.20.B09.1.454.CMB.1.raw
  modified_base (286)..(286): a, c, t, g, unknown or other
  misc_feature (286)..(286): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatcgcattgaccaaaaacaatatgcttactggtaccagcagaggccaggccaggcccctgtcttggtntatttataaagtactttgagaggccctcgacgggcccctgagcgtattcctcgtggcctccagtcctcgagggacaacgacgtccaccgtttgaccctataccgaggtacggacggtcccggacctagggaacgggacggaacgggcctaggtaaccttagttaccgtcggttacacgttccgaccgtacggacacggcgtagggtcggccgtaaggtttacgtggttaccggttaaggttccgggacggggtaagggtacctaaccgggtccgttacggacccggttccgtacggtttcccgaacggtcccgtaagggtcccttacccggtaccccccggttgggttaccccg

SEQ ID NO: 75338 - DNA, 737 bp, Homo sapiens
  misc_feature: GYAE6OF02FLMC8.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattcgaccaaaaacaatatgacttacgtggtaccagcagacggccaggccacggccccctgtcgtttggtagtatttaataaagtactttggaagtacggccctacgacgggtacccctaggacgtacgtatttcctcgtggccttccgagtccgtacgaacgggaccaaacgtacgttacctaaccgttcgaaccctagtaccgtaaggtacgggaacggtccccggggaccgtaacgggaacgggaaccggtacggggtaccgtacgggtaaaccgtttaacgtttaccgtacggttacccgtaacggttcccgaccgtaaacggaacgacggacgtacgggtacggtacgttaaggtttacgttacggttacggttaacgggttccgggtacggggtacgggaccgttaaccgggtccgtaccgggttaccccgtaccgggttaaccggtaccgtaaccggtaccccggtaaacgggtcccgttacccggtacccccggttccggttaccccg

SEQ ID NO: 75339 - DNA, 582 bp, Homo sapiens
  misc_feature: GYAE6OF02F4CFI.49.20.B09.1.454.CMB.1.raw
  modified_base (357)..(357): a, c, t, g, unknown or other
  misc_feature (357)..(357): n is a, c, g, or t
  modified_base (489)..(489): a, c, t, g, unknown or other
  misc_feature (489)..(489): n is a, c, g, or t
tcagagtcgagagacacgaccggtgctcgatttagtgtagtgtgaaggggtcgtggtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggatcacctgctctggcgatgctattcgaaccaaaaacatatgtcttacgtacggtacagcagacggccgacggccacggccctgtcgttggtgtatttaataaagtattgaggacgcctcgacgggtaccctgagcgattctcgtgctcgacncgtcgacggacaacacgtcaccttcgaccacgtacgacggtggacgtccggccgtaagggacggacggaacggctagtaacctttagttactggttacgacgccgacgagacacgacgtaggtcgctagttntagtacggttagtcgggaggcggtataccggtcgtacggtacccgtcgtaggtaccacggacccgaagtcccgtcccggttccccgacggtcc

SEQ ID NO: 75340 - DNA, 759 bp, Homo sapiens
  misc_feature: GYAE6OF02FZR11.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcgaggacagacggccaggatcacctgctctggcatgcattcgaccaaaaacaatagtgtcttacgtcggtaaccagcgaaggacggccgacgggccacgggtcccccttgttcgtttgggtagtaattttaagtaaaagtacttttaggaaggtacggtcccctacggacggggtaccccttggacgtcgtacttcctcgtcggcctccgacgccgtacgaacgggaaccaaacgtacgttcctaccgtttacgaaccctagtacgtacgggtacgggtaacggttccccgggaccgaacggggaacgggaaaccgggacgggtaccgttacggtaaccgtttaacgtttaaccggttacggttaccgtaccggttcccggacctaacggaacgtaggacgacggtcgggtacgttacggtttacttacggttacgttacgggtttacggggacggggtacgggtaccgtacccgggtcgttacccgggtaacccggttaccggttacggttaaccgaccgggaacccggtaacgggtcccgttaccccgggtcccccggttcggttaccccg

SEQ ID NO: 75341 - DNA, 582 bp, Homo sapiens
  misc_feature: GYAE6OF02H3B0D.49.20.B09.1.454.CMB.1.raw
  modified_base (235)..(235): a, c, t, g, unknown or other
  misc_feature (235)..(235): n is a, c, g, or t
  modified_base (423)..(423): a, c, t, g, unknown or other
  misc_feature (423)..(423): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaanatatgcttatggtaccagcagacggcaggccacggccctgtcttggtgtattttaagtaaagacttttggagacggaccctcgacgggaccccctagagcgattctctggctccagctcgaggaacaacagtcacttgacaatcagtggacgtccggaccaggagacgaggctagacttaattacgtntcgacgtaccgacacgacgtagacgacggtaggacctaaggtttatcgtacgttagttccggggacggtacggaccgttacgcgttacggtaccgtaccgttaacgggcctaaccggacccgaaacgggtcccgtacccgtcccccggttggtaacccc

SEQ ID NO: 75342 - DNA, 806 bp, Homo sapiens
  misc_feature: GYAE6OF02I3A1X.49.20.B09.1.454.CMB.1.raw
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
tcagagtcgagagacacgaccggtgctcgatttagtgtagtgtgaagggggctgtgggtccaggaggcagaactctgggtgtctcaccatggcctggatccctctacttcctcccctcctcactctctgcacaggctctgaggcctcctatgagctgacacagtccacccgtggtgtctgtcgtcctcgaggacaggacggccaggactccacctgcctgtgggcatgctattcgaaccaaaanatntgtacttacgtaggtaccaggtacaggaacggccacggaccaccggcccctggttccgttaggtagtaattttagtaaaagttaccgttttaggaaggtaccgggtacccctacggtaacccgggtaccccgtaggtaacgaccggttacttccgttaccgtcgggtaccttaccgacgtaccgtaccggaacggggtaaaccgaaactaccgggttaccctaacccgtttaaccggaacccttaacgtaccggtaacgggttaaccgggtaccgggttaccccgggaccggtaaacgggaacgggtaaaccgggtaccgggttacggtacggttaaacgtttaacgtttaacggtacggttaccgaaaccggttccggtaaccgaaccggaacgtaaccggtaccgtaagggtaccgtcgttaaccgtttattacgggtttacctaacggggttacggggacgggttaacgggtaccctaacggtcggttacccgaccgttaccgtacggtacctacggacccggtacggtcccgtcccgtacccccgtgggttaccc

SEQ ID NO: 75343 - DNA, 550 bp, Homo sapiens
  misc_feature: GYAE6OF02GNJUF.49.20.B09.1.454.CMB.1.raw
  modified_base (292)..(292): a, c, t, g, unknown or other
  misc_feature (292)..(292): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgacccaaaaacatatgcttactggtaccagcagaggccaggccaggcccctgtcttggtgtatttaanaaagtactttgagacggcccctgacgggacccctgacgcgtattctcgtggctccgagtcctcgagggacaacgagtccaccttgaccatcgagtggacgtccgacaggaggacgaggctagacttagttacgtgtcacgtccgacagacgagacgaggtcgcgtagtttagtgtcgttagttcgggacggtaggacgtacggctcggaccgtcgtacggtccgacgcccgaaggtccgtaccgtccccgtgtacccg

SEQ ID NO: 75344 - DNA, 617 bp, Homo sapiens
  misc_feature: GYAE6OF02HH74H.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctactatgagctgacacagtcaccctcggtgtctgtgtcctcaggacagacggccaggatcacctgctctggcgatgcattgaccaaaaacaatatgcttactggtaccagcagacggccaggccaggcccctgtcttggtgtatttaataaagactttgagacggccctcgacgggacccctgagcgtacttctcgtggcctccgagcctacgagggaccaaacgacgtccaaccttcgaacctactacgtaggtcgggacgtccggacccgaaggacggacggaggcgtagacttagttaactgtacgtacgtcccgacgacgacgacggtacgacggtggacgtagtttaagtcgttacggttagttaccgggacgggtagggtaacgtaccggtcgtacggtaacccggtcccgtacggtccgacgtacccggaacggtcccgtccggtaccccccgtcgggtaacccg

SEQ ID NO: 75345 - DNA, 539 bp, Homo sapiens
  misc_feature: GYAE6OF02IGFQW.49.20.B09.1.454.CMB.1.raw
  modified_base (186)..(186): a, c, t, g, unknown or other
  misc_feature (186)..(186): n is a, c, g, or t
  modified_base (445)..(445): a, c, t, g, unknown or other
  misc_feature (445)..(445): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggcaggatcacctgctctggcatgcattgaccaaaacatatgcttactggtaccagcagacggccaggccaggcccctgtcttggtagtattttagtaaagtactttggagacggccctcgacgggacccctgagcgtattctcgtggctccagctcgagggacacgagtcaccttgaccacgtcagtggacgtccggcaggaggacgaggcctgactattactgtcacgtcgcagacgagacgaggtgntagttatgtcgtagttcgggcggtaggtactacggcgtcgaccggtccgtaggtccacggacccgaacggccgtccggtcccccgtggtacccg

SEQ ID NO: 75346 - DNA, 548 bp, Homo sapiens
  misc_feature: GYAE6OF02F29MP.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacatatgcttactggtaccagcagaggccaggccaggcccctgtcttggtgtatttaataaagtctttaggagacggccctcgacgggacccctggagcgattctcgtggctcagtctacgaggacaacgacgtcaccttgacctatcgagtggacgtccggccgaggacggacgaggctagacttattacgtgtacacgtccgcagacagcagtgctagttatgtacgttagtcgggacggaggtacgtacggtctacggaccgttccgtaggtccgacggacccgaaggtcctccggtcccccgtggtaccc

SEQ ID NO: 75347 - DNA, 686 bp, Homo sapiens
  misc_feature: GYAE6OF02F4DWQ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccagtactcacctgctcgtggagatgctattgaccaaagctaatatgtcttacgtggtaccagcaagaacgccacggccacggtcccctgtcttgatctaattaataaagtactttaggaacgacggtccctcgaaccgggtacccctggacgtcgtacttctcgtcggtcctaccgagtcctcgaacgacgaacaacgtacgtctacgtacgaaccctagtacgtagggtcgggtacgggtccgggacgaacggggtacgggaccggtagggccttaggtaactttacgtaccgtagtacctaggtacagttacgacgaacgtaggttaacggtcgggtacctttacgtttccggttaggttaccggttacggttaccggggtaccgggtaacgggtaaccgaacggtccggtaccggtaacccggttaccggttccgggtaaaccggacccggaccccggttacgggtacccccgtttcccccggg

SEQ ID NO: 75348 - DNA, 600 bp, Homo sapiens
  misc_feature: GYAE6OF02GB5FL.49.20.B09.1.454.CMB.1.raw
  modified_base (320)..(320): a, c, t, g, unknown or other
  misc_feature (320)..(320): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcactgctctggcatgcattcgacccaaaaactaatatgtacttacgtcggtaaccagcaagaggccaggccaggcccctgtcttggtgtatttataaagtactttgagacgccctnacggaccctgagcgtattctcgtcggctcacgtcgtcgaacgggacaacgtacgtaccaccgtttcgaacctatacgaggtcggaacgtccggaccgaggacggacggacggtcgtacgacttaagtttacgcgttctacggtcccgacgtaagacagacgaggtggtacgtagttattacggtcggttaacgtcgggacggtagggtactacggcgtacggtaccgttaccgacggtcgacgaccgtaacggccgtaccggtcccccgtaggttacccg

SEQ ID NO: 75349 - DNA, 698 bp, Homo sapiens
  misc_feature: GYAE6OF02JO3OO.49.20.B09.1.454.CMB.1.raw
tcagagtcgagagacacgaccggtgctcgatttagtgtagtgtgaagggggcgtgtgggtccaggaggcagaactctgggtgtctcaccatggcctggatccctctacttctcccctcctcactctctgcacaggctctgaggcctcctatgagctgacacagtccacccgtcggtgtcctggtcgtccctcagggaccaggacggccaggactccacctgctcgtggcgatcgctattcgacccaaaaatatactgcttaactggtacccaggtccagacggccgaaggcccgacggtccccctggttccttggggtactattttaactaaacgtacttttggaagtaccggccctacgacgggacccctggaacgtcgtacttcgtcgtcgggcctacgacgtcctacgaacggggtaaccaaacgacggttaccctaaccgttcggaaacctacgtaccgtacggtacggtaaccggtccggaccgacggacgggacgacggtcgtagacgttaacgtacgtcgtacgtaccgtcgtacgagaaccgagtacgacgtcggacgttaacggttactcgggttcgttaacgttcgggaccggggtacggtaaccgtaccggtacgttccggtaccggttaccgtacggttacgaccggaccgtaacgcccggtttcccgaccccggttccgtacccg

SEQ ID NO: 75350 - DNA, 541 bp, Homo sapiens
  misc_feature: GYAE6OF02HQTEK.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaacatatgcttactggtaccagcagaggccaggccacggcccctgtcttggtgatttataaagctttgagtagccctgacgggacccctggagcgattctcgtggctcagctacgagggacaacgtgtccacttgaccatcgagtggacgtccggacaggaggacgaggcgtagtactattacgtgtacgacgttccgcacgacagcgagtggctagttagtgtacgtagttacggacgggtaggacgtacggcgtacggacccgtcgtacggtcgacggtaccgaacggccgtaccgccccgtgtacccg

SEQ ID NO: 75351 - DNA, 585 bp, Homo sapiens
  misc_feature: GYAE6OF02G62VO.49.20.B09.1.454.CMB.1.raw
  modified_base (290)..(290): a, c, t, g, unknown or other
  misc_feature (290)..(290): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgctattgaccaaaaacatatgtcttacgtggtaccagcaggacggccaggccacggcccctgtcgttggtntatttaataaagtctttgacgtacggccctacgacgggtacccctggacgtccgtattcctcgtggcctcgacgtctacgacggacaaacgtacgtcctaccgttcgaccctatacgtaggtcggtacgtcccggacgagggacggacgaggctacgacttattactgtcgacgtccgagacgacgagcgtaggtcgactagttcgtgtcgtagttcgggcggtacggtcgtacgtcgtaccgtaccgtccgttacggtaccacggccgacgtccgtcccgtccccgttggtccc

SEQ ID NO: 75352 - DNA, 596 bp, Homo sapiens
  misc_feature: GYAE6OF02FPYNZ.49.20.B09.1.454.CMB.1.raw
  modified_base (239)..(239): a, c, t, g, unknown or other
  misc_feature (239)..(239): n is a, c, g, or t
  modified_base (437)..(437): a, c, t, g, unknown or other
  misc_feature (437)..(437): n is a, c, g, or t
tcagagtcgagagacacgaccggtgctcgatttagtgtagtgtgaagggggctggtgggtccaggaggcagaactctgggtgtctcaccatggcctggatccctctacttctccccctcctcactctctgcacaggctctgaggcctcctatgagctgacacagtccaccctggtgtctgtgtcctcaggacagacggccaggatcgacctgctctggcatgcattgaccaaaacatangcttactggtaccagcagaggccaggccaggcccctgtcgttggtgatttataaagtctttgagacggccctcgacgggcccctgagcgatttctctggcctcacgctacgagggtacaacagtccaccttgaccatcgagtggacgtccggacaggacggacgaggctacggacttacgttaactgtcgagtcccgngtacgacgtacgcgaggtacggactaggtttactcggtttcgtaacgttcgggaccgggacgggttacaacgggtcctacggtacccggttccgttaacgggttccgacggtaccccggaagggtcccgtacccggtaccccccgttcggttaaccccg

SEQ ID NO: 75353 - DNA, 768 bp, Homo sapiens
  misc_feature: GYAE6OF02ITEUD.49.20.B09.1.454.CMB.1.raw
  modified_base (246)..(246): a, c, t, g, unknown or other
  misc_feature (246)..(246): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctctatgagctgacacagtccacccgtcggtgtctgtcgtcctcgaggacagaccggccaggactccacctgctcgtggcgtatgctattcgaaccaaaaanatagtgccttaactaggtaccagcaacgaggaccacggaccacgggcccccctggttccgtttggtacgtaattttaagtaaaaggtacttttaggaaggaccgggtccccttcgaaccggggaacccccttggacggccggtaactttccgtccgttcggggccctcccgtaacggtccttacggaacggggaaaccaaacgtacggttaccctaacccgtttcggaaccctaacgtacgtaacgggttacgggaccgggtaccccgggtacccgaaagggacggggtaaccgaacggggtccgttacgggtaaaccttaacgttttaaccgtcggttacctaccggtccgttacgaacgtaaccgacgacggtaggtcggacgttacgtttaagttcgtaacggttcgttacggggaccggtacgggtacgtccggtacggttaccggtaccggttccgtaacggtcccgaccgtaacccggtacggtcccggtcccgtcccccggtttaggtacccccg

SEQ ID NO: 75354 - DNA, 741 bp, Homo sapiens
  misc_feature: GYAE6OF02HQEL9.49.20.B09.1.454.CMB.1.raw
  modified_base (132)..(132): a, c, t, g, unknown or other
  misc_feature (132)..(132): n is a, c, g, or t
tcagagtcgagagacacgaccggtgctcgatttagtgtagtgtgaaggggcgtgtggtccgaggaggcagaactctgggtgtctcaccatggcctggatccctctacttctcccctcctcactctctgcacnggctctgacgcctcctatgagctgacacagtccacccgtcggtgtcctgtcgtccctagaggaccaggaccgcaggtactcacgtgcttcgtggcgatgcctattcgacccaaaacgttagtcgacttagttcggtaacagacaaggacggaccggaccgacggccccgttaggtcgttgggtacgtagtaggttaaagtaaacgactaacgtacgaacggtacgtcccgtacgacgggtactacccgtaggacgtacgtacttcgtcgtacgctaccggtagtacgaacggacgaacgtaccaacgtgtacggactagtaccgtaggtcggtaacggtaccgacggacgtaacgggacgggtaacgaggtactacggtaactttaacgttagttaccgttaacgtaagtaaaccgtaaacgaaccgttaaactaacccgtttagttaaccgtttaactttaacggtccgttaccggttaaccggtaacgtacggtaaccggtaacccgtaacggtcccgttaacccgttacgggtacccggttacgaccggtaaccccgaaccgggtaaccccttaaaccccggactttaccgggtaccctaacccgg

SEQ ID NO: 75355 - DNA, 658 bp, Homo sapiens
  misc_feature: GYAE6OF02GDUE3.49.20.B09.1.454.CMB.1.raw
  modified_base (588)..(588): a, c, t, g, unknown or other
  misc_feature (588)..(588): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacatatgcttactggtaccagcagaggccaggccaggcccctgtccttggtgtatttaataaagtactttgagtacggccctcgacgggacccccgttgaggcgtattccgtcgttcggctccgagtcctacgaacgggaccaaacgtacgttaccaaccgtttcgaaccctagtacgaaggttcgggacggttcccgggaccgtaagggacgggaacgtaacgggcgttacggtaacttaacgtttacgtcggttacaacggtcccgacgaacgacgtaaggcgtaggtcgggacgtaaggtttactacggttacgttaacggttccgggacggggtacggaacgttaccggngttaccggacccggttccgtaacggtccgacgacccgtaacggtccgtaccggtacccccgtggtacccg

SEQ ID NO: 75356 - DNA, 728 bp, Homo sapiens
  misc_feature: GYAE6OF02HSX7K.49.20.B09.1.454.CMB.1.raw
  modified_base (245)..(245): a, c, t, g, unknown or other
  misc_feature (245)..(245): n is a, c, g, or t
  modified_base (272)..(272): a, c, t, g, unknown or other
  misc_feature (272)..(272): n is a, c, g, or t
tcagagtcgagagacacgaccggtgctcgatttagtgtagtgtgaagggggcgtggtgggtccgaggaggcgagaactctgggtgtctcaccatggcctggactccctctacttcctccccctcctcacctctctgcacgaggctcgtcgacggccctcctatgagctcgacactacgtccacccgtcggtcgtccgtgtcgtccacgaggacaggaccggccaaggtactccacctcgctccgnggactatgcctaagtcgaaaccaaaanatatcgactttaacgcgtaccagacgacggacggccgaacggtcccgacggtcccctgtcgtggtatattaacgtaatcgttagacgcggccctggacccggacctgacgcggtacttccgcgtcgacctaccgagtcccgtacgggagaaaccctaacgaacgttccctaaccttacggacctaagtcgagggtacggccgggttacccggacgaacggaaggggaaccgagggtaccgtaacgggttaactagttaaccgtgaccgttaacgcggaccaaggaacccgaaggaccttagggtccggtaactacgggtttaccgtagttccggttaacgggtcgggtaccgggtaaccgggaccgtaccgggtcccgtacgggtaaccccgttcggaaccggtccgtaacggcccggttaaccgccggtacccccgttccccgtacgttaccccg

SEQ ID NO: 75357 - DNA, 807 bp, Homo sapiens
  misc_feature: GYAE6OF02FNPB7.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgctattcgaccaaaaacatatgtcttgttggtaccagaagaagtcaggccagggccccggtgttgctcatctatcgacgacaacgaaaaccgcccgtaccgggactcccgtgagagtacttctcgtggccctacctaccctcgaacgggtacccagtccgggtaccctacgtttacggaaccttacgtaccgacggggcccggggacccgtaggggtacgggtaacgggtagttagggaaagggtcggtaaacgttaaccgttaagtttaccggtttaaacctacccgtaaacccgtaacggaaacccgtaaccgtaaacgggttaaacgtaaaaacgttacccgaaacgtaaacgggtaaagggttaaaaccgtttacgggttacccgggggaaaccggggtaacgggggtaaaccccgaaacggggttacccgtaacccggggttaacccccgttacgggttaaaccggggttacccgaaaccccggggtaaccccgaaacggggttccccggttacccccgggttaccccccccggtttaccggggtacccgtttaccccgttacccgttttaaccccccccggg

SEQ ID NO: 75358 - DNA, 523 bp, Homo sapiens
  misc_feature: GYAE6OF02FS7SP.49.20.B09.1.454.CMB.1.raw
  modified_base (410)..(410): a, c, t, g, unknown or other
  misc_feature (410)..(410): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggccccctgtccttggtgtatttataaagatttgagaggccctcacgggacccctgagcgattctctggctccagctacgagggacaacagtacaccttgaccatcagtggagtcggcgagaggacgaggctgacttattacngtcagtcgcagacagacgagtggctagtttatgtcgtagttcgggcggagggactacggctacggaccgtctacggtccacggacccgtaaggcctccgcccccgtggtaccc

SEQ ID NO: 75359 - DNA, 671 bp, Homo sapiens
  misc_feature: GYAE6OF02J09DJ.49.20.B09.1.454.CMB.1.raw
  modified_base (107)..(107): a, c, t, g, unknown or other
  misc_feature (107)..(107): n is a, c, g, or t
  modified_base (141)..(141): a, c, t, g, unknown or other
  misc_feature (141)..(141): n is a, c, g, or t
tcagagtcgagagacacgaccggtgctcgatttagtgtagtgtgaagggggcgtggtgggtccaggaggcagaactctgggtgtctcgaccatggcctggatccctntacttctcccctcctcactctctgcacaggctcngaggcctcctatgagcctgacacagtccaccctggtgtctgtcgtcctacaggacagaccgcaggtactccacctggctcgtggctatgctagttcgaaccaaaatattactgtacttacgtagtaccagcgacgacgcgacggaccgtacgtccctgttacgttggtatagttaacgtaagtacgttacgacgtaccggtaccctacggaccggtcccgtagtaccgtccgttacgttccacgttcgtcctccgacgccgtacggacggtacctaacgtacgtaccctaccgtacgacctacgtacggtacgtacggtaccggtaccgacgacggacggtaccgacggtactacgtacttaacgttacgtacgtacgtaccggtcacgtacgtacgacgtacgtacgtcgtacgttacgtacgtccgtacggtcgtaccggacggtacgtacgtaccggtcggtaccgtaccgtacggtcggtaccgaccggtaccgtacggtcccgtaccccggtacccgtagtaccc

SEQ ID NO: 75360 - DNA, 760 bp, Homo sapiens
  misc_feature: GYAE6OF02JC2W0.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacagctctgaggcctcctatgagctgacacagtccacccgtcggtgtctgtcgtcctcgaggacaggaccggccgaggactccacctgcctcgtggcatgctagttcgaaccaaaaactattagtcgtacctttaacggtacggtaacccgagaccgaaggaccggcccgaacgggcccgaaccgggtcccccccgttagttccggtttgggttattaacttttaaagtaaaacgttcgttttaggaggtacccggcccttacggaccgggtacccctggaacgtccgtattcctcgtcggccttccgagtacctacggaacgggtaaccaacgtaccgttacctacccgttacgaaccctagtcgtacgggtacggtaccggtacccgggaccgaagggaacgggtaccggacggtaccgttaccggtaacgtttacgtttaccgtgttaccgacgttcccgacgaacgtaacacggaccgtaggtacggacgttaacgtttacgtcggttacgttacggttccggggaacggtacggtaccgttccggacgttccggacccggttacgtacggtaccgtaccggacccgtaaccggtcccggtaccccgttccccgtccggttacccg

SEQ ID NO: 75361 - DNA, 664 bp, Homo sapiens
  misc_feature: GYAE6OF02JX5PP.49.20.B09.1.454.CMB.1.raw
  modified_base (285)..(285): a, c, t, g, unknown or other
  misc_feature (285)..(285): n is a, c, g, or t
  modified_base (292)..(292): a, c, t, g, unknown or other
  misc_feature (292)..(292): n is a, c, g, or t
  modified_base (332)..(332): a, c, t, g, unknown or other
  misc_feature (332)..(332): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgacccaaaaacaatatgtcttactggtaccagcagacggccaggccagcccctgtcttggntatttanaaactctttgagcggcctgacggaccctgagcgtattccncgtggcctcagtcctacggaggaacaacgacgtctacccgttagaccctagtcgacggtcgggtaccgtcccgggacgtaaggacgggacggaacgggtccgtaggtaaccttacgttaccgtacgtacgtaaccggttccgactacgggaaccacggaccctaaggtaccggtacgttaaggtttacgttccgggttacgttacggttccggggtaccgggaagggttacctaccgggtccgttaccggtacccgttaaccggttagggtacctaacccgggtacccgaaagggttccccgtaacccgggtcccccgttacgggttacccc

SEQ ID NO: 75362 - DNA, 541 bp, Homo sapiens
  misc_feature: GYAE6OF02HF6OD.49.20.B09.1.454.CMB.1.raw
  modified_base (355)..(355): a, c, t, g, unknown or other
  misc_feature (355)..(355): n is a, c, g, or t
  modified_base (387)..(387): a, c, t, g, unknown or other
  misc_feature (387)..(387): n is a, c, g, or t
  modified_base (498)..(498): a, c, t, g, unknown or other
  misc_feature (498)..(498): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcaccgtgctcgtggcgatgcattcgaccaaaacatatgcttactggtaccagcagacggcaggccacggcccctagtcgttaggcgtaatttaagtaaagtactttggagacggtccctacgacggaccctgagcgattcgctggctcganctcgaggacaacgatcacttgacctatcgagnggacgtccggacgaggacggacgacggactgtaacttattacgtgtcacgtccagacgacgagccaggtcgtacgtagttacgtgtacgtagttcgggcggaggactacgngtacgacgtcgtagacgcgacgacggctccgtacccgtgtccg

SEQ ID NO: 75363 - DNA, 656 bp, Homo sapiens
  misc_feature: GYAE6OF02JLSIP.49.20.B09.1.454.CMB.1.raw
tcagagtcgagagacacgaccggtgctcgatttagtgtagtgtgaaggggctgtgggtccaggaggcagaactctgggtgtctcaccatggcctggatcctctacttctcccctcctcactctctgcacaggctctgaggcctcctatgagctgacacagtccaccctcggtcgtctgtgtcctcaggacagacggccaggactcacctgctctggcatgcattcgacaaaaacatatcgtcttaacgtcggtaccagacagacggccaggcccaggccccgtgttccgttagggtctagtttaacgtaaaacgttcgttttacggaacggtacggtcccctacgaacggggtaaccccctggaaacggcgtaacttttccgtaccgttcgggaccttacccgaaggtcccgttacccgaaacgggggtaacccaaaacgttcggttacccgtaacccgtttagaaccccgtaataccgtacggtacggtacgtccgggacccgacggacggaacgacggtacgtcgtaaccttaagttacgtgttaccgacgttccgacacgacagacgagtcgactagttactgtacgtgtacggcggacggactcgcgtagcgttccgtgtacgacgccggaagccgtcgtcccgtgtacccg

SEQ ID NO: 75364 - DNA, 741 bp, Homo sapiens
  misc_feature: GYAE6OF02GLRYS.49.20.B09.1.454.CMB.1.raw
  modified_base (191)..(191): a, c, t, g, unknown or other
  misc_feature (191)..(191): n is a, c, g, or t
tcagagtcgagagacacgaccggtgctcgatttagtgtagtgtgaagggggctagtgggtccaggacggcagaactctgggtgtctcaccagtggccgtggatccctctacttctccccctctcactctctgcacaggctctgaggcctcctatgagctgacacagtccaccctcggtgtctgtgtcctanaggacaggacggtccaggatcaccgtgctcgtggcgatgacattcgaccaaaaaacatagtcgtaccttaacgtcggtaaccaggaccaaggacggaccaacggtcccgacgggccccccttggttccgtttagggagttaatttttaaaagttaaaacggtacttttgggaaaggaccgggtaccccttcgaaccggggacccctaggaacggtcgtaatttcctacggtgggtaccttcccgaaggtcccttacggaacggggtaacaaacgtagaccctaaccgttggaaccccaattcgaacggtacggggtactaccgggaccgaacgggtacgggacggaacgggtccttaggtaccttaattaacgttcgtccgttaacggccgaacgtaggaaccgaacggttaccagggttacgaacgttacgttacgtcgtttacgtacggttcggacgggtacggaccgtaacggtcggtaccgaccgggttacctacgggttaccgacgaccccgttaaggccctccggtaccccctagggttacccc

SEQ ID NO: 75365 - DNA, 630 bp, Homo sapiens
  misc_feature: GYAE6OF02FK0N8.49.20.B09.1.454.CMB.1.raw
  modified_base (174)..(174): a, c, t, g, unknown or other
  misc_feature (174)..(174): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtntctgtgtcctcgaggacagacggccaggatcactgctcgtggcatgctattcgaccaaaaacatatcgtcttacgtggtaccagacgaggacgccgacggccgacggtcccctgttcgttggtagtaatttaagtaaagtacgttttagaggtacggtcccctacgacgggacccctggacgcgtacgtttctacgtcggcctccgacgtctacgaacgggacaacgtacgtcctaaccgttacgaaccctatcgaggtcggacggtcccggcgaacggaggacggacggtcagtacttattacgtgtcgacgtcgcacggacgagcgtacgtcggacgttagttacgtgtacgttaggttcgggacggtacgggtacgtacgtcggtccggtaaccgttccggtacggtccgaccgtccggaacggtcccgtacccggtcccgtccggttacccg

SEQ ID NO: 75366 - DNA, 688 bp, Homo sapiens
  misc_feature: GYAE6OF02IKAWQ.49.20.B09.1.454.CMB.1.raw
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacagtcaccctcggtgtctgtctcctgaggacagaccggccaggactcacctgctctggcgatgcctattcgacccaaaaanatatgacttacnggtaccagcagacggccaggccacggcccctgtacgttggtgtactttaataaaagtcttttgaacgtacggcccttacgaccgggaccccttaggaacgcgttacttctacgtcggccttcgacgtacctacgaacgggaacaaacgtacgtacctaaccttacggaaccctagtcgtaacggtacgggtaaccggtcccggaccgaaagggacgggtaaccggaagggtaccgtacgtaacgttaacgtttaaccgtgttaaccgtacgttcccgacgacgaacgacggactaggtcgtacgtaagttacgtaggttaccggttacgttcgggcgggtacggtaccgttacggcgttaccgacccggttaccggtacggtaaccgacggtacccgtaaaggcccgttaccggtaccccccgtcgttaacccg

SEQ ID NO: 75367 - DNA, 792 bp, Homo sapiens
  misc_feature: GYAE6OF02JL6WR.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatcgagctgaccactacgtccacccgtcggtgtcctgtcgtccctcgacggacacggaccgggccaagggacttcaccgttgccttcgtcgggaccgtatcggactacgttaccgaacctaaaaactagttatcggtacctttacgtacggtaaccaggacaaggacggcccgaaggccccgaacgggtcccccttaggttccgtttagggtacgtttaacttttaagtaaaacggtccgttttaggaacggtacccggtcccttacggaaccggggtacccccttaggaacggtccgtacttttccgtacgtcggtaccttaccgacgccgtacgaaacggggaaccctaaacgtccgttaaccaaccggtttcggaaacccctagttaaccggaagggttccgggtaaaccggttccccgggacggtaaacgggtacgggtaaccgggtacggtcctaaacgggtaccctttaagtaccggttacgtaaccggtcgtacccgaacgtaggaaccgtacgccggtaggtacggacttacggttgtaccgtcgtacggtacgggaccggaggttacctacggaccgttcgaccggttcgacggtacaccgtacggacccgttcgtaccccgaccggttctccg

SEQ ID NO: 75368 - DNA, 792 bp, Homo sapiens
  misc_feature: GYAE6OF02GSSAZ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacaggacggccaggactcacctgctcgtggcgatgctattcgaacccaaaaaactaattagtgtacctttaacgtaccgggttaaccacggacgaaggaccgggacccgacgggaccccgaaccgggtccccccgttggttaccgtttgggttacgttaaactttttaaagtaaaacggttaccgttttaggaacggtaccgggtcccctacggtaacccggggtaccccgttagggacgtaccggttactttccgtcgtcgggtacctccgaacgtccgtacggaacgggaacaacgtacgtacctaccgttacgaacctacgtacgtacggttacgggacggtacccgggacgacgggtacgggaacggacgggtcctaggtaacttaagttaccgtcgttacgaccggttccgacgacgtacgacggtaccgacgggtcgtaccgttaggtttatccggttaacggttacggtacgggggtacgggacgggttaccgtaccggtcgttaaccggtacccggtttaccggtaccgggttaccggaccggtaccccggtaaccgggttcccgtcccccggtaccccggttccggtaaccccg

SEQ ID NO: 75369 - DNA, 682 bp, Homo sapiens
  misc_feature: GYAE6OF02FFPJ5.49.20.B09.1.454.CMB.1.raw
  modified_base (305)..(305): a, c, t, g, unknown or other
  misc_feature (305)..(305): n is a, c, g, or t
  modified_base (546)..(546): a, c, t, g, unknown or other
  misc_feature (546)..(546): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgctattcgaccaaaaacaatatgacttactgggtaccaggacagacggcccaaggcccgacggtcccccctgtccgtttagggtntaatttaagtaaaacgtacttttggaagtacggccccttacggaacgggtacccccttaggacggtcgtacgtttccgtcgttgggacccttcaacggtcctacgaacggggacaacgtacgtccaaccgttacgacctatcgagttagggacgtccggcgaacggagggacggacggtacgtacggaactttaacgttacgtagttaccgacggttacccgaccaacggtacgaaccggntacgggtacggacttacggtttagtcgtcggttagtttccgggacgggtagggtaccgtacgtccggtacgtacccgtccgtttaagggacctacggaccccgtaaggtccctacccggtcccccgtaggtacccg

SEQ ID NO: 75370 - DNA, 771 bp, Homo sapiens
  misc_feature: GYAE6OF02F2LG3.49.20.B09.1.454.CMB.1.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtcaccctggtgtctgtgtcctcaggacagacggccaggatccacccgctcgtggcgatgcattcgaccaaaacatatgcttacngtaccagcagagccaggccacggccctgtctggtgatttanaaagtcttgagacggcctcgacgggacccctgacgtcgacttcctcgtcggtctccgacgcgtacgagggtaacaaacgtaggtacctaccgttacgaaccctagtaccgtaagggtcgggtaaccggttacccgggaccgtaaacggggaacgggtaaccgggaacgggtaccgtacgggtaaacctttaacgtttaccgttacgggtacccgtacgggttaccccggacgaaaccgggaacccgaaggtccgtaacgggttcgggaaccgtttaaggttttaccgttaggggtttaacccgtttaaacggtttccggggaacccgggggttaggggttaacccgttacgggtccgttttaaccgggaacccccgggttttaccgttaaccggggtaaccgtaacccgggtaccccggtaaaccggtccccggtttaccccgggtaccccccccggttagggtttaccccttaaccccggg

SEQ ID NO: 75371 - DNA, 631 bp, Homo sapiens
  misc_feature: GYAE6OF02JY58G.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggcagacggccaggatcacctgctcctggcgatgcattgaccaaaacaatatgtcttaactcggtaccagcagacggccacggccacggcccctgttcgtttggtgtaatttaataaacgtcgtttagaggtacggccctacgacgggacccctggagtcgtaatttcctcgtggtcctccagcctcgaagggacaactacgtacctaccgtgaccagtaccgaggtcggacggtccggccgaggacgggacgacggtctacggtacttattaacgtcgtacgtacgccggacacggacacggaccgagtcgacgtagtttaacgtggtttaccggtacgttcgggacgggtacgggtaccgttaccggcgttaccggaccggtccggttaacggtccgtaacgtcccggaaacggttccgtacccgttccccgtacgtccccg

SEQ ID NO: 75372 - DNA, 688 bp, Homo sapiens
  misc_feature: GYAE6OF02HY56R.49.20.B09.1.454.CMB.1.raw
  modified_base (583)..(583): a, c, t, g, unknown or other
  misc_feature (583)..(583): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcacccctcggtgtctgtgtcctcgaggacaggacggccaggactcacctgctcgtggcgatcgctattcgaacccaaaaacattagtgtactttacgtggtaaccaggacgacggacggccgacggccgacggtcccctgtccgtttgggtagtaacgttttaagtaaaggttactttggaacggcggtcccctacgaaccggggtacccctggtaacggaccgtacttccgttccgtcgggcctacccgacggcctacggaacgggaacctaacgtaacgttacctaaccgtttcgaacccttaacgtcgtaacggtacgggaccggttcccggaaccagggaacgggacgacggcgtacgtaacgttagttaccgtcgtactaccgtccgacgaacgacgacgtacgaggtacgggntacgtttacgtcgtacgttcgttcggacgggtagtccgtaacgtcggttacggtacccgtacgtacggtcgacgtacccgacgtccgtcccgcccgttcgtaccg

SEQ ID NO: 75373 - DNA, 784 bp, Homo sapiens
  misc_feature: GYAE6OF02IPTFQ.49.20.B09.1.454.CMB.1.raw
  modified_base (177)..(177): a, c, t, g, unknown or other
  misc_feature (177)..(177): n is a, c, g, or t
tcagagtcgagagacacgaccggtgctcgattttagtgtagtgtgaagggggctgtgggtccaggaggcagaactctgggtgtctcaccatggcctggatccctctacttctcccccctcctcactctctgcacaggctctgaggcctcctatgagctgacacagtccaccctggtntctgtcgtcctcgaggacaggaccggccaaggactccaccttgcctcgtggacgtatgcctagtttcgaacccaaaaaactattactcgtactttaaccgtggtaaccaagcgaacggaggccgacggacccaacggtcccccgttgttcgttggtacgtaattttaaagtaaacgtaccgtttagaagtaccgggaccctacgaacgggtaccccgtaggacgtcgtaacttcgtccgtacggtccgtaccgacgtacgtacgaacgggaaccaaaccgtaacgttaccctaacccgttaccgtaaaccctacgttaccgaacggggtacggtaacggtccccgggaaccgtaaggggaccgggacggtaacggcggttaccgtaactttaacgttacgttacggttaaccgtcgttacccggacgacgaccgagtaccgtacggtacggtacgttaacgtttgttacgggttacgtttaacgttcggggaccgggttacggggtaaccgttaccggccgttacgggtacccggttacccggtaacgggtaccgaacggtaacccgtaacccgggtccgtaccccgtcccccgggttacgtccccg

SEQ ID NO: 75374 - DNA, 821 bp, Homo sapiens
  misc_feature: GYAE6OF02HISM4.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtcgtcctcacggacagcggccaggactcacctcgctcgtggacgatgcattcgaaccaaaaacaattatcgtacctttaaccgtacggtaccacgaccgaaggacggccgaacgggtccgaccggtcccccgttggttcgttttacggggtaggttaacttttaaacgttaaaacggttaccgtttttacgggaacgggtaaccgggtcccccgttaacgggtaacccgggggtaacccccgttaggtaaccggtacggttacctttccgttcgttcgggttaccctcccgtacgtacccgttaacggaacgggtaaaccgaaaccgtaccggttacccgtaaccgttacccgaaccgtacgtttaccggaacgggtttacggtaccgggtaccccgggaccgtaaggggaaccgggacggtacgggtaccttacggtacgttaacgtttaccgtcggttaccacgggtccgtacgacgtaaccgaggaccgtaggtcggacttacgtttagttcgttacgttaagggtccgggtagggacgggtaccttaccgggtcgtacccgggtacgttacccggtacggtaccgacggtaaccccggtcggttacccggtccccgtaccccggttcgttaacccccg

SEQ ID NO: 75375 - DNA, 639 bp, Homo sapiens
  misc_feature: GYAE6OF02FZYOS.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagacggccaggccacggccccctgtcttgggtcgtatttaataaaagtacttttgaaggacggccctcgaacgggaccccctggacgtcgattccgtctggcctccagctacagggacaactagtcaccttgaccatcaggtggacgtccggccaggacggacggacggacgtacgaacttacgttaactcggttacgtacgtcccgactaacggaacgacggaccgtaggtcggaccgtaagttttacgttcggttacgttaacggttcgggaccgggtagggtaccgtaacggtccgttacggaaccccgttaccggtacggtacccgacggtaccccggtaaacgggtcccgttacccggtccccccgttacgggttacccc

SEQ ID NO: 75376 - DNA, 535 bp, Homo sapiens
  misc_feature: GYAE6OF02G74SX.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggcccctgtcttggtgtatttaataaagtactttggagacggccctcgacgggacccctggacgcgtattcctcgtggctccgagctcgaggacaacacgtcaccttgacctatcgagtggacgtccggacaggaggacgaggctagactattactgtcagtcatcagacagtagtgctacttcgtgtcgtagttcgggacggacgggaccaggctacgtacccgtcgtacggtcacggaccgaaggccgtccgtccccgtggtccc

SEQ ID NO: 75377 - DNA, 590 bp, Homo sapiens
  misc_feature: GYAE6OF02HIW85.49.20.B09.1.454.CMB.1.raw
  modified_base (186)..(186): a, c, t, g, unknown or other
  misc_feature (186)..(186): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggatcactgctctggcgatgactattcgaccaaaaacatatgcttactggtaccagcagagccaggccaggcccctgtcttggtgtatttataaagactttgagtacggccctcgacgggacccctggacgcgtattctctggctcagctcaggacaacagtacaccttacgacctatcgaggtggacgtccggcaaggaggacgacgggtctaggtaactagtttactcggactacggtccgactagacgagaccgtaggtcggacgtagtttacgtacggttcggttaagttccggggacgggtacgggtacgttaccggcgtacggtacccgtaccggtaggtaccgaccgaccgtaacggtcctcccggttccccgtggttacccg

SEQ ID NO: 75378 - DNA, 815 bp, Homo sapiens
  misc_feature: GYAE6OF02HBSRJ.49.20.B09.1.454.CMB.1.raw
  modified_base (84)..(84): a, c, t, g, unknown or other
  misc_feature (84)..(84): n is a, c, g, or t
  modified_base (242)..(242): a, c, t, g, unknown or other
  misc_feature (242)..(242): n is a, c, g, or t
tcagagtcgagagacacgaccggtgctcgatttagtgtagtgtgaagggggcgttggtgggtccaggaggcagaactctgggtntctcaccatggcctggactccctctacttcctccccctcctcacgtctctgcacacggctcgtggaggccttcctatggagctgacacagtccacccgtggtcgtctgtcgtcctcgacggacaggacggccaggactccaccgtgcctctggcagtnctagtcgaacctaaaagtagtctcgtacttacgtacggtaccagtaccgaacggacggacccgaacggacccgtaccggtcccccgttacggttccggtttacgggtacgttaaacttttaacggtaaaacgttcgtttacggacggtaaccggtacccgttaccgggaaccgggtacccccgtaggaccgtaccggttacttccgtcgtcgaccgtaccgacgtccgtacggaacggaaccgtaacgtaccgttacccgtaccgttacgtaaccgtacgttaaccggacgggttcgggtaaccgtacccgggtaacgaagggacggggaacggtacggggtacttaacggtaacgttacggtttacgtacggttaccgtacgttacccgactaccggaacgtacggaccggttagggtaccgtacgttacgtttagggttcgttaccggtttacgggtccgggttaaccgggtacgggtaaccgtccggttccggtaaccggtccgtacggttaccggtagaacccggttaccgggaccgtcccgggtccccgtacccggttcctaccccgg

SEQ ID NO: 75379 - DNA, 817 bp, Homo sapiens
  misc_feature: GYAE6OF02GOEYC.49.20.B09.1.454.CMB.1.raw
  modified_base (175)..(175): a, c, t, g, unknown or other
  misc_feature (175)..(175): n is a, c, g, or t
  modified_base (236)..(236): a, c, t, g, unknown or other
  misc_feature (236)..(236): n is a, c, g, or t
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtntctgtgtcctcaggacagacggccaggatcacctgctctggcatgcattacgaccaaaaanatatgtcttacgnggtaaccngacaggacggccgacggccgacggtaccccctggttccgtttaggtacgttaattttaaacgtaaacggttaccgtttaggaacggaccggtccccgttacggaacccggggtacccccttaggacggtaccgttactttccgttaccgtcgggtaccttacccgacgtaccgttaccgggaaacgggtaacctaaacccgtagttaaccccgtaaccgtttacggaacccctagtaaccgtacgggttaccgggtaccgggtacccggacccggtaagggaaccgggacgggtaacggtccgtaacggttaacgtttaaccgttacggttaccggttaccgaaccggttccgaacgaacggtaaccgaacggaaccggttacgggtacggtaacgttaacggtttacggttggtttaaaccgtttacgggttaccgggtaacgggtacgggtaacccgtcggtaaccggttacgggtaaccccggtttacgtacgggtaacccgaaccggtacccggtaaaccgggtccctacccgggtcccccggttacgtaaccccg

SEQ ID NO: 75380 - DNA, 701 bp, Homo sapiens
  misc_feature: GYAE6OF02JF3PD.49.20.B09.1.454.CMB.1.raw
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
tcagagtcgagagacacgaccggtgctcgatttagtgtagtgtgaaggggcgtgtgggtccgaggaggcagaactctgggtgtctcaccatggcctggatccctctacgttctcccctcctcactctctgccacaggctctgacgcctccatgagctgacactagtcaccctcggtgtctacgtgtccctcgaggacagaccgggcctaggactccgacctgcctcgtaggcgattcgcaattgacccaaaaagnttancgtcttacgtggtaccagcaagacggtccacggccacggccctcgtccgttggtcgattttaacgaaagtacgtttcgaagacggcccgttacgaacggggtacccctgacgcggtactccgtctacggtctaccaggtctcgacgggacaacgcgtaccaccgtcgaccactcgacgtgaacgtccgacgagtaggacgacgggtactaggtaccttaagttacctaggttccgacggttaccactaacggaactcgacccgaaggtcgtaccgtacggttaagttccggtccggtttaaacgttcggggaaccgggtacgggtaacccgttaccgggtaaccggttacctaacccgggttccggttaacgggtacccggtacccggttaacccggaaccggaaccccctaacccccggtaacgttcggttaaaccccccg

SEQ ID NO: 75381 - DNA, 594 bp, Homo sapiens
  misc_feature: GYAE6OF02GNUCS.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacatatgtacttacgtcggtaccagcaaggacggccgacggccacggtccccgtgttcgttggtagtatttaagtaaagtacgtttagagtacggtccctacggaccgggacccctggacgtcgtagttctcgtggcctcgacgtctacgaacgggaacaacgacgtcctaccgttcgacctagtcgacggtggacgtcccggacgaggaggacgaggtctagtacttagttacgtcgtacgacgttccgagagacgacgcgtaggtgactagttacgtgttacgtaggtcggaggtacggactcggctcggaccgtcgtacggcaccggtacgacggtcctaccgtccccgtaggtacccg

SEQ ID NO: 75382 - DNA, 546 bp, Homo sapiens
  misc_feature: GYAE6OF02HK1GS.49.20.B09.1.454.CMB.1.raw
  modified_base (236)..(236): a, c, t, g, unknown or other
  misc_feature (236)..(236): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctggaggcctcctatgagctgacacagtcaccctcggtgtctgtgtcctcaggacagacggccaggatcacctgctctggcgatgcattgaccaaaaanatatgcttactggtaccagcagaggccaggccaggccctgtcttggtgtatttataaagactttgagaggccctcgacgggcccctgagcgtattctctggctcagctcgaggacaacgagtcacttgaccatacgagtgagtccggcaggaggacggacggactgaactagttactgtactagtccgtacacgacagaccaggtggcgtagtttaagtcgtacggtacgttcgggacgggagggacgtacggcgtacggaccgttccgtacggcacggcccgaggtccgtccgtcccccgtggtacccg

SEQ ID NO: 75383 - DNA, 833 bp, Homo sapiens
  misc_feature: GYAE6OF02FP7ZS.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggcgatgcattgaccaaaaacaatatgacttacgtcggtaccagcaagaacgccaggccacggcccctgtcttgatctaatttaataaagtactttggaggacgggtcctacgacgggacccctggacgtcgtacttctcgtcggcctccgaagtccgttacgacggtaccgaaaccaaaccgtaacggttacccgtaaccggttttacgaacccgtaagttaaccggtaacgggttacggggtaaccggggttaccccgggggaacggaaacggggtaaaccgggggtaaccgggaacggggtaccgttaacgggttaaaccgtttaaacgttttaaccgttacggttaccgtaacggttaccctaacgttaaccgtaaacgtaaaccgtaacgggtttaaacgggttcgggtaaccgtttaaccgttttaccggtttacggtttaccggtttaacgggttttacccgggggaaccgggggtaaaccgggggtaaacccgtaaaccgggttccggttaacccggttaaccccggtttacccggttaacgggttacccggtaacccgggtaacccccggtaacggggttaccccgttaccccgggtaccccccccggg

SEQ ID NO: 75384 - DNA, 725 bp, Homo sapiens
  misc_feature: GYAE6OF02GAXS1.49.20.B09.1.454.CMB.1.raw
  modified_base (176)..(176): a, c, t, g, unknown or other
  misc_feature (176)..(176): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtntctgtgtcctcaggacaggaccggccaggactccacctgcctgtggcatgcattgacccaaaaagattatgtcttactaggtaaccagacgaagacggaccacggcccgaacggtccccccgttgttccgttggtagtagttttaataaaacggttacttttaggaaggtacggtccccgtacgaaccggggtaccccctaggacgcgtattcctcgtcggtcctccgacgtctaccggacgggaaccaacgtacgtcctaacccgttacgaacctacttacgtaggtacgggtacggttcccggaccgaacggtacgggacggtacggtcgtacggtaacttaacgttaacgtcggttaaccacggttacccgacgaacggtaacgaccgtacggagtacgggacgttaggtttaacgtggttcggttagttccggggacgggtacgggacgtaccggtccggtaccggtacccggtaccgttaacggtaccgtaaccggtcccgtaaacgggttcccgtaccccggtcccccggtccggttaacccg

SEQ ID NO: 75385 - DNA, 679 bp, Homo sapiens
  misc_feature: GYAE6OF02HSLR5.49.20.B09.1.454.CMB.1.raw
  modified_base (240)..(240): a, c, t, g, unknown or other
  misc_feature (240)..(240): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctcggtgtctgtgtcctcaggacagacggccaggatcacctgctcgtggcgatgctattcgaacccaaaaanaagtatcgtcttactcggtaccagcagaggccgacggccacggccctgtcgttggtgtaactttaagtaaacgtacgttttagacgtacggtccccttacgaaccgggtacccctggacgtacgtacgttctcgtggtcctaccgagctacggaggacaacgtacgtccaacgtacgactagtacaggtacggacggtccggacgaagggaggtaacggacggtcgtacggtacttaacgttcgttagaccgtacggttaccgagaaccggtaacgaacggacgtacggtacggtacgttaaggtttaacgtcgggttacgttaacggttccggggaacgggtacgggtaccgtaccggtcgttaaccggtccgttaccggttaacggccgtaaccggaccgtacggtcccgttcccggtacccccggtggttaccccg

SEQ ID NO: 75386 - DNA, 649 bp, Homo sapiens
  misc_feature: GYAE6OF02HUAFC.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggactcacctgctctgggcatgctattcgaaccaaaaacatatgacttacgtggtaccagcaagcggccaggccgacgcccctgtcttggtgtatttaataaagtactttgagacggccctacgacgggacccctggacgcgtacttcgtcgtcggcctccgagctacgagggaacaacgagtaccaccttcgaacctatcgaggtggacgtccggacgaacggtaggacgacggtcgtagaacttaacgttacgttagtacgtacggtaccgacgaacgtaacgacgacgtagggtacggtactaacggtttaagttcgggttaacgttacggttaccgggaccgggtaagggtacctacgggtccgttaccggtaccgttccgttaacgggtccaaccggtacccggtaacggtcccgtaccccggttccccggttaccgggtaccc

SEQ ID NO: 75387 - DNA, 774 bp, Homo sapiens
  misc_feature: GYAE6OF02IW2NL.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgacggcctcctatgagctgacacacgtccacccgttggtgtctgtcgtccctgaggacaggaccgaccaggactccaccgtgctcgtggcatcgactagttcgaaccaaaaactatagtcgtaccttacgtacggtaacccagacggaagtacggccgacggacccgaccggtcccccgttggttacccgtttgggtacgttaaagtttttaaacgtaaaacggttacgtttttacgggaacggttaccgggaccccctttacgggaaacccggggtcccccgtttagggaaaccggcgttaacgtttcccttcggtaccgggtaaccctttccgaacggtcccgttaacggaacgggaacctaaacggacggttaccctaaccgttacgaacccgtaacgtcgtaacgggtaccgtaaccgggttcccggaaccgtacgggaaccggtaacggtaggtccgtaagtaccgtttagttacgtcgtacgacgtaccgacgacgtacgagaccgtggtacgacgttagttacgttcggtacttaggtaccggcgggtacgtacgtacggtcgttacggtaccgttcgtacggtactaccggaccggacgtcccgtaccggtaccccgttggtaccc

SEQ ID NO: 75388 - DNA, 581 bp, Homo sapiens
  misc_feature: GYAE6OF02FUBWS.49.20.B09.1.454.CMB.1.raw
  modified_base (260)..(260): a, c, t, g, unknown or other
  misc_feature (260)..(260): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacaatatgcttactggtaccagcagnggccaggccaggccccctgtcttggtgtatttataaagtactttgagacgccctcagggacccctgagcgattctctggtctccagctcgagggacaactagtacaccttgacctatcagtggacgtcccggcagaggacgaggctgactattactgtacacggtccgcgacgtacacgcgaggtggactagtttacgtgttacgttagttcgggacgggtacgggaaccgttaccggtacgtacggtaacccggtccgttaacggtccgaacggtaccccgtaagggtcccgtcccggtaccccccgttcggttaccccg

SEQ ID NO: 75389 - DNA, 739 bp, Homo sapiens
  misc_feature: GYAE6OF02G8GUG.49.20.B09.1.454.CMB.1.raw
  modified_base (380)..(380): a, c, t, g, unknown or other
  misc_feature (380)..(380): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcgaggacaggaccggccaggatcacctgctcgtggcatgctattcgaccaaaaacatagtcgcttacgtggtacccagcaaggacggaccaggccgacggtccccctgttcgttggtagtactttaagtaaagtactttaggacgacggtccctacgacgggacccctgacgtcgtacttctcgtcggcctccgngtcctacgacgggtacaaacgtacgtactaccgttacgacctagtcgacgggtacggacggtcccgggtaccgaacgggaacgggaacgagggtccgttaacggtaacgtttacgttaccgtttacggtaccgtaaccggttcccgacgtaaccggaaccgtacggtaaccgtacgggtacggtaccggttaagtttacgttacggtttccggtaaggtttacccgggggaacggggtacgggtaaccgttaccggtaccggttaccggtaacccggttcccggtaacgggttacccgaccggtaacccggtaaccggtcccggttacccccggtcccccggtttacgggttaaccccg

SEQ ID NO: 75390 - DNA, 654 bp, Homo sapiens
  misc_feature: GYAE6OF02IMBGV.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacagtccaccctcggtgtctgtgtcctcgaggacaggaccggccaaggactcacctgcctcgtggcatgactagttcgaaccaaaaataatatcgactttagttcggtaaccagacgaaggaacggcccgggccacggcccctggtggttggtgatggtaataaagacacgtagacggacggccctagagggtactcccgtgagcgtacttcgtcgtcggacctccgtaggtcgaacgggacctaaacggcaacgtagttcgggaccctaagttcggaggttacgggaacgtccgacgggacgtaagggaagggtaccgagggtctacggtaactttagttacgttacgtactaaacgtacgaaacgaccgtaacaccgttagttacggttacttagttcgttacgttacgacttcgacgtaccgtaacgccgtaccgtcgttcggtacaaccggtacccgaacggaccccaaccccggtatccgtcctacccg

SEQ ID NO: 75391 - DNA, 621 bp, Homo sapiens
  misc_feature: GYAE6OF02GUN8Z.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttacgtggtaccagcagaggccaggccacggcccctgtcttggtagtatttaagtaaagtctttaggagtacggccctacgacgggacccctggacgcgtacttccgtcgtcgcctccgacgtctacgaacgggaacctaacgtacgtacctaccgttacgacctaagtcgtaacggtcggtacggtaccggacgaagggacggacggtacggtactacgtacttacgttacgtacgtccacggtccgacgtagacgacgacgaggtgtacttaggttacgtcgttacggttacgttcgggacgggtacggtaccgtacggcgtaccggtaccggtcgtacggtacgacgaccgaggcccgtccgtccccgtcgtacccg

SEQ ID NO: 75392 - DNA, 640 bp, Homo sapiens
  misc_feature: GYAE6OF02HNYLJ.49.20.B09.1.454.CMB.1.raw
  modified_base (240)..(240): a, c, t, g, unknown or other
  misc_feature (240)..(240): n is a, c, g, or t
  modified_base (409)..(409): a, c, t, g, unknown or other
  misc_feature (409)..(409): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccacccgtcggtgtctgtgtcctcaggacagacggccaggactcacctgctcgtggcgatgcattcgaaccaaaaanatatgactttacgtggtaccagcaaggacggccaggccgacggcccttggtcgttaggtagtaattttaagtaaagtactttggagacggccctacgacgggacccctaggacgacgtattctcgtcggctccgagtctacgacgggacctacagtccacgttcgactntcgagtcggacgtccggacgaggacggacgacggtctaagtacttaagttctcggtactacgtccgacgaacgtacgacggtacgaggtcggtacgtagtttacgtcgggttacgtacgggtcgggaccgggtagggtaccctacggtaccgttacggtacccggttccgttaacggcccgtaccggacccggtaacggtcccgtccccggtacccccggttcgtacccgg

SEQ ID NO: 75393 - DNA, 673 bp, Homo sapiens
  misc_feature: GYAE6OF02GO5RB.49.20.B09.1.454.CMB.1.raw
  modified_base (234)..(234): a, c, t, g, unknown or other
  misc_feature (234)..(234): n is a, c, g, or t
  modified_base (296)..(296): a, c, t, g, unknown or other
  misc_feature (296)..(296): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcatgcattcgaccaaaaanatatgcttactggtaccagcagacggccaggccacggcccctgtcgttggtagtattttaanaaagtctttaggagacggtccctcgacgggtacccctggacgcgtattccgtacgtcgggcctaccgagtcctacggaagggtaaccaaacgtacggttaccctaccgttacggaacccctagttaccgtaaggtcggggtaacggtaccccgggacccgaacgggaacgggaaccgggacgggtccttaacggtaaccgttaacgtttaaccgtcggttacgacggttcccgacgaacgtacgaggtacctagggtcggacgttaggtttactcgggttacgtacgttcgggacggacgggtactacggcgttacggtacccgtacgttacggacgtaccggaccgtacggtcctcccggtccccggttaggtccc

SEQ ID NO: 75394 - DNA, 757 bp, Homo sapiens
  misc_feature: GYAE6OF02ILDLK.49.20.B09.1.454.CMB.1.raw
  modified_base (605)..(605): a, c, t, g, unknown or other
  misc_feature (605)..(605): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctagtgagctgacacagtcaccctcggtgtctgtgtcctcaggacagacggccaggactcacctgtcctcgtggcgatgctattacgaacccaaaaacaattacgtcgtacctttaacgttacggtaaccagacaggacggaccgacggccgaccggtcccctgttccgttgggtacgttaagttttaaagtaaaacggttacgttttacggaacggtaccgggtcccccgttacggaacccggggtaccccctgggtaaccgtacggttacttccgttaccgtcggtcccttaccgtaccgtccgtaccgaacgggtaaacccaaacgtaccgtaccgttaacccgttaccggaaccctaacggttacgtagggtacgggtacccgggtcccggtaccgaagggacgggaacgacggtacgtacgtacttagttacgtacgtaccgacgtcccganaacgacctaggtacgtaggtcgtacgttaggttacgttacggttcggttaacggtcggggtacgggtacggtaccgtacggcgttaccgtaccgtacggtacgtaccgtaccgacccggtacggtcccgtcccgttacccccgtcggtaccc

SEQ ID NO: 75395 - DNA, 566 bp, Homo sapiens
  misc_feature: GYAE6OF02I7MI4.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtaccagcagaggccaggccacggcccctgtcttgggtgtatttaagtaaagtactttgagacggccctacgacgggacccctgacgcgattctctggcctcagctacgaggacaacacgtccaccttagacctatacgagtacggacggtccggacgaggaggacgacggctacgacttagttactgtcacgtccgcaggacaggcaggtgactagttatggttacgtacggttacgggacgggtaggacgtacggcgttacggaccgtccgtacggaccgtacggacccgaggtcctccggtccccgtggtacccg

SEQ ID NO: 75396 - DNA, 788 bp, Homo sapiens
  misc_feature: GYAE6OF02FLPBA.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctcgtggctatgcattcgaccaaaaactaatatcgtcttacgtggtaccagcagacggccacggccacggtcccctgtcgttggtacgtatttaaagtaaacggtacttttaggaaggtacgggtcccctacggaaccggggttaaccccctttaagggaccgttatttccgtacggttcggtaccctccgtaacggtccttaccggaaacggggaacctaaacggtacggttaccctaaacccgttttacgaaccctaacgtccgtaaggggtacgggtaacggtcccccgggtaacgaacggggaacgggtaccggaacgggttccgtaacggttaaccgtttaacgtttaaccgttcggtaccgtaacggtacccgtagtaaccggaacgtacggtacgtacgggttcggtacgtttaaggttacgttacgggttcggtttacggttacggggcccgggttaagggtaccgttaccggtcggttaacccggtacccggttcccgttaaacgggttcccgaaccggtacccggtaacggttcccgtacccgtcccccggttacggttccgtacccg

SEQ ID NO: 75397 - DNA, 549 bp, Homo sapiens
  misc_feature: GYAE6OF02GM382.49.20.B09.1.454.CMB.1.raw
  modified_base (439)..(439): a, c, t, g, unknown or other
  misc_feature (439)..(439): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattcgaccaaaaacatatgcttactggtaccagcagacggccaggccaggcccctgtcttggtgtatttataaagtactttgagacggccctcgacgggacccctggacgcgtattcctctggctccagctacgagggacaacagtcaccttgacctatcagtcggacgtccggccaggacggacgaggctagactattactgtcagtccgcagacngactaggtggactagttagtgttacgttagttcgggcgggtacggacgtacgtcgtaggacccgtcgtacgttcgacgtacccgacggcctccgtcccccgtcgtacccg

SEQ ID NO: 75398 - DNA, 863 bp, Homo sapiens
  misc_feature: GYAE6OF02IQ6C1.49.20.B09.1.454.CMB.1.raw
  modified_base (190)..(190): a, c, t, g, unknown or other
  misc_feature (190)..(190): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctcgtgacggcctctatgagctgacacagtccaccctggtgtctgtcgtccgtanacggacacgaccggccgaggactccgaccgtgccttcgtgggacgtatcggacctagttaccgaaacctaaaaactattacgtacgtaccttaaccgtacggtaaccgacgtaccgaacggaccggacccgtaacgggccccgtaaccggtccccccgttggtttaccggttttagggtacgttaacgtttttaaacgtaaaccgttacggttttacgggaacggtaccccgggttccccgttaacgggtaaccccggggttacccccgttaggtaaccggtaccgttaaccgtttcccggttaccggttcggtacccgttacccggacggttaccgtaccggtaacgggtaacctaaaccgtaccgttacccgtaacccgttaccgaaccctacgttaccggtagggttaccgggtacccgtaccccgggacggaacgggtaccgggtaacggtaccgggtacttaaccgtaacgttttacgttacgtcgttaccgtacggtacccacgtaacgaacgtacgtaccggtggtcgggttaacttagttacgttcggtacggttaggcgggtaccggtaacgccgttaccggtcggttaacgtaccggttacgaccggtaccgtaacccggaccggttaccgccccgtacccggttccccgttacggtaccccg

SEQ ID NO: 75399 - DNA, 760 bp, Homo sapiens
  misc_feature: GYAE6OF02HYGQK.49.20.B09.1.454.CMB.1.raw
  modified_base (312)..(312): a, c, t, g, unknown or other
  misc_feature (312)..(312): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctcggtgtctgtcgtcctcaggacagaccggccaggactccaccttgcctcgtggcgatcgctattgaacctaaaactaatatcgtacttacgtggtaaccaggccaaggacggccacggccacggtccccttagtcgttggttnaattttaagtaaaacgacgttttggacggacggtcccgtacgaccgggtacccctaggcgacgtacttcgtcgtacggctcctaagcctaggacggaaccaaacgttcgtaccctaaccgtttacgaaccgtgtaaccggtagggttaccgggaaccggttccccgggaacgtaaacgggaacggggaacgaaccgggtactcggtaaactttaactaaccggttggtaccaaccggttccgactaaaccggaacgtacggtaccgagggtacgtaccggttaagtttacgtacgggttacggttttacggttacccggggacggggttaacgggtccttaacgggtacccggttaccggtaacccggttccgggttaacgtcccgggaccggtacccggtaaccgggttacccggttccccggtacccccggttacttaaccccggg

SEQ ID NO: 75400 - DNA, 653 bp, Homo sapiens
  misc_feature: GYAE6OF02GS6Z0.49.20.B09.1.454.CMB.1.raw
  modified_base (175)..(175): a, c, t, g, unknown or other
  misc_feature (175)..(175): n is a, c, g, or t
  modified_base (223)..(223): a, c, t, g, unknown or other
  misc_feature (223)..(223): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagcccaccctggtntctgtcgtcctcgaggacagaccggccagtactcacctgctcgtgganatgctattcgaccaaagcaaatatgtcttacgtcggtaccagacaagaacgccgaggccacggtcccctgtcttgatactaattaataaagtctttggacgacggtcctacgacggacccctgacgcgtattcgtcgtacggccttaccgagcctacgacgtaccgaacaaccgtagtaccgtacggttacacctagtcgaacgggtggaccgggtcccggagaacgggtacgggacggagggtacctaggtaacctttacttacgtcgtactacggtactagtacgagacgtaggttacggtcgtaccttacgtttacgtcggtaccggtttagttccggggacgggtaaccggtaaccgtggaaccgttcccggtaccggttaccggtacggaccgtacgggacccctaccgggcccgttcccccggg

SEQ ID NO: 75401 - DNA, 512 bp, Homo sapiens
  misc_feature: GYAE6OF02FJIW0.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatctatttataaagacttttgagagggcctcgacgggacccctgagcgattctctggctccagctcagcgacaacagtcacgttgaccatcaggtggagtccgggcaggaggacggaggctaggacttattactgtcagtcatcagacagtagtgctacttcttgtcgttagtcgggcggtaagggaccaagctacggaccgtcgtacggtccacggcccgaggcctcccgg

SEQ ID NO: 75402 - DNA, 661 bp, Homo sapiens
  misc_feature: GYAE6OF02IEIY2.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagcaggccaggcccctgtcttggtgtatttataaagtactttgagtacggccctacgacgggacccctgagcgtattcctctcggctccagcctacgaacgggaacaacgacgtactaacccgtttcgaaccctaagttacacggtacgggtacggtccccgggaccgaacgggaacggggaaccggaggggtccgtacgtaacgttaactttacgttcgttacgtaacggttcccgaccgaacggaccgtaaggaccgtaaggtcgggacgttagtttaacgttcgttacgttaagtttccgggacgggtacgggaaccttacggcttccggtaacccggtcgttacggtaccgacggtaccccgaacgggtacccgtccggtaccccccgtcggttaccccg

SEQ ID NO: 75403 - DNA, 668 bp, Homo sapiens
  misc_feature: GYAE6OF02IMNNX.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtgtctgtgtcctcaggacagacggccaggactcacctgctcgtggcgatgcattgaccaaaacatatgacttacgtaggtaccagacagacggaccaggccacggccccttagttcgttggtacgtaattttaaagtaaagtaccgttttagaacgtacggaccctacggacggaccccttaggaacgcgtaacttccgtcgtcgggacctaccgacgtcctacgaacgggtaacaaacgtacgtacctaccgttacgacctacgtaccgtacggtggtacggtccggaccgaacggagggaacggaggacgtagactttaaacgtttaccgtacgtacgtacggtcccgacgaacgacgacgacgtacggtggtacgtagtttacgtcgttagtacgttcgggacgggtacgggtacgtacggtaccgttacggacccgttacgtacgtacgacggtacccgaaggtccctcccggtcccccgtggtacccg

SEQ ID NO: 75404 - DNA, 627 bp, Homo sapiens
  misc_feature: GYAE6OF02J24VI.49.20.B09.1.454.CMB.1.raw
  modified_base (191)..(191): a, c, t, g, unknown or other
  misc_feature (191)..(191): n is a, c, g, or t
  modified_base (233)..(233): a, c, t, g, unknown or other
  misc_feature (233)..(233): n is a, c, g, or t
  modified_base (500)..(500): a, c, t, g, unknown or other
  misc_feature (500)..(500): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcacaggctctgaggcctcctatgagctgacacagtcaccctcggtgtctgtgtcctgaggacngacggccagatcactgctctggcatgccattcgaccaaaacnttatcgacttacgtggtaccagcgagacggccaaggcccgacggccccttgtcgttggtagtatttaataacgtgtttagacgtacggccctacgtacggaccctggtacgcgtctttacgctcggtcctccagtcctcgaacggtactaacgtacgtaccgtacgttaccgaacgactagacggtggacccggtcgacggaggacggacgaggtaccgtgtaacgttcgttacgtcggttaacgacgttaccggacgacggtaacncggacttacgggtgtacgttagtttacgtgtaccggttagtacgggaccggtaggtaccgtaccgtacggtcgacccgttacgtcggtaccgacccgtacggacctccgtacccgtccgtctacccg

SEQ ID NO: 75405 - DNA, 684 bp, Homo sapiens
  misc_feature: GYAE6OF02I5LAB.49.20.B09.1.454.CMB.1.raw
  modified_base (133)..(133): a, c, t, g, unknown or other
  misc_feature (133)..(133): n is a, c, g, or t
  modified_base (164)..(164): a, c, t, g, unknown or other
  misc_feature (164)..(164): n is a, c, g, or t
  modified_base (177)..(177): a, c, t, g, unknown or other
  misc_feature (177)..(177): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcanaggctctgaggcctcctatgagctagacacngtccacctcggtntctgtcgtcctcgaggacaggaccggaccaggactccacctgcctcgtggcgatgctattcgaaccaaaactatatcgtacttacgcggtaaccagcgaaggcgcgacggccacggtccctgtcgttggtactaatttaagaaacgtacgtttaggacggtacggtaccccttacggacccgggtaccctaggacggtacgtacgtttccgtcgtcgggacctaccgcgtaccgtacgaaacgggacctaacgtacgtcctacgttacgacctacgtcgaaggtcggaccggtccgaacgtagggacggtaggacgtcgtacaacgttacttacgtgtacctcggtaccacggtaacgaacgaggacgttaggtcggaaccgttaaggttatcggtttacggtaacggtcggggaacggacgggtaacgtaccggtacgtaccggtaccgtacgaccggttccaaccggtccggaaccgtcccgtcccggtaccccgttaggtaccc

SEQ ID NO: 75406 - DNA, 617 bp, Homo sapiens
  misc_feature: GYAE6OF02FQ6DZ.49.20.B09.1.454.CMB.1.raw
  modified_base (361)..(361): a, c, t, g, unknown or other
  misc_feature (361)..(361): n is a, c, g, or t
  modified_base (447)..(447): a, c, t, g, unknown or other
  misc_feature (447)..(447): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtcgtcctcaggacagacggccaggactcacctgctctggcatgcattgaccaaaaacaatatgcttactcggtaccagcaagacggccaggccacggcccctgtccttggtgtaatttataaacgtactttaggagacggtccctcgacgggtacccctggagcgtattctcgtggcctccngctcgaaggacaacacgtcaccttcgaccatcgagtggacgtccggacgaggacggacgaggctacggacttagttactcgttacncgtccgacagacacgcgaagtcgacttaggttattcggttacgtacggtttcgggaccggggtacggaccgttacgggtcctacgggtaaccccggttcggttaacgggtcctaacccgggaccccgtaaagggtccccgtacccggtccccccggttacgggttacccc

SEQ ID NO: 75407 - DNA, 712 bp, Homo sapiens
  misc_feature: GYAE6OF02H6131.49.20.B09.1.454.CMB.1.raw
  modified_base (132)..(132): a, c, t, g, unknown or other
  misc_feature (132)..(132): n is a, c, g, or t
  modified_base (283)..(283): a, c, t, g, unknown or other
  misc_feature (283)..(283): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcanaggctctgaggcctcctatgagctgacacagtcaccctggtgtctgtgtcctcaggacagacggccaggatcacctgctctgcgatgcattgaccaaaacatatgcttactgtaccagcagacggccaggccacggcccctgttcttggtntattttaataagtactttgagacggccctcgacgggacccctggacgcgtacttcgtcgtcggcctaccgacgtccgtacgaacggggaacctaaacgacgttacctaaccgttcggaaccctaacgttaccgaggtacgggaaccggttccccgggaccgtaacgggaacggggaacgggacggggtaccgttagggtaaccttttaacgttaaccgtttagtaccgtaaccggttcccgacgaaaccggacgaacggaccgtagtacgggcgttagtttaacgttcggttacggttaaggtttccggggacgggtacgggttaccgttaacgggccgttacggtaaccccggttccggttaaccggtccgtaccggtaccccggaaaccggttccgtaccccggttccccccggtcggttaaccccg

SEQ ID NO: 75408 - DNA, 608 bp, Homo sapiens
  misc_feature: GYAE6OF02FOKNL.49.20.B09.1.454.CMB.1.raw
  modified_base (284)..(284): a, c, t, g, unknown or other
  misc_feature (284)..(284): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactggtacagcagaggccaggccaggcccctgtcttggtnatttataaagtctttagaggacggccctcgaacgggacccctggacgcgtattcctcgtcggctccgagcctacgaacgggtaccaaacgacgtcctaaccgttcgaaccagtcgacggtaggacgtccggaccaggacgggacgaggctagtaacttaagttacgtcgtacgacgtcccgcgtaacgactaggctaggtggacctagttagtcgttacgtacggttacgggcgggaggtaccgtacggtcgtacggtacccggttccgtaacgggtccaaccggcccggtaaggcccgtacccggtcccccgtcggttacccg

SEQ ID NO: 75409 - DNA, 809 bp, Homo sapiens
  misc_feature: GYAE6OF02JXWRG.49.20.B09.1.454.CMB.1.raw
  modified_base (177)..(177): a, c, t, g, unknown or other
  misc_feature (177)..(177): n is a, c, g, or t
  modified_base (220)..(220): a, c, t, g, unknown or other
  misc_feature (220)..(220): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccgttcggtntctgtgtcctcaggacagacggccaggactccacctgcctcgnggccatgctagttacgaacccaaaaactaatagttacgtacttacgtacggtaccagaccgaggaacggccgaacggccgaccgggtccccgtgttccgtttagggtagttaacttttaaagtaaacgtacgtttaggaacgtaccgggtaccccgttcggaaaccggggttaccccgtaggtaccggtaccggtaacgttttccgtcggttccggtccgttaccgaacgttcccgtacggaaacggggtaaccaaacgtacgtaccgttaacccgtgaaccctaagtcgtaaacggttgggtaccggtacccggaccggaacgggaacggggaccggaacggtacgttacggacttaacgtttacgtaccggttagaacccgtaccctaacggtaaggaccgaaggtcgttacgtacggggtacttaagggttttacgtacggtttaggtaaaccgggttcgggtacgggtacgggtaaccgtaccggttaccggttacccggtaacccgttccggttaacggcccggttaacccggaccggttaacccgggtccgttaccccccggtccccggttacggttaacccc

SEQ ID NO: 75410 - DNA, 771 bp, Homo sapiens
  misc_feature: GYAE6OF02I5JFK.49.20.B09.1.454.CMB.1.raw
  modified_base (180)..(180): a, c, t, g, unknown or other
  misc_feature (180)..(180): n is a, c, g, or t
tcagagtcgagagacacgaccggtgctcgatttagtgtagtgtgaagggggctgtgggtccaggaggcagaactctgggtgtctcaccatggcctggatccctctacttcctcccccctcctcactctctgcacaggctctgaggcctcctatggagctagacactagtccaccctggtntctgtgtcctcgaaggaccaggacggccaggatccaccgtgctcgtggaccgatgcattcgaaccaaaaacatatgctttacgtggtaaccagcagacggccaggccgacgtccccgtagtcttggtagtaattttaagtaaaacgtaccgttttaggaaggtaaccggtcccgtcgtaaccggggaacccccccttaggaacggtaccggtaacttttccgttaccgttacggggacctttacccgacggcccgtttacggaaacggggtaaacccaacgtaacggtaccctaacccgtttacgaaccctagttaccaagggttacggggacggttccccgggaacgtagggaacggaaccgggtaaggaccgtaacggtaaccgtttaaagttacgtacgttacgtaacgggttccccgaagaaccggaacgtaacgaccggtaggtaacgggtcctaagtttacggttacggttacggttaacgttacggggacgggtacgggtaaccgtaccggcgttaccggtaacccgtacggttaccgttacgaccggaccgtaaccgccgtacccgtaccccggtcgtaaccg

SEQ ID NO: 75411 - DNA, 687 bp, Homo sapiens
  misc_feature: GYAE6OF02IX5NU.49.20.B09.1.454.CMB.1.raw
  modified_base (174)..(174): a, c, t, g, unknown or other
  misc_feature (174)..(174): n is a, c, g, or t
  modified_base (219)..(219): a, c, t, g, unknown or other
  misc_feature (219)..(219): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgagcctctatgagctgacacagtccaccctcggtntctgtgtcctcgaggacaggacggccaggatccactgctcgtggntatgctattcgaaccaaaaacaatatcgtacttacgtacggtaccagcgaggacggccacggccacggtccccctggttcgttgggtagttattttaagtaaagtacgtttgacggacggtcccgtacggaccgggtacccctggtaccgaggtacttccgtcgttcggtcctccgagtccgttacggaacgggtaaccaacgtagtccctaaccgtttacggaccctaacgtcgtaagggtcggtaccggtacccggtaccgaacgggaacgggacgggtacgggtctaacggtacttaacgtttaccgtgttacgtaaccgtccgtacaaacggtcaacggcgtaggtcgagtagttcgtgttacgtaggttcgggacggtacggtacgtaccgtcgtaccggtaccgttaccggttaccgtacgaccgtaccggaaccggtcgtccccgcccgtccggttacccg

SEQ ID NO: 75412 - DNA, 768 bp, Homo sapiens
  misc_feature: GYAE6OF02HVCGN.49.20.B09.1.454.CMB.1.raw
  modified_base (249)..(249): a, c, t, g, unknown or other
  misc_feature (249)..(249): n is a, c, g, or t
tcagagtcgagagacacgaccggtgctcgatttagtgtagtgtgaaggggggctgtgggtccaggaggcagaactctgggtgtctcaccatggcctggatccctctacttctccccctcctcactctctgcacaggctctgaggcctcctatgagctgacacagtccacccgtcggtgtctgtcgtcctcgaggacagaccggccaggatccacctgacctcgtggcgatgcctattcgaaccaaaaanatatcgtacttaacgtcggtaaccagccgaaggacggaccgagggcccgaccggtccccgttggttcgtttgggtagttaaactttttaaaggtaaaacggttaccgttttaggacggtaaccgggtccccttacggaaccgggacccctaggaacgcggtaatttccgtcgtcggcctcgtacgccttacggaagggaaccaacgtacgtaccgtaaccgtttccgaacctacgtacgtaacgggttacgggtacccgggtaccccgggtaccgaacgggtacgggaaccgggaacgggtacggtaacggttaaaccttacggtttaacgtacggttaccgtaaccggttccgaccgtacggaacgtacgtacgtacgggtaccggtcgttaacggtttcgttacggtacggttacgttaccggggacgggtacgggtccgtacggtcgtccggttaccgtaccggtacggtacctacggcccgaaccggtcccgtacccggtccccgtacgtacccg

SEQ ID NO: 75413 - DNA, 572 bp, Homo sapiens
  misc_feature: GYAE6OF02GCRXI.49.20.B09.1.454.CMB.1.raw
  modified_base (202)..(202): a, c, t, g, unknown or other
  misc_feature (202)..(202): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacgcaggntcactgctctggcatgcattcgaccaaaaacatatgacttactggtaccagcaagaggccaggccacggcccctgtcttggtgtatttaataaagtactttagagacggccctgacggccctagagcgtattctctggctcagctcgaggacaactagtcaccttgacctatcgagtggacgtccgccaggacggacgaggctagacttattacgtcgtacgacgtccgacgaacgtacaagcaggtcgacgtagtttagtcggttacgttacgtacgggacgggtacggacgtaacggtcgtacggtacccggtaccgtacggtacgaaccggtcccaacgggtaccttccggtccccgtacggtaccc

SEQ ID NO: 75414 - DNA, 695 bp, Homo sapiens
  misc_feature: GYAE6OF02G5YG2.49.20.B09.1.454.CMB.1.raw
  modified_base (177)..(177): a, c, t, g, unknown or other
  misc_feature (177)..(177): n is a, c, g, or t
  modified_base (189)..(189): a, c, t, g, unknown or other
  misc_feature (189)..(189): n is a, c, g, or t
  modified_base (242)..(242): a, c, t, g, unknown or other
  misc_feature (242)..(242): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtcacccgtgggtntctgtcgtccanaggcaggcgcaggatccacctgctcgtggcgatcgactagttcaaccaaaaanatcgtcgtacttacgtcggtaccagacaggacggccgaggcccgacgggtcccctggttacgttggttattaactttaaagtaaacgttcgtttaggaaggaccggtcccgtaggacccggaacccgtgacgtacgtacgttccgtcgtacggccttaccgacggtaccgtacgaacgggtaaccaacgttaccggtacctaaaccgttcgaaccttacgtacgtacggtacggccgtacccgggaacgtaagggacggaacggacgtccgtaacggtactttaacgttacgtacgttacgtaccggttaccgaccgagtaccgaggacgtaggtgtaccgtagttaccgtggttacgtaaggttcgggaacggtacggtacgtacgtcgtaccggtacgtccggtacgtacgaccgtaccggacgtcccgtccggtacccctggttaacccg

SEQ ID NO: 75415 - DNA, 713 bp, Homo sapiens
  misc_feature: GYAE6OF02HTIWZ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcacccgtcggtgtctgtgtcctcaggacagaccggccaggactcgacctgctctggcgatcgcattcgaccaaaacatatgacttacgtcggtaccagcaaggacggccgaggcccgacggccccttggttccgttgggtgttaattttaacgtaaagtacgtttaggaggacggtcccctacgaacgggacccctggacgtcgtacttctcgtcggtcctaccaggtcctaacgtacgggaaccaacgtacgtccctaaccgttaccgaaccctacgttaccgaggttaccgggaaccggttccccggaacgacggacgggaccggaacgggtccttacggtaaccgttaacgtttaccggttacgttacccgtacggttcccgacgtaacgaccgtagtaccgtaggttcggacgttaaggtttagttcgggttacgttacgttcggggacgggtacgggtacgtaccggtccgtaccggtaccgttaccggtacggtccgaccggtaccgaacggtcccgtacccgtacccccggtcggttacccg

SEQ ID NO: 75416 - DNA, 737 bp, Homo sapiens
  misc_feature: GYAE6OF02H9F39.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacaggacggccaggactcacctgctctggcgatgcattcgaccaaaacattatgcttacgtcggtaccagacgagacggaccacggccacggtcccctgttccgtttgggtagtaattttaagtaaaggttacgtttaggacggaccggtccccgtaccgtaaccggggacccctaggacgacggttacttcctacgttcggccttaccgacgtaccgtaccggaacgggaaccgaaaccgtacgtaccctacccgtttacgaacccgtaacttacggtaggtacgggtaccggaccccgggaccggtaacgggaacgggaacggacgggtaccgttacggtaaacctttacgttaaccgttcggtaccgtaacggttcccgaacgtagaccgagaccgtaaggtcggtacgttaagttagttacggttacggttacggtacgggtaccggggacggttaccgtaccggtccggtaccgggtaacccggtccgttacgggtacgacccggacccggtaacgccggtacccgtccccggtcgtacccg

SEQ ID NO: 75417 - DNA, 545 bp, Homo sapiens
  misc_feature: GYAE6OF02FMNQT.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgacccaaaaaacaatatgcttactggtaccagcagaggccaggccaggcccctgtcttggtgatttataaagactttgagacggccctcgacgggacccctgacgcgattctcgtggctccagctcgacgggacaacgagtcaccttgacctagtcagtcggacgtccggccaggaggacgacggctgacttattactgtactacgtccgcgacgtacgagacgtagtggactagtttagtgttacgttagttcggacgggaggacgtacgcgtcgaccgtcgtaggtcgacgccgaaggcctcgtccccgtcgtacccg

SEQ ID NO: 75418 - DNA, 929 bp, Homo sapiens
  misc_feature: GYAE6OF02IV0LL.49.20.B09.1.454.CMB.1.raw
tcagagtcgagagacacgaccggtgctcgatttagtgtagtgtgaaggggctgtgggtccaggaggcagaactctgggtgtctcaccatggcctggatccctctacttctcccctcctcactctctgcacaggctctgaggcctcctatgagctgacacagtcaccctcggtgtctgtgtcctcaggacagacggcaggatcacctgctcgtggcgtatgcattcgaccaaaaacagttatcgtacttacgtcggtacctaagaccgaggaacggccgaacgggccctaacgggccccccttggttaccgtttcggggttataacgtttttaacttaaaaacggtaccttttagggaacgtaaccgggtaccccgttacgaaaccgggggtaacccccttggtaacggtacccgtaaacggttttaccgtaccggtttacgggtcccgttaccccgtaaagggtcccgtttaacccggtaaaacggggggaaacccttaaaaccgtaacggggtttacccccttaaacccggttttaccggttaaaacccaaccggttaccgtaaacgggtttaccggggtaaacccggttaccccgggtaaccccgaaacggggttaaacggggaacccggtaaaccggggtctttaaccgggtaaaccttaaacgggtttaccgtttaaaccggtcggtttaaaccggccccgggtaacctaaccgggttaacgaaacccggggtaccttaaacccggggttgggtaacccttaaagggtttaccgttaaccgggtttaggttaaccgggtttaccggaccgggggtacgggtaacgttaccggtaacggttaccggtacccgggtaactttaacgggtaccgtacggtacccggaaaggttccggtaacccggttccccggtacccggttacccgg

SEQ ID NO: 75419 - DNA, 715 bp, Homo sapiens
  misc_feature: GYAE6OF02G4Y2R.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgctattcgaccaaaaacatatgtacttactcggtaccagcaggaggccaggcccaggcccctgttcgttggtagtatttaataaagtactttggaaggacggtcccgtcgaaccggggtacccctggacgccgtactttccgtcgtcggccttccagtcctacgaacgggaaccaacgtacgtacctaaccgtttcgaaccctagtccgaggttacgggaccggttccccgggaccgtaagggaacgggaccggtagggtccttaaggtaacctttaactttacgtcgttacgtaacggtcccgtacgacggtaaccgaggtaccgaggtacggtacttaaggtttacgttggtttaccgttaacggttccggggacgggtacggtaccgtaccggtccggttacggtacccggttaccgttaacggggtacccgtaaccggtaccccggaaccggttcccgtacccggttaccccccgttacgggttaaccccg

SEQ ID NO: 75420 - DNA, 511 bp, Homo sapiens
  misc_feature: GYAE6OF02FIAGS.49.20.B09.1.454.CMB.1.raw
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagaggccaggccaggccccctgtcttggtgatttataaagactttgagaggccctcagggacccctgagcgattctctggctccagctcagggacaacagtcaccttgaccatcagtggacgtccggccaggacgacgaggctgactattactgtcagtccgcagacagcagtgntagttangtcgtagttggcggagggactacgcgtgacccgtccgtaggtcacggcccaaggcctccgtccccgtcggtaccc

SEQ ID NO: 75421 - DNA, 530 bp, Homo sapiens
  misc_feature: GYAE6OF02FIZO6.49.20.B09.1.454.CMB.1.raw
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccaggccccctgtcttggtgatttataaagtctttgagacggccctcgacgggacccctgacgcgacttctctggctccgagctacgagggacaactagtccacttgaccatcagtggacgtccgcagngacgagctgacttattacngtacacgtcgacagacagcaggtgactagttatcgtactagttcggacggtagaccgtacgcgtcggacccgttacgtagtccacgacccgaaggtcctccgtccccgtggtacccg

SEQ ID NO: 75422 - DNA, 888 bp, Homo sapiens
  misc_feature: GYAE6OF02IDO4D.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctcctatgagctgacacagtccacccgtggtgtctgtcgtcctgaggacagacggccaggatcacctgctcgtgggcatgactattgaaccaaaaatatatcgtacttaacgtggtaaccagacgaagacggaccacggaccgtacggtccccgttgtccgtttagggttacgttaaagtttttaaaacgtaaaaacggttcgttttaggaaccggtaccggtacccccgttacggtaacccgggggtaacccccttggaaccggtcgttaaccgtttccttaccggtcggtacctacccggtaacggtacctaccggaaagggtaaccaacgtaacgttaccctaaccgttacgaaccgtacgtacgtaagggttccggggtaacgtaccccgggaacgtaaagggaacggggaaccggtaacgggtaccgttaacgggtaactttaaacggtttaaccgtttacggttaaccgtaacccgggttaccgaaccggtaaccggtaacgaacgggtaccgtttaaggggtaacccggggttaactttaacgggttttaacgttccgggtttaacggttacgggtttaaccggggacggggttaaacgggttacccggttacgggtaacccggtttaaaccgggttacccggttacccccggttaagggttacccgaaacccgggaccccggttaaccgggtaccccgttcccccggttaccccccggttacgggttaacccccg

SEQ ID NO: 75423 - DNA, 722 bp, Homo sapiens
  misc_feature: GYAE6OF02I4IP0.49.20.B09.1.454.CMB.1.raw
  modified_base (186)..(186): a, c, t, g, unknown or other
  misc_feature (186)..(186): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggatcacctgctcgtggcgatgcattgaaccaaaaacagtactgtcttactacggtaccagcagacggccacggccacggcccctgttctttcggtgattttaacgtaaagtacgttttagaggacggtcccgtcgaaccgggacccctagacggtaccgtagttccgttcgttcgggtccttacccgacgtaccgttacgaaacggggtaactaaaaccgtacgttacccaacccgtttaggaaccccgtaataccggaggttaccggaacggtcccggacccgtaacggagggaaccggacggtacgtagtaacctagtttacctacgttaccgtacgggtccctacgacggtaacctacggacggtaggtaacggtaccgtaagtttacgtagtttaccggttaggtaccgggttcgggaaggtaccggtaaccggtcggttacggtaacccgttcccggttacgggtacgacccggttaccgaaccggtccgtccggtacccccgttcgggtaacccc

SEQ ID NO: 75424 - DNA, 706 bp, Homo sapiens
  misc_feature: GYAE6OF02GRT44.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctctcactctctgcacaggctctgaggcctcctatgagctgacacagtcaccctggtgtctgtgtcctcaggacagacggccaggatcacctgctctggcgatgcattcgacctaaaaacatatgacttactcggtaccagcagaggccaggccacggcccctaggtccttggtagtaactttaagtaaacgtacttttagaggtacggtccccgttacgaaccggggtacccccttggaacgtaccggtatttacccgtcgttcggggtccttacccgaggtccttacggaacggggaaccaaaccgtacggttacctaacccgtttcgaaccctaagttaccgtaacgggttcgggaacggttacccgggaccgaaggtaacgggaaccgacgggtccgtaggtaaccttagttaacgttcgtacgtacgttccgacgtaggacacgacgacggtcgaccgtagtttagtcggttacggttcgttacggggaccggtacggggtacctacggtccgttacggtacccggttaccgttacggtacctacggtacccgtaacggccgttcccgtacccccgttgttacccg

SEQ ID NO: 75425 - DNA, 595 bp, Homo sapiens
  misc_feature: GYAE6OF02G1JLZ.49.20.B09.1.454.CMB.1.raw
  modified_base (292)..(292): a, c, t, g, unknown or other
  misc_feature (292)..(292): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggatcacctgctctggcatgcattgaccaaaaacatatgcttacgtggtaccagcagacggccaggccacggcccctgtcttggtgtatttanaaagtactttgagacggtccctagacgggacccctgacgcgtattcctcgtcggcctccagctacgaacgggaaccaaacgacgtctacccgttcgacctatccgagtcggacgtccggcgaggacggacgacggctacgtacttagttacgtcgttacgacgtcccgactaacggacgaggacgtaggtacggtcgttaagtttagttcggttacggtagttcgggacggtacgggactacggcgtacggaccgtccgtaggtcacgtacccgaacggtccgtaccgtcccccgtagtcccg

SEQ ID NO: 75426 - DNA, 652 bp, Homo sapiens
  misc_feature: GYAE6OF02HMD8F.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtcgtcctcaggacagacggccaggatcacctgctctggcgatgcattgaccaaaaacatatgcttactggtaccagcagacggccaggccacggtccccttgtcgttggtagtattttaagtaaacgtcgtttggacgtacggtccctacgaacgggtacccctggacgcggtacttctcgtcggcctaccgagtacctcggaacgggtaaccaaacgtacgttacctacccgttacgaacccgtatacgacggttcggacggttccccggacgaagggacgggtaacggaggtccgttacgaacgtttaacttaacgtcgtacgtacgtcccgtacacgaactaggactaggtggtacgtacgtttagtcggttacggttacgttcgggacgggtacgtacgtacggtcgtccggtaccgtcggtacggtaccgacggacccgacggtcccgtccgtcccccggtgtacccg

SEQ ID NO: 75427 - DNA, 832 bp, Homo sapiens
  misc_feature: GYAE6OF02ISGWI.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggactcacctgcctcgtggcgatcgctattcgaacctaaaaaactattactggacttttaacgtcgggttaacccaaggccgaacggacgggaccgacgggtaccaacggggtcccccttggtttccgtttaggggtagttaactttttaaagtaaaacggttaccgtttttagggaacggtaccggtcccccttacgtaaccgggggacccccttggaccgtaccggtaactttcgtcgtcgggacctccgtaacgtcctacggtaacgggaacctaaacgtacgtacctaacctttacggaaccctaagttccgtaaggttacgggtaaacgtccccgggtacgaagggtaccgggtaacggtaacgggtccgttaacggtaacgtttaacgtttaaccgtcggttaccgttacggttacccggtacgaacggacgtaacggtaccgttagggtacgggttacgttaaggtttacgttcgggttaccggtttaacggttcggggacgggttacgggtaacccgttacgggaccgtttacccgggtaaccgttcccgggtaacggttaccgtaacccggtacccgggtaacggtccccgtttccccggtacccccggttcgggttaacccc

SEQ ID NO: 75428 - DNA, 683 bp, Homo sapiens
  misc_feature: GYAE6OF02IPPD1.49.20.B09.1.454.CMB.1.raw
  modified_base (245)..(245): a, c, t, g, unknown or other
  misc_feature (245)..(245): n is a, c, g, or t
  modified_base (561)..(561): a, c, t, g, unknown or other
  misc_feature (561)..(561): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctctatgagctgacacagtccacccgtcggtgtctggttcgtcctcgagggacagaccggccaggactcacctgctcgtggcatgctattcgaccaaaanatatcgtacttacgtcggtaaccagaccgaaggacggaccgaggcccgacggtcccctgttaccgttgggtacgttaattttaacgtaaacggttacgttttacggaacggtaccggtaccccgttaccggaaccggggtacccccgtaggacggtacgtacttttccgtacggtcggtacccttaccgagtcccgtaacgggaacgggaacctaaacgtacgtaccctaaccgttcggaactacgtacgacggtacggacggtccgaccgaggacggacgagtctagtacttattacgtcgtacgtacgtccganacggtacacgtacgaggtcgagttacgttcgtcgttagtacggtcggacggacgtacgtacgcgtccgtaccgtccgtacgtcgacggtaccgacggtccgtacccgtccccgtagtacccg

SEQ ID NO: 75429 - DNA, 729 bp, Homo sapiens
  misc_feature: GYAE6OF02I0388.49.20.B09.1.454.CMB.1.raw
  modified_base (248)..(248): a, c, t, g, unknown or other
  misc_feature (248)..(248): n is a, c, g, or t
  modified_base (320)..(320): a, c, t, g, unknown or other
  misc_feature (320)..(320): n is a, c, g, or t
  modified_base (374)..(374): a, c, t, g, unknown or other
  misc_feature (374)..(374): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtcgtcctcaggacagaccgccaggatcacctgctcgtggacgtatggacctagttcgaaccctaaaaanattatcgtactttacgtcggtaccagcgagacggccgacggccacggtcccctgtcttgggtatactttaanaaagtctttaggaacggccgccctagaaccggtccctaggagtccgaatttccncgtggcctccgaagtcctcgaagggacaaacgcgtacccgacgttacgaccaacttcgacggtacggaccgttcccggaaccggacggtaacgggaccggtaaggtccgttacggtaaaccttaagtttaccgtacggttaccgacggtacccgacgtaaaggaccgacggttaccaagggtttcccgggaacgttacggttaacggttcggtttaaggtacccggggttaggacccggggtaaagggttcccgtaaccggtccgggttaccgaccccggtttaacccggtaggtaccccgaaccggtaccccggtaacgggtccctccccgggtaaccccccggttgtaccccg

SEQ ID NO: 75430 - DNA, 758 bp, Homo sapiens
  misc_feature: GYAE6OF02HWI5S.49.20.B09.1.454.CMB.1.raw
  modified_base (174)..(174): a, c, t, g, unknown or other
  misc_feature (174)..(174): n is a, c, g, or t
  modified_base (242)..(242): a, c, t, g, unknown or other
  misc_feature (242)..(242): n is a, c, g, or t
tcagagtcgagagacacgaccggtgctcgatttagtgtagtgtgaagggggctgtgggtccaggaggcagaactctgggtgtcctcaccatggcctggatccctctacttctccccctctcactctctgcacaggctctgaggcctcctatgagctgacacagtcaccctcggngtctgtcgtcctcgaggacaggacggccaggatcacctgctacgtggcgatgacattgacccaaaaanagtatcgacttacgtcggtaacagcaaggacggaccgaaggcccgacggtccccctagttcgttagggtgtaattttaacgaaagttacgttttaggaacgtaccggtccccgttacgaaccggggttacccctagggacgcgttaacttcgtaccgtcggtacctcctaacggtccgtaacggaacggggaaaccaaacgtacgttacccgtaaccgttaacgaacctacgtacgtacgggttaacgggaccggtaacccgggacgtaacggggacggtaaaccggacggtaccgttagtaacctttaaagtttaaccgttgtaccgtacggttacccggacaaacggacgaagtacgtaacggtggtaaccgtagtttacgttcggtaaccgtttagggttaccgggacgggttaacgggtacgtacggaccggttaccggtaaccgggttccgttaacgtaccggaacggtacccgaacggtcccggtaccggttcccccgttaggttacccg

SEQ ID NO: 75431 - DNA, 594 bp, Homo sapiens
  misc_feature: GYAE6OF02GMXNN.49.20.B09.1.454.CMB.1.raw
  modified_base (236)..(236): a, c, t, g, unknown or other
  misc_feature (236)..(236): n is a, c, g, or t
  modified_base (446)..(446): a, c, t, g, unknown or other
  misc_feature (446)..(446): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtgtctgtgtcctcgaggacagacggccaggatccacctgctctggcatgcattgaccaaaaanatatgtcttactggtaccagcagaggccaggccacggtccctagttcgttggtgtatttaataaagtacgtttgagacggtccctcgacgggtacccctgacgcgtattcgtcgtgctcagtctacgacggacaacgacgtcctacttcgacctagtcgtaggtcggacgtcccggacgacggacggacggagcgtagacttaagttacngttccacgtccgacacgacgagaccgtaggtgactagttactcggtacgttaagttcgggacggtacgggacctacggtcgtacggtacccgtaccgtacggtccgaccgacccggaacggtcccgtacccggtccccgtaggtcccg

SEQ ID NO: 75432 - DNA, 538 bp, Homo sapiens
  misc_feature: GYAE6OF02JGSU4.49.20.B09.1.454.CMB.1.raw
  modified_base (289)..(289): a, c, t, g, unknown or other
  misc_feature (289)..(289): n is a, c, g, or t
  modified_base (360)..(360): a, c, t, g, unknown or other
  misc_feature (360)..(360): n is a, c, g, or t
  modified_base (424)..(424): a, c, t, g, unknown or other
  misc_feature (424)..(424): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacatatgcttactggtaccagcagagccaggccaggcccctgtcttggtgatttanaaagtactttgagaggccctcgacggggacccctgacgcgtattctctggctccagctcgagggacaacgngtcaccttgaccatcagtcggacgtccggcagaggacgaggctgacttattactgtcagtccgnagacgagacgagtgcagttactgtcgttatcgggcggaggtacgtacgtcgtacggtaccgtaccgtaggtaccgacggacccgtaaggccgtccggtacccccgttggtaccc

SEQ ID NO: 75433 - DNA, 727 bp, Homo sapiens
  misc_feature: GYAE6OF02JG1WB.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacaggacggccaggatcacctgctcgtggcgatgcagttcgaccaaaagactaattacgtcgtacgttacgtacggtacgacgacgacggacgaccgacggaccgacccggtccttgttacggttacggtattaacgtttaaagtaacgttacgtttaggaacggtccgtacccgacgggacccggtccgtaggaccgtacgtttacttcgtacggtcgtcctaccggacgttcgaacgggaacggtaaacctaacgtccgtaccttaccggttaccgaaccgttacgtacggtaaggggttccggaccccgggtacccggaacggtaagggacgggtaacggtacggtaccgtacgtttaacgttacgtttacgtcgttaccgccgtaccgagtaacgacgtacgacggtggtacggacgtttagttaacggccggtttaacgggttcggaccggggacgtacggaccgttcggcgtaaccggttacccgtacgacggttccaccggaaccggtctcccggtaccccgtccgttccg

SEQ ID NO: 75434 - DNA, 594 bp, Homo sapiens
  misc_feature: GYAE6OF02G6GGW.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagccaccctcggtgtccagtcgtccccaggacagacggccaggatcacctgctctggagatgcattcgaccaaaccgatatgtcttattggtaccagcagaacgccggccaggcccctgtcgttggtgatgtaataaagacactgaaggacggccctacgagggacttcccgtggaacgtcgatttctcgtggcctaccgacggtcgacgggaccgaacggtccgactaagttcggacctatcgaggtggtacgtccgaaggcaggacggtcggaaggcgtgacttattagttcgactaatacaacacgactaaccgtagtttagtaacttagttcgttcgttacggaactcgtaccgaccgtaacgtcgtaacccggtccgtcgggtaccacggacccaacgacccaacccctacgtccgtacacttacccg

SEQ ID NO: 75435 - DNA, 704 bp, Homo sapiens
  misc_feature: GYAE6OF02HLJBJ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctgaggacaggacggccaggatccacctgctctggcgatgcagttcgaccaaaaacatatgtacttacgtggtaccagcgagacggaccgaggccacggcccctgttcttggtagtatttaagtaaagtcttgagacggcctcgacgggaccctggacgcgtacttctcgtcggcctcgagtcctacgacgggaacaacgacgttccaccgtttacgaaccctagtaccgtacggtacgggaccggttacccgggaccgtaacggggaacgggtaaccgggaacgggtaccgttaggtaaccgttaacgtttaaaccggttcggttaccgtaacggtcccgacgtaacggacgtacggacggtacggtaggaccgttaagtttacgtggttacgttacgggttacgggacgggtacgggtaccttaccggtcggtacccggtacccgttaccggtaacggtaccgaaccgggtaccccggtaacggtcccgttccccggtacccccgttacgggttacccc

SEQ ID NO: 75436 - DNA, 783 bp, Homo sapiens
  misc_feature: GYAE6OF02HELQI.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtcgtcctcaggacagacggccaggactcacctgctcgtggcgatgcagttcgaccaaaaactagtatcgtacttacgtcggtaaccagcgaagacggccaggccgaccggtcccctggttcgttggtagtaatttaagtaaagtacgtttgacggtacggccctacggaccggacccctagacgtacgtacttcctcgtacggtcctccgacgtaccttcggaaacggaaccgtaactaaccggttacctaacccgtttacgaacccctagtttaccggaaggttaccggggtaaccggtaccccggggacctaaagggggtaaccggtaaccgggtaaggggtacccttaacggttaacgtttaaaccgtttaaccggttcggttaccgaaccggttacccgaacgacggtaaccgaacggtaaccgtaacggtcggggtacttaacggtttcgttacgggttaccggttaacgttccggggacgggtaacgggttaccgtaccgggtaccgtaccggttacccggttaaccggttacggtaccgtaacccggtaccgaaccggggtcccttacccccgggtccccgtttaccggtaaccccg

SEQ ID NO: 75437 - DNA, 752 bp, Homo sapiens
  misc_feature: GYAE6OF02IG2GN.49.20.B09.1.454.CMB.1.raw
  modified_base (241)..(241): a, c, t, g, unknown or other
  misc_feature (241)..(241): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtcgtcctcgaggacagaccggccaggatcacctgctctggcgatgctattcgaccaaaaanatatgcttactcggtaccagcaagacggccacggccgacggccccctgttacgttgggtacgtattttaagtaaaagtacgttttggaacgacggtccctacgaaccgggtacccctaggacgtcgtacttcgtcgtcggtctccgagtctacgaacggacaacgtacgtcctacgttcgaacctagtacgaggtggtaccggtacccgggaccgtaaggacgggaacggtacggtaccgtacggttaaccttagtttaccgttacggtaccgtacggtcccgtacgaaacggaccgaacggtaccgtagggtacgggtacgttacgggtttaacgttacgggttaccggtttacgggtttaccgggggacgggtacggggtacccgtaaccgggtccggttacccggttaaccccgggttacccggtttacggtaacccggtacggtaaccccggtaaccggggttccccgttacccgggtacccccccggtttacgggttaacccccgg

SEQ ID NO: 75438 - DNA, 758 bp, Homo sapiens
  misc_feature: GYAE6OF02H78HU.49.20.B09.1.454.CMB.1.raw
tcagagtcgagagacacgaccggtgctcgatttagtgtagtgtgaagggggctgtgggtccaggaggcagaactctgggtgtctcaccatggcctggactccctctacttcctccccctcctcactctctgcacaggctctggacggcctcctatgagcctgacacacgtccacccgttcgggtgttccttgtcgtcctcgaggaccaggaccggcaggactccaccgtgctcgtggcgtatgctaagttcgaaccaaaatactatcgtacttacgtacggtaccagacgaggacggccgacggtaccgaccggtcccgttcgttacgttggtagttaagttttaagtaaagttcgtttaggacggtaccggtcccgttacggaaccgggtaccccgtaggacggttcgtaacgtttccgtccgtcgggtacctcccgtaacgtccgtacggaacgggaaacctaacgtaccgtaccctaccggttacgaaccgtacgtacgtagggtaccggacggtccccgggacgaacggtaacggggaccggaggtcgttacgtaagtttaacgttacgtccgttaacgaccgtccgacgtaaggaccgtaacggtaccggaggttaccggagttacggtttagtaccggttggtaaccggttcggggaccggtacggtaccggtacggtccgtaccggtaccggtaccgttacggtaccgaccggtacccgacggtcccgtacccgtccccggtacgtacccg

SEQ ID NO: 75439 - DNA, 680 bp, Homo sapiens
  misc_feature: GYAE6OF02FIFDX.49.20.B09.1.454.CMB.1.raw
  modified_base (186)..(186): a, c, t, g, unknown or other
  misc_feature (186)..(186): n is a, c, g, or t
  modified_base (240)..(240): a, c, t, g, unknown or other
  misc_feature (240)..(240): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctnaggacagacggccaggatcactgctctggcatgctattagaccaaaaacattangtcttacgtcggtacagcagacgccaggaccacggcccctgtcgttggtgtaatttaagtaaagtactttaggagtacggccctacgacgggtaccccctggacgacgtacgtttcctcgtcggtcctccgagtccgtacgaacggggaacaaacgtacgtaccctaaccgtttacgaaccctagtaccgtaaggtcggaccgtccggaccgtaggaacggacgtaggctagtaaccttagttacgtcgttacgtaaccggttccacgtacgaacgacgacgtacggtcggtacgttaacgtttacgtcgttacggttacggttaccggggtaacgggtacgggtaaccgtaccggtccgtaccggtacccggttaccgtaacggtaccgaacggacccggttaaccggccgtacccccggtcccggtaccgttacccgg

SEQ ID NO: 75440 - DNA, 839 bp, Homo sapiens
  misc_feature: GYAE6OF02GA0IE.49.20.B09.1.454.CMB.1.raw
tcagagtcgagagacacgaccggtgctcgatttagtgtagtgtgaagggggctgtgggtccaggaggcagaactctgggtgtctcaccatgcctggatccctctacttctccccctcctcactctctgacacaggctctgaggcctcctagtgagctgacacagtccacccgtcggtgtcctgtgtccctcaggaccaggaccggccaggatccgacctgctccgtggcgatgctattacgacccaaaaacattatgtaccttacgtacggtaccaggcgaggacggcccgaagggccctaccgggtcccccgttggttccgtttagggtagttaaagttttaaacgttaaaacggttacgttttggaacggtaccggtccccgttacggaacccgggtaccccgtagaacggtacgttacgtttccgtcgttccggtcccttaccggacgtaccgtaccggaacggggtaaccaactacggtaccctaccgttcggaacctagtaccgacggtacgggtacccggtccggacggtaggaaccgggtacggacgggtcctacggtaacttaacgttacgtacggtacgtacccggtaccggacgaaccggtacgacggtacggtacgggtacgtacgttaaggttttaccggttccgttacgggtttaagggttccccggggaaaggggttacccgggtaacccggttacccgggttacccggtttaccccggttaaacccccgggttcccggttaaaccggtcccgtaacccgggtaccccggttaaaccggggttccccctttaccccgggtaccccccggttccggttaacccccg

SEQ ID NO: 75441 - DNA, 621 bp, Homo sapiens
  misc_feature: GYAE6OF02HYBVF.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggactcactgctcgtggcgatgcattcgaccaaaaactatactgtactttaacgtggtaaccagcaaggaggccgaggccacggccccctggtccgttaggtctattttaagtaaaagtacgttttagagacggtaccccttcgaacggaccccttggacgcgtattctcgtcggctccagctacgaggaaccaacagtcctaccttagacctatcgaggtcggacggtcccggacaggagggacgacggacgtgaacttattactgtacacgtccgcgaacgacgagaccgaggtcggacttagttagtcggtacgttacggttacgggaccgggtagggaccgttccggcgtccgtacccggtcgtaacggtccgaccggacccgtaacgggtccgcccggttccccgtacggttacccg

SEQ ID NO: 75442 - DNA, 730 bp, Homo sapiens
  misc_feature: GYAE6OF02H46KM.49.20.B09.1.454.CMB.1.raw
tcagagtcgagagacacgaccggtgctcgatttagtgtagtgtgaagggggctgtgggtccaggaggcagaactctgggtgtctcaccatggcctggactccctctacttcctcccctcctcactctctgcacaggctctgacggcctcctatgagctagacacacgtcacccgttggtgtctgtcgtcctacgaggacacggcgcaggactaccgtacctgctacgtgggactagtcgactaacttacgaaacccaaaaaagtataacgtcgtacttaccgtacggtaaccaagacgaaggaccgacacgggacctaccgggcccttagttcgttaggtagttaatttaagtaaacgtacgtttaggacgaccggtcctacgaccggggccctaggacgtacgtacttcgcgtcgtaccgtacgacgcgttacggaacggacaccgaagttacccaaccgttacgaacctaacgtacgtacggtacggtaccgtcccgggaccgaacgggacggtaacggagtacgtacgtacttaacgttcgttacggtactaccggtacgacgaacgcggaacggatagggtacaggttacggtttatcggtaaggttccgtacgggacggtaccgggtacgtaccgtacgggttaccacccggttaccgtaacgggtcccgtaaccgacccgggtaacggttccccggtacccgtacccccgttcgggttaacccc

SEQ ID NO: 75443 - DNA, 593 bp, Homo sapiens
  misc_feature: GYAE6OF02HFXLU.49.20.B09.1.454.CMB.1.raw
  modified_base (334)..(334): a, c, t, g, unknown or other
  misc_feature (334)..(334): n is a, c, g, or t
  modified_base (453)..(453): a, c, t, g, unknown or other
  misc_feature (453)..(453): n is a, c, g, or t
  modified_base (465)..(465): a, c, t, g, unknown or other
  misc_feature (465)..(465): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaacatatgcttactggtaccagcagaggccaggccaggcccctgtcttggtgtatttaagtaaagactttgagacggccctagacgggaccctgagcctattcncgtggctcgagctacgaggaacaacgacgtaccaccttggaacccattacgagtcggacgtccggaccaggacggaacgacggtctagaacttattacgtcgtacagtccgactagacngaccaggtacgntaagtttagtcggttcgtaaggttccgggacggtagggaccgttacggtacgttcggacccggttaccgttacgggtaccgtaccggacccgaacgggtacccgtcccggtcccccgtaggttacccg

SEQ ID NO: 75444 - DNA, 815 bp, Homo sapiens
  misc_feature: GYAE6OF02F0ZRY.49.20.B09.1.454.CMB.1.raw
  modified_base (187)..(187): a, c, t, g, unknown or other
  misc_feature (187)..(187): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctnaggacagacggccaggatccacctgctctggcgatgctagttacgaacccaaaaaactaattatcgtaccttacgtacggtaccaagcgaaggacggaccgacggccgaacggtcccccgttgttccgtttgggttacgtaattttaagtaaaagttaccgttttaggaaggtaacggtcccccgttaccggaaaccggggtacccccctaggtaacggaccgttaccgtttccgttcgttacggtcccttacccgacggtcctacggtaacgggaaccaaaccgtacggtaccctaccggtttacgaacccgtaagttccggtaaggttacgggaaccggttacccgggaaccgaacgggtaacggaccgggacgggtacctagtaaacctttagtttaaccgttcggaaccgttccggtacccgtacgtaaccggaactacggaccggtacggtagggtaccttaaggtttacgttacggtttacggtttaaccgggttaccggggtacgggtacgggtaaccggttacggtccggttaccggtacccggttcgttaacgggtcccaaccgggtaccggtaaaccgggttccccgtaccccgggttcccccggttccggttacccg

SEQ ID NO: 75445 - DNA, 766 bp, Homo sapiens
  misc_feature: GYAE6OF02GYBNZ.49.20.B09.1.454.CMB.1.raw
  modified_base (175)..(175): a, c, t, g, unknown or other
  misc_feature (175)..(175): n is a, c, g, or t
  modified_base (245)..(245): a, c, t, g, unknown or other
  misc_feature (245)..(245): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtntctgtcgtcctcgaggacaggaccgccaggactcaccgtgcctcgtggcatcgactattcgaccaaaaanattatgtacctttacgtacggtacccagccgaaggacggacccgaggacccgaccgggcccccgtttaggttccgtttgggttaaggttaaactttttaaacgtaaaaacggttccgtttttagggaaacggttacccgggtacccccttacgggtaaccccggggtacccccgttaggaaccggtaccggttaactttcccgtacggttccgggtccttacccgaacggtccgttacggaacggggtaacctaaacgtcgtacccgtaaccgttcgaaccctatacgacggtaggtccggtacccgacgaacggacggacgacggtcgtacgtacttaacgttacgtcgtaccgtacggtccgtacgaacgaccgtaggaccgtacgggtcgtaacgtaacgtttacgttacggttacgtaacggttcgggacgggtacggtaccgtcgtacgtaccggtaccgtaccggtacgtaccgacggacccgtacggtcccgcccggtccccgtagttaccccg

SEQ ID NO: 75446 - DNA, 689 bp, Homo sapiens
  misc_feature: GYAE6OF02JYCTM.49.20.B09.1.454.CMB.1.raw
  modified_base (535)..(535): a, c, t, g, unknown or other
  misc_feature (535)..(535): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctggacggcctcctatgagctgacacagtccaccctcggtgtctgtcgtcctcgaggacaggccggccaggactccacctgctcgtggctatcgctattcgaaccaaaaacattactcgtccttacgtcggtacagacgacgacgccgaggccacggtcccctgttcgttggtagttatttaagtaaacgttcgtttacggaacggtaccggtacccgtccggtaaccgggtaccccgtaggtaacggccgttaacgttcccgtcgtccggtcctaccgacgtcgtacggaacggtaaccaacgtacgttaccctacgttacgaccgtacttacgacggtcggtacggtccggaaccgaggacggacggtacgcgtacgtacttagttacgtcgtacncgcacgacgtacgacgcgtaggtacgtagttacgttaggttcgtacggtacgtcggggaccggtacggtaccgtacggtccgtacggtacccggttaccgtacggtacccgaccggtccgaccggtcccggttccctcccccgggtacgtcccg

SEQ ID NO: 75447 - DNA, 679 bp, Homo sapiens
  misc_feature: GYAE6OF02G3GN9.49.20.B09.1.454.CMB.1.raw
  modified_base (532)..(532): a, c, t, g, unknown or other
  misc_feature (532)..(532): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtccctcaggacaggaccggccaaggatcacctgccttcgtaggcgatcgctattacgaaccaaaaactatagtgtacttacgtcggtaccagacgaaggacgccgacggccacggtcccctgtcgttggataatttaataaacgtcgttgacgtcgccctacgaccggaccctggacgtcgtattctcgtcgtctaccgagctacgacgggtaaccaaacgtcgttacaccgttacgaacctacgtacggtacggtacgggaaccgtccccgggaacgaagggtaacggggaccggtaggtaccgttaagacttttacgttaacgtgttaccgacggttacccgcgtaanccgaagtacggtaggcgtattacggttattcggttaccgtagggttccgggagggtaccggtacgtaccggtcgttaccggaccggttccgtagggacccacgggtaccctacgggtaccccgtcccgtaccccgttcggtaccccg

SEQ ID NO: 75448 - DNA, 735 bp, Homo sapiens
  misc_feature: GYAE6OF02HF5NL.49.20.B09.1.454.CMB.1.raw
  modified_base (250)..(250): a, c, t, g, unknown or other
  misc_feature (250)..(250): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtgtctgtcgtcctcgaggacaggaccggccaggactccacctgctcgtcggcgtatgctagttacgaacctaaaaanattagtcgtaccttacgtacgtaaccagacgagacggccgacggccgacggtccccttggttcgttagggtagttaatttaaagtaaacgtacgtttacggaacggtaccggtaccccttacggaacccggggtaccccgtaggtacgaccgttacttccgtcgtacggtccttaccgacgtcgtacggaacggtaaccaacgtcgtaccctaccgttacgacctacgtacgagggttacggaccggcccgggaacgaacgggtaggaacggtacggtcgtaacgtacttacgttacttcggaccgtacggcccgtaagaccgtaacgcgtacgtaggtcgttacgtaacgttagtacggttacggtacggttcgggacggggttacgaaccgttaccggaccggtaccggtaacccggtcggttaaccggaccgtccggtaacccggtacggttccccgtacccggtccccgttacggtacccg

SEQ ID NO: 75449 - DNA, 688 bp, Homo sapiens
  misc_feature: GYAE6OF02HF0H5.49.20.B09.1.454.CMB.1.raw
  modified_base (175)..(175): a, c, t, g, unknown or other
  misc_feature (175)..(175): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctggtntctgtgtcctcgaggacaggacggccaggactcacctgctcgtggcgatcgcattcgaccaaaaacatagtgacttacgtggtaccagcgagacggccaggccgacggcccctgttcgttgggtagtatttaagtaaagtctttggaggacggtccctacgaccgggacccctggacgtcgtattcctcgtcggcctcgacgtctacgaacgggacaacgtacgtcctaccgttacgaacctgtacgtagggtacggacggtcccgggtaccaagggaacgggacggaacgggtcttaacggtaactttaagttacgtaggttacctacgggtcccgtaagaccggtaacaggtccgtaagggtcgtacgttacggtttagttcggttacgttaacggttaccggggacggggtacgggtaccgttaccgggccttaccggtaacccgttcggtacggtaccgaccggtacccggtagggtcccgtacccggttccccgtaccgggttacccg

SEQ ID NO: 75450 - DNA, 629 bp, Homo sapiens
  misc_feature: GYAE6OF02FRN0J.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcatgcattgaccaaaaacatatgcttactggtaccagcagacggcaggccaggcccctgtcttggtgtaatttataaagtactttagagacggccctcgacgggacccctgagcgtattctctggctccagctacgtagggaacaacgagtcctaccttcgaaccatcgtaggttacgggacggttcccggaccgaacggacgggaacggaacgggccgtacgacgttaacttacgttcgtacgtacgtacccgcagaccgagcgtaaggtcggacttaggttacgttcgttcggttaacgttcgggcgggtacggggtaccgtaccggtcgtacggtaccccggttacccgttacgggttccgacggtcccggaaacgggtcccgtcccggtacccccgtccgggttacccc

SEQ ID NO: 75451 - DNA, 801 bp, Homo sapiens
  misc_feature: GYAE6OF02HF14V.49.20.B09.1.454.CMB.1.raw
  modified_base (176)..(176): a, c, t, g, unknown or other
  misc_feature (176)..(176): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtggtntctgtcgtcctcaggacacggacggccaggatcacctgctcgtggcgatcgctattcgaaccaaaaataatatcgtacttactcggtaaccacgcgaaggacggccgacggccgaacggtccccgtagttcgttaggtgtaatttaaagtaaacggtactttagacggtaccggtccctacggaccgggtacccctaggacgtaccgtatttccgtaccgtcggtcctacgacggtcgtaacggaacggggaactaaaccgtacgtacccttaaccgtttaccggaacctacgttaccgtagggttaccgggtaaccgggtaccccgggtaaacggaacggggaaccggggtaaacgggaacgggtaccgtaacggtaaaccgtttaactttaaccgtacgggttacccgtaaccgggtcccgtaaaccgaacggaaccgtaaccgacggtacgggtcgggtaaccgttaagggtttagttacggtttaccggtacggtttaccggggaaccggggtacggttaaccggtacggtaccggtaccgggtacccgttaacccggtacggtacccgaacggtacccgtacgggtaccccggttcccgtaccccggttaccggtacccg

SEQ ID NO: 75452 - DNA, 793 bp, Homo sapiens
  misc_feature: GYAE6OF02IDAEK.49.20.B09.1.454.CMB.1.raw
  modified_base (238)..(238): a, c, t, g, unknown or other
  misc_feature (238)..(238): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggccctcctatgagctgacacagtccaccctggtgtctgtgtcctcaggacagacggccaggatccacctgctcgtggcatgcattcgaccaaaaanatatcgcttacgtggtaccagcagacggaccagggccacgggtccccttggttcgttgggtattaattttaacgtaaagtactttggacgaccggtcccctacgaaccgggacccctggacgcggtacttcctcgtcggcctaccgagtcctacggaacgggaacccaaacgtacgtacccttaacccgtttacggaacccctacgttccgaacgggttgggaaccggtccccgggaccgtaagggacgggaaacggtcgggaccgtagtaacttaagttaccgtagttacgaccggttacccgacgaacggtaacaacggtaccgtaggtacgggtaccgttaacggtttacgtttacggttacggttacggtttaccggggacccggggttaaacgggggttaccccttaaccgggtcccgggttaaccccgggttaaaccccggttaccccgggtttaaccggggttacccgaacccgggtaacccccgggtaaaccgggtccccggtttaccccccgggttaccccccccggttaaccgggttacccccgg

SEQ ID NO: 75453 - DNA, 736 bp, Homo sapiens
  misc_feature: GYAE6OF02GHUQD.49.20.B09.1.454.CMB.1.raw
tcagagtcgagagacacgaccggtgctcgattttagtgtagtgtgaagggggctgtgggtccaggaggcagaactctgggtgtctcaccatggcctggatcctctacttctccccctcctcactctctgcacaggctctgaggcctcctatgagctgacactagtccacccgtcggtcgtcttgtgtcctcgaggacaggaccggccgaggctcacctgcgtcgtggcagtcgctattcgaccaaaactaatcgtcgtaccttacgtacggtaccagacacggacggccgacggccgaccggtccccttggttcgttacgggtagtaagtttaagtaaacgttacgtttggacggtacggtacccgtacgaccgggtaccccgtgacggtcgtacgttccgttcgtcggtcctaccgtcggtaccgtacggaacggtaaccaacgtacgttacctaaccgttacgaacctacgtacgtacggtcgggacggtaccggaccgtaagggacggtaacggacggtcgtacgtaacgttaacgttacgtcggtactacggccgtacgacgtacgacgacgtaggtcggtacttacgttagttcggttaccggttaggtaccggggtgggtaacggtaccgtaacggtccggttaaccgtacccggttacgttacggtaccggtaccgggtaccccggtacgggttaccccggtccccggttccccgtacccggttacccg

SEQ ID NO: 75454 - DNA, 666 bp, Homo sapiens
  misc_feature: GYAE6OF02HMBJL.49.20.B09.1.454.CMB.1.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (346)..(346): a, c, t, g, unknown or other
  misc_feature (346)..(346): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctgaggacagacggccaggatcactgctcgtgcgatgctattcgaaccaaaaanatactgcttacgngtaccagcagacggccaggccacggcccctgtcgttggacgttatttaaacgtaaagtacgtttaggaggacgtccctacgaaccgggtaccccnggacgcgtattcgtcgtcggcctacgacgtcgtacgacggaacaaacgtcgtaccaccgttcgactacgtcgtaacggtcggacggtacccggacgtaacggacgggaacgacggactacgtaacttagttacgtgtacgtaccgtacgacgaacgacgagacgtaggtacgtacgtaggttactcggtttacgtaacgttccggggtacgggtaacgggaaccgttacggaccggttaccggaccgtttaacccggtacggtaacgtacccggacccggtaacggtcccgtaccccggtacccccgttaccggtacccg

SEQ ID NO: 75455 - DNA, 780 bp, Homo sapiens
  misc_feature: GYAE6OF02HBQC4.49.20.B09.1.454.CMB.1.raw
  modified_base (177)..(177): a, c, t, g, unknown or other
  misc_feature (177)..(177): n is a, c, g, or t
  modified_base (714)..(714): a, c, t, g, unknown or other
  misc_feature (714)..(714): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtntctgtcgtcctcaggacagaccggccgaggactccacctgtcctcgtggctatcgctattacgaacccaaaaactattcgtacgtacgttaccgtcggtaccagtaccgaaggtacggaccgaacggcccgaaccggtcccccgttaggttccggtttaggtaacggttaattttaaagtaaaaccggttacgttttagggaacggtaccgggtccccttacggtaacccgggggtacccctgggtacggtaccgttactttcccgtacgttccgggaccttaccgtaacggtaccgttaccgggaaaacggggtaaacctaaaccggtaccgttacccgttaccgttaacgaccctaagttcccggtaagggtccgggtaaccggttccccggaacggaacgggtaaccgggaacggtacgaccgttacgtaaccttagttaacgtcgtacgtaccggtccgacgtaacgacgtaggacgtagggtcctgttaaggttcgttcggtcgtttaacggcgggtaccggcggttaaccncggtacggtaccgtccgtaacgtcggacacggtaccggacgtcccgtcccggtcccgtgttacccg

SEQ ID NO: 75456 - DNA, 904 bp, Homo sapiens
  misc_feature: GYAE6OF02IBNV0.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctagacacacgtccacccgttcggtgtctgtcgtcctcgaggacaggacggaccaggactccaccgtgccgttcgtcggacgagtgacctattacgaaccctaaaaatacttatacgtacctttaccgtacggtaccagacgaggaccggaccgacggcccgtaccggtcccgttaggttgggttacggtagtaagttaacgtaaacgtaaacgtaccgtacgtaggtaaccgggaccggtacccgtacgggtaacgggtaccttacccggacgggtaacgttcccggtaacttttcccgtcgggttaccggtacccgttacgggtaacgggtaccggtaaccgggaaacccgttaaccggggtacctaaccggttaccggtttaccgacccgtaacgtttccgggtaaggtaccggggtaaccgtaccggaacggggtaacgtaaacggggaccggggtaaaccggggtcggtaacccgtttacggttaaacgttttaacggttttaagttaccgttaaaccaaacccggtttaacaaaacccggggtaaacaccccgtttaaaccgtggttttaaccggtttaaacctttaggtttacccggtaaacccgtttaaccggtaactccgggtaaacccggttaaccgaaccgggttaaccccgttaccggttaccccggttaccgggttaaccaaccccgggtaaccccgtaaccggtaccccccctaaccggttccgtaccgttaacccg

SEQ ID NO: 75457 - DNA, 744 bp, Homo sapiens
  misc_feature: GYAE6OF02H8WD5.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtgtctgtgtcctcaggacagacggccaggactcactgctcgtggcgtactgctagttcgaacccaaaaactaatacgttcgtctttaaccgtacggtaaccgagacgaaggtacggaccgacgggacccgaccggtccccccgttaggttccgttgggttacgttaatttttaaacgtaaaacggttacgtttttaggaacggtacccgggtccccgttaccgggtaaccggggtaaccccccgttaggaacggtacccggttactttccgttccgtcggggtcccttccgacgtccgtaacgaacggggtaccaacgtacgtcctaccgttaccgactacgtacgtacggtcggtacggtcccggacgacggacggacgcggcgtacggacttacgtacgtgtcgacgtccgacgacgacgtacgcgtacggtcgacgttacggtttacgtacggttcgttaacgttccggggacgggtaccggacgtaccggtcgtaccggtcccgttacggttacggtaccgtacgtacccggacggtcccggtcccgtcccccgtggttaccccg

SEQ ID NO: 75458 - DNA, 760 bp, Homo sapiens
  misc_feature: GYAE6OF02I6X0V.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacagtccacccgtggtcgtctgtgtcctcgaggacaggacggccaggactcaccgtgcctcgtacggcgatcgactagttcgaaccaaaaactattacgtacgtaccttttacgtacggtaacccagcgtaacggacggacccgaaacgggcccgaaccggggtcccccgtggtttaccgtttacgggggttaatttaacgtttttaaaagttaaaacggtacgtttttaggaacgggtaccggttaccccgttacgggaaccggggtaaccccctgggaccggtacggtacctttcgtcgttccggaccgttaccgaggtcctacgggaggaaccaactacggttcccaacctttcgacccagttacgtacgggtacgaccggttcccggaaccgagggaacgggtacggacgggtactacggtaacgttaaccgttcggtacgtacgtacccgtacgaccgtaaacgcgtaacggcgtaaacgggcgtaacgtttacgttaacgtcgtttacgtacgggttccggagggtacgtacggtactccggtcgtaaccgtcgtacgcgtaccgtccgacgtcctcccgtacccgcgttaccg

SEQ ID NO: 75459 - DNA, 756 bp, Homo sapiens
  misc_feature: GYAE6OF02HXNAP.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcacccgtcggtgtcagtcgtccccaggacacggacggccaggatccacctgctcgtggagatgctagttcgaccaaacgtataatgtctttagttcggtaccaagcgaaggaaccggcccgggaccgacggtccccttggttacggtttgggacgtaagttacgtaaagtaaaacggacctaacggttacggaacggtaccggtacccttacggaacggggtaccttaccccggtaggtacggtaccgtactttcccgtcgttcggtacctaccggtaagggtaccgacgggtaaccgtaaccgggtaccaacgtacggttaccggaccctagtaccgtaagggtacgggtaccgttacccgggaggaccgaagggacgggaacgggtacggtcgtaacgttaacgttaacttttacggttacgttaaccaaactaaccgtaacgaacgtaacccaacgttaagttaccgtttagttacgttcgttacgtaaccggtacgttacgaccgtaccgtaagtcccgtaaccgttcggacggttaccacgtacccgacgtacccgtaacccgtcgtaccgtaccgtaccttacccg

SEQ ID NO: 75460 - DNA, 754 bp, Homo sapiens
  misc_feature: GYAE6OF02JKUE1.49.20.B09.1.454.CMB.1.raw
  modified_base (176)..(176): a, c, t, g, unknown or other
  misc_feature (176)..(176): n is a, c, g, or t
tcagagtcgagagacacgaccggtgctcgatttagtgtagtgtgaagggggcgtgtgggtccaggaggcagaactctgggtgtctcaccatggcctggatccctctacttctccccctcctcactctctgcacaggctctgaggcctcctatgagctgacacagtccaccctggtntctgtcgtcctcgaggacagaccggtccaagggacttaccacctgccgttcgtgggccgatggcctagttcgaaccctaaaaaacatagtcgtacttacgtggttaccagcagacggccgaggaccacggcccctgtcgttcggtatatttaataaagtactttagacggtacggtaccctacggacgggtaccccgtaggacggtccgtagttccgtacgtcgggtcccttaaccgacggtacctacggaaacggggtaaccaaacgttaccggtacccacccgtttacgaaccctacgttaccgtacggtacgggtaccgttacccggacccggtaaaggtaccggggtaacgtacgggtacttacgggtaaaccttaaggtttaaccgtacgttaccggtaaacgtcccgtaccgtaacgaacgtaccggacgacgtcgggaaccgttaggtttacgttacgggtactttaagggccgggtaacgggacggtacgtacggtccgttaccggtaccggtaaccgtaggtaaccgcggttaacccgaggtcccgtacccggttccccgtccggtacc

SEQ ID NO: 75461 - DNA, 749 bp, Homo sapiens
  misc_feature: GYAE6OF02G6IJ5.49.20.B09.1.454.CMB.1.raw
  modified_base (188)..(188): a, c, t, g, unknown or other
  misc_feature (188)..(188): n is a, c, g, or t
tcagagtcgagagacacgaccggtgctcgatttagtgtagtgtgaaggggggctgtgggtccaggaggcagaactctgggtgtctcaccatggcctggatccctctacttctccccctcctcactctctgcacaggctctgaggcctcctatgagctagacacagtccaccctcggtgtctgtgtccncaggacaggacgccaggatcactgctgtggcatcgactagttacgaaccaaaacaatagtacgacttaacgtacggaaccaggacgaaggtacggccgacggacccgaccggtcccctggttcgtttgggtacgttaatttaaagtaaacgttacgtttaggacggtaccggtcccttacggaaccgggtaccccgtggacgacgttacgttcctacgtcggcctacgagtcgtacggaaggaaccaacgtacgtacctaccttagaccctaagtcggtaacggtcgggaccgtacccgggacgaagggacggagggtacgacgttaggtaaaccgtttaattacgtacgtaccgtacgttcccgaacgaacggtaacgacggtacgtacggttacggggtaacgttaaggtttaacgttcgggttaaacgttttaacggggcccggggtaagggtacgggttacctaacggggtccgttaaccgggaccccgttaggtaacggtacccgaggtaaccccggtaggttaccccgtaccccggttacccgtacggttacccc

SEQ ID NO: 75462 - DNA, 742 bp, Homo sapiens
  misc_feature: GYAE6OF02I4CVH.49.20.B09.1.454.CMB.1.raw
  modified_base (221)..(221): a, c, t, g, unknown or other
  misc_feature (221)..(221): n is a, c, g, or t
tcagagtcgagagacacgaccggtgctcgatttagtgtagtgtgaagggggctgtgggtccaggaggcagaactctgggtgtctcaccatggcctggactccctctacttctccccctcctcactctctgcacaggctctgacggcctcctatgacgctagacacacgtccacccgtggttgtctgtcgtcctgaggacagacggcaggctcactgctcgnggacgtatcggctaattcgaaacccaaaaaagtatttacgtcgtacgtttaccgtacggtaaccagaccgaaggacggacccgaggaccccgacgggtccccttggttaccgtttggtaagttaacttttaagaaacgttccgtttaggaacggtaccggtaccctaacggtaccgggaacccctaggtacggtcctaagtttcctacgttcgggtaccttccgaaggtcccgtacggaaacgggtaacctaacgtcggttacccaaccggttcgaactaacgcgtaaggtacgggtaccgtacgacgaacgggtaggaccggtaagtcgtaacgtacgtttaagttaccgtacggttccgaacggtaccgtagaaccggacgtacggttacgacggttggaccctttagtacttacggtcgttaacgggttcgggacgggtacgtacgtcgtaccggtacgtaccggttccgaggtacccgacgtaccgacggttcccacccggttcccggtaccgtacg

SEQ ID NO: 75463 - DNA, 779 bp, Homo sapiens
  misc_feature: GYAE6OF02GTE2I.49.20.B09.1.454.CMB.1.raw
  modified_base (178)..(178): a, c, t, g, unknown or other
  misc_feature (178)..(178): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacagtccacccgtcggtntctgtgtcctgaggacacggaccggccaaggactccacctgctcgtggcgatgctattcgaaacctaaaacaattatcgtactttaacgtcggtaaccagacgaacggacggaccgacggacccgaccggtcccccgttaggttccgtttagggttagttaaagtttttaaacgtaaaacggttacgttttacgggaacggtaccggtaccccgttacggaacccgggtaccccgtaggacgtaccgttactttcccgttacgtccggtaccttccgaacgtccgtaccggaacggaaccaacgtaaccgtacccgtaaccttacgaaccctagtacggtaacggtacgggtaccgggtccgaacgtagggaacggaacggtcggtacgtacggtaacttaacggttcgtacgtacgtacgtccgtaagacgacgacgacgtaaggtcgtacgtaagttaggttacgttacggttacgggttaaccggcgggtacggtaccgttacgggtccgtaaccggttacccggtaccggttacggtacccgaaccggttacccggaaccggtccccgtttaccccggaccccgttacggtaccccg

SEQ ID NO: 75464 - DNA, 968 bp, Homo sapiens
  misc_feature: GYAE6OF02F4HAI.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctctcactctctgacagcgctgtaggcgtccttactagtacggctctacgaaccaacgtacgtacccctaccggtcggttgttcgttcggtccttacctacggaacgaaccgacgggaccgtaccgtaaaggtcctaccgttaccgcgttcccttgggtacgggacctaagtccgtaaccttaagttaacccaaaaaaccaaaaaagttagttactccgttaaccgttaacggtaacgaccaagacgaacgggacgtaccgtacggtacccgtacccgtcccgtttaggtacgtttaggaacgttttaaattaaaaccggtaaacttacggttaggaaccggtccccgttaaccgaccggtaaccgggtaccctaggtaccgttaacgtaccgtttcgttcggtcccgtaaccgtttcaacccgttcgaacgggtaaaccggtaaacctaaccgtagggtttacccccctaaaggttaaccacccgtaaagtttccggtacgggttacgggtaccccggtaaccgggaccggtaaagggtaaccgggtaacgggtacccgggttaaacgttaacgttaacccggtttaacggtttaccggtaaccggtttacccggtaaccgggtaccgtaaccgaacggttaacccggagtaaccgggttagttaccggggtaatttaacggttacggttacggttacccggttaagggtaccggtaccgggggttaaccttaccggggtaaaccgttccgaacccggggttaaccgttaaccggttaaccgggtaacgtaacccggacccggtttaaacggccccgttaaccccgtaccccgggttaccgttaaccccgg

SEQ ID NO: 75465 - DNA, 604 bp, Homo sapiens
  misc_feature: GYAE6OF02ICALO.49.20.B09.1.454.CMB.1.raw
  modified_base (176)..(176): a, c, t, g, unknown or other
  misc_feature (176)..(176): n is a, c, g, or t
  modified_base (203)..(203): a, c, t, g, unknown or other
  misc_feature (203)..(203): n is a, c, g, or t
  modified_base (239)..(239): a, c, t, g, unknown or other
  misc_feature (239)..(239): n is a, c, g, or t
  modified_base (283)..(283): a, c, t, g, unknown or other
  misc_feature (283)..(283): n is a, c, g, or t
  modified_base (296)..(296): a, c, t, g, unknown or other
  misc_feature (296)..(296): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctaatgagcctgacacagtcaccctggtntctgtgtcctcaggacagacggcaggntcacctgctcgtggcgattgcagttagaccaaaaanatatcgtcttacgtgtaccagcagagcaggcacgccctgtctgntattaagaaacgntttgaggcgcctagacggaccctgacgcgtaattcgacgtcggactaccaggtcctacgaaacggaacacgaaacgttcgaacttacgaccagtacgtagtcggtacgtaccggacaggaacggaacgacgtcgaacgtaactaagttacgtcgtacacgttcacgaacacgtagacgtagtcgtactaacgtttatcggttacgttaagtacgtcgggaacgtacgtaccggacgttaccgaccgttacccgaacggttacgaccgtaccggaaacggtcccgtaccggtccccgtccggttaaccg

SEQ ID NO: 75466 - DNA, 692 bp, Homo sapiens
  misc_feature: GYAE6OF02HANLP.49.20.B09.1.454.CMB.1.raw
  modified_base (565)..(565): a, c, t, g, unknown or other
  misc_feature (565)..(565): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctgaggacagaccggccaggactcacctgctcgtggcgatgcacttacgaaccaaaaacattatcgtactttacgtacggtaccagcgaaggacgaccgacggccgaccggtccccttaggttcgttggtagttaagttttaagtaaacgttacgtttaggacggtaaccggcccctacggacccgggtaccccgtaggaacgtccggttattccgttcggttccgggccttacgaccggtctaaccggagggtaaccaacggtacgtaccctaccgttacgaacctacgtcgtaaggtcggaccggtcccgggaacgaacgggacggacgacggtctacggtacttaacgttacgtcggtacacggtccgacacggaacgnggaccgtaggtcgtactaaggtttactggttacgtagttccgggacggtacggtacgtaccgtcggtccggtaccgtccgttacggccgtaaccgacgtaccggcctacccggtcccgtacgtcccg

SEQ ID NO: 75467 - DNA, 734 bp, Homo sapiens
  misc_feature: GYAE6OF02GZU7U.49.20.B09.1.454.CMB.1.raw
  modified_base (176)..(176): a, c, t, g, unknown or other
  misc_feature (176)..(176): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtntctgtgtcctcaggacagacggcaggatcacctgctcgtggcatcgctattcgaaccaaaaacaatatcgtcttacgtacggtaccagacgaggacggccgacggccgaccggtcccctgttcggttaggtagtaattttaagtaaacgttcgtttacggaacggtaccggcccgttacggaaccgggtaccccttagggacggtaccggttactttcccgttccgtcgggtacccttccgacggtacctacggaacggggtaaccaaacgtacgtacccgtaaccgttaacgaccctaacgtacggtaacgggttcgggtacccgggtaccggaaccggaaacggggtacggaacgggacggtaccgttaacgtaaccgtttaacttacggttcgttaccgtaaccggttcccgaacgacgaaccgaacggcgtaggtcggaagttacgtttagttcggttacggtaaggttcgggaacgggtacgtaccgtacggtccgtacggtcccgttacgtacgtcgaccgtaccgtacgcccgtccgtcccggtcgtaccg

SEQ ID NO: 75468 - DNA, 888 bp, Homo sapiens
  misc_feature: GYAE6OF02GIDA2.49.20.B09.1.454.CMB.1.raw
tcagagtcgagagacacgaccggtgctcgatttagtgtagtgtgaagggggctggtgggtccaggaggcagaactctgggtgtctcgaccgatggcctggatcccgtctacttctccccctcctcacttctctgctacaggctcgtgaggcctcctatggagctgacacagtcacccgtcggtgtcctcgtcgtcctcgagggtacaggaccggccagggatccaccgtgccttcgtagggcagttcgctagttacgaacctaaaagtattagtacgtactttaaccgtacggttaaccgaaggaactaaggaacggacccgacggacccggtaccggtcccctaggttccgttagggtagtaagtttttaaacgaaacgttacgtttacggaacggtacggtacccgtcggaccggtacccgtaggaacgtccgtaagtttccgtcgttacgggtaccttaccggacgtccgtaccggtaaagggaaccgtaaaccggtacgtacccgtaaccgttacgaccttaacggtaccgtagggtaaccgggtaaccgggtacccggtaccggtaaacgggaaccggtacggggtaaccggttcggtaacggttaaccgttaggtttaaccgttaccggttaacggtaccggtaacccgtaccggtaaaccggtaccgtaaaccgggtcgtaaacgggtccgttaaccggttaggttaacgtttacgggttaccggtttaacgggttacccgggggtaaccgggggtaaccggttaccggtaaccgggtccggttaccgggtaaccccggtttaccgggttaccggtacccggtaaccggaccccgtaacgggtccccgtaccccggttacccccggtccggttaacccccg

SEQ ID NO: 75469 - DNA, 752 bp, Homo sapiens
  misc_feature: GYAE6OF02JSPQX.49.20.B09.1.454.CMB.1.raw
  modified_base (170)..(170): a, c, t, g, unknown or other
  misc_feature (170)..(170): n is a, c, g, or t
  modified_base (193)..(193): a, c, t, g, unknown or other
  misc_feature (193)..(193): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcacctctctgcacgaggctctgacggcctcctatgagctgacacacggtcncccgtggtgtcgtgtcgtcctanacggacaggacggccacggtataccaccgtgtcttcgtagggccattggactacttcaaaccctaaaaacataattcgtcgttacgttacggaccgaacgacgacggacggtaccgaacgggtcccgtaaccggtccccgttggttccggttagggtattaacgttttaaaacgtaaagtacgttttacgggacggtacggtacccctggtaaccggggaccctacggtacggacggttcttctcggttcgcccgttacgtacgtccgtacgaaccggtaacgtaaccgtataccccgttaacgtacgtacccaccgttagtacggttacggggaacctccggaccgaacgggtagggtaacccgagggttcacggtaacttacgttactgtacccgtacgaccgtagacgacgtacggacgttcgacgggtacctaagggttcttaccggttaggtaccggttcgcgggggtacgtaccgtccggtcttacggtacggttacccgcgggtaacggaacccgtccggtagtacccgggtcccgtccccgttacgtaccg

SEQ ID NO: 75470 - DNA, 854 bp, Homo sapiens
  misc_feature: GYAE6OF02JCF8Q.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtccaccctggtctctgtgtcctcgaggacacgacggccaggactcacctgctcgtggcatcgctatttacggaacaaaaactaattagtcggtaccttttaacgttccggggaaccctagaccgaaagggacggacccgaacgggtcccctaccgggaccccccttgggtttacctttaccgggggtaggtaaactttttaaaacggaaaacggtttaaccggttttaggaacgggtaccgggtccccctttaacggggaaccccgggggttaaaccccccttgggtaacccggtaccggttaaactttcccgttcggttaccggtacccggttccccgtagtacccggttaccggaaaacgggggtaacctaaaacccgtcgggttaaacccaccccgtttagggaaccccctaagttaaccgtaacggtccgggtaacgggtcccgggtaacccgaaacggtacggaccgggtaaggtccgtacggaaccgtttattaaccggttacgtccgtaacggttccgacgtaaacgggtcgacgtacgtaacgtcggggtacttagttaacgttcgttaacggttagggtaccgacggggtcgtaacgtacccgggtaacgctaacccgggttcgaaggttaccctacgggacccggtaaggtccccgtaccggttcccccgtacggttacccg

SEQ ID NO: 75471 - DNA, 715 bp, Homo sapiens
  misc_feature: GYAE6OF02I818K.49.20.B09.1.454.CMB.1.raw
  modified_base (442)..(442): a, c, t, g, unknown or other
  misc_feature (442)..(442): n is a, c, g, or t
tcagagtcgagagacacgaccggtgctcgatttagtgtagtgtgaagggggctgtgggtccaggaggcagaactctgggtgtctcaccatggcctggatccctctacttctcccccctctcactctctgcacgaggctctgacggcctcctatgagctagaacacacgtccacccgtcggtcgtcgtgtcgtcctacgacggacacggaccggaccaggactccaaccgtgcctacgtggcagtcgactagttaccgaaaccaaaaactaattcgtcgtacttacgtacgtaaccgacgacgaaggacggtccgacggacccgaccggtccctcggtttcgttacggtagttaacttttaaagtaaacgttacgtttaggaacggccggtcccttacggaacccggtcccgtaggagtccgtattcctcgtacgccgtaccncgacgtacgacgggaacaacgcgtacgtacgttcaccgtaagtcgacgtcggactacggagacgtaagaacggacgagtacctagtaacttaagttagtactactaacgtcaagtcaagtacccggtacggtacgtttacgttacgtcggggttaggtccgggtacggaacggaactaccggtaccgtcggttaacccgttacggtaacccgtgacccggaaccggtacggtcccgtacccggtaccccgtcggttaccacccggtttccccg

SEQ ID NO: 75472 - DNA, 833 bp, Homo sapiens
  misc_feature: GYAE6OF02HUCFA.49.20.B09.1.454.CMB.1.raw
  modified_base (162)..(162): a, c, t, g, unknown or other
  misc_feature (162)..(162): n is a, c, g, or t
  modified_base (465)..(465): a, c, t, g, unknown or other
  misc_feature (465)..(465): n is a, c, g, or t
  modified_base (669)..(669): a, c, t, g, unknown or other
  misc_feature (669)..(669): n is a, c, g, or t
tcagagtcgagagacacgaccggtgctcgatttagtgtagtgtgaagggggctgtgggtccaggaggcagaactctgggtgtctcaccatggcctggatccctctacttcctccccctctcactctctgcacaggctcgtggacggtccctcctaagtgacnctacgaaccacgtacgtcccacccgttcggtgttccgtgttcgtacctacgacgggaaccacggaccggcgaaggtactccgacgtgcgttaccgtggactagtcgacttacgtacgaaaccctaaaataacttagttaccgtaccgtttaaccgttccggaaccgtacggacgtaacgggacccggtaccgaacggcccgtacccggtcccgtttaggttaccgttaggttaacgttaaacgttttaaagtaacggttcgttaacgacggtacccggtacccgtacggtaaccggtacccgnggacgtacttacgtttcgtacgtccgtacttaccgacgtacgaacggaacggtaaacacgttccgtaaccgtaccgttaacgaccgtacgtacggtacggtaccgggaccggttacccggaacgaacgggtacggtacgaacggttactacggtaaacgttacgttacgtcgtacgtaccggtcaagtaccgacaaggtaccgngggtacgttaacgtagtttacggtaccgttagtaccgggttagggtccggtaacgttccggtaccggtaccggttacccggtaacgttggtaacccggtaccgtaacccgggtcccgtaaccggttccccggtttaccccggttaccccggtgttaacccccgg

SEQ ID NO: 75473 - DNA, 726 bp, Homo sapiens
  misc_feature: GYAE6OF02HVPF6.49.20.B09.1.454.CMB.1.raw
  modified_base (204)..(204): a, c, t, g, unknown or other
  misc_feature (204)..(204): n is a, c, g, or t
tcagagtcgagagacacgaccggtgctcgatttagtgtagtgtgaagggggctgtgggtccaggaggcagaactctgggtgtctcaccatggcctggatcctctacttctccccctcctcactctctgcacaggctctgaggcctctatgagctgacacagtcaccctggtgtctgtcgtcctcgaggacaggacggccagacncactgctctggcgatgctattcgaaccaaaacatatgtacttactggtaccagacagacgaccgaggaccgaccggtacccgtcggttcgttggtacgttaagttttaagtaaacgttacgttttacgacggtaccggtacccgtacgaccggggtacccctaggacgacgtacttcgtacgtcggacctcgacgtccgtacggaaacgggacctaacgtacgtacctaaccgtaccgtaacctacgtaccgtagggtcggtaaccgggtccgacggaacggtacgggaaccggacgtacggttacgtaacgttaacgttacgttacgtacgtaccgtccgactaacggaacgtacgggacctaacgggtcggtaacgttacggttacgtttacggttacgtaacggggttccgacggggtacgtaccggttaaccgtcggttaaccgtaccggttaccgttacgggaccgttacccggtacccgagggttcccctacggtacccccgtacggttaaccccg

SEQ ID NO: 75474 - DNA, 732 bp, Homo sapiens
  misc_feature: GYAE6OF02ICU2G.49.20.B09.1.454.CMB.1.raw
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (419)..(419): a, c, t, g, unknown or other
  misc_feature (419)..(419): n is a, c, g, or t
tcagagtcgagagacacgaccggtgctcgatttagtgtagtgtgaagggggctgtgggtccagggaggcagaactctgggtgtctcaccatggcctggatccctctacttctccccctcctcactctctgcacagctctgagcctcctatgagctgacacagtcaccctggtgtctgtcgtcctgaggacaggacggccaggactcacctgctcnggnatgnattacaacaatatgcttactacgtagacagtagagtaccgcgacgccgtacccgtcgtacgttcgttaggtaatttaaggtttaaaataacgttacggtttggaaacgggccctttacccggacggtaaacccccggttaccggaagtccgggtaaactttccgtttccggacggtttccccggcggtttaaacccnccggtaaccgaaacgggtaaaccgtaaaccgtaacgttaaccgttaacccgtaaccgtaccgtaactccggtaacggtacgggtaccggtaccgggtacgacggaagggaccgacggtacgtactaacggttacttagttacgtacgtacgtacgacgtacgacgacgacgtaccggtgtacgtactagttacgtacggtacgtacgggtacggtaccggacgtaccgacggtcggtaaccgtccggttaacggtaccggtaccgacccggtaaccggtacccggttcccggaccccctacccggtactcccg

SEQ ID NO: 75475 - DNA, 776 bp, Homo sapiens
  misc_feature: GYAE6OF02GT0GM.49.20.B09.1.454.CMB.1.raw
  modified_base (137)..(137): a, c, t, g, unknown or other
  misc_feature (137)..(137): n is a, c, g, or t
  modified_base (145)..(145): a, c, t, g, unknown or other
  misc_feature (145)..(145): n is a, c, g, or t
  modified_base (162)..(162): a, c, t, g, unknown or other
  misc_feature (162)..(162): n is a, c, g, or t
  modified_base (180)..(180): a, c, t, g, unknown or other
  misc_feature (180)..(180): n is a, c, g, or t
  modified_base (195)..(195): a, c, t, g, unknown or other
  misc_feature (195)..(195): n is a, c, g, or t
  modified_base (639)..(639): a, c, t, g, unknown or other
  misc_feature (639)..(639): n is a, c, g, or t
tcagagtcgagagacacgaccggtgctcgatttagtgtagtgtgaagggggctggtgggtccaggaggcagaactctgggtgtctcaccagtggcctggactccctctacgttcctccccctctcactctctgcacnggctctgngcctctatgatctaganacacgtccaccgtcggtntctgtcgtcccgtanacgggtacacggacggcctaaggtactccactgcctcgtacgggcatgctatacgaaaccaaaataatgtcgtacttacgtacggaccagacgacgacggccaacggtcggaccgtccccgttgttacggttacggtagttaaccgtttaagtaaaccggttgttcggaacggtaccggtccccggttaccggtaacccggtacccctaggtaaccggtccgttaaacgtttcccggtccgttaccggtccttacccgaagggtcccgtttaaacggaacgggtaaaccttaaaccggtccgttaaccctaaccgggttaccgaactttaacgcgggtaccggtacgggtccggtacccgggaccgaaggtacgggacgtacggtactacggtaaccttacgttcgtacgttacacggttccagcgggaactggaccgtacggnttagaccgttagtacgtttcggtaaccgggttcgaacgggtcgtaaccggtacgggttccgtttaaccggtccgtaacgttacggtaccctaacccggaaccgtccgggtaaccgtcccggtaccctcgggtaaccc

SEQ ID NO: 75476 - DNA, 711 bp, Homo sapiens
  misc_feature: GYAE6OF02F86JC.49.20.B09.1.454.CMB.1.raw
  modified_base (296)..(296): a, c, t, g, unknown or other
  misc_feature (296)..(296): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggcaggatcacctgctctggcgatgcattcgaccaaaaacatatgtcttatcggtaccagcaagaggccaggaccacggcccctgtcttggtgtatttaanaaaagtctttaggaagacggtccctacgacgggacccctgacgcgtaacttcctcgttacgggcctaccaggccgtcgaaacggggaaccaaacgaacggttcctaacccgtttcgaacccctaagtccgagggttacgggaacggttaccccgggaccgtaaaggaacgggtaaccgggaacggtacgtacggtaaccttaaacgtttaccgttagttaccgaacgttacccgacgtaacggaacgacggacgtaggtcggacgttaacgtttacgtacggttacggttaacgttaccggggacggggtacgggtaccgtaccggtaccgtacggtaccccggttaccgttaacgggtaccgtacggaccccggtaaccggtccgtacccggtaccccccggtaggttaccccg

SEQ ID NO: 75477 - DNA, 713 bp, Homo sapiens
  misc_feature: GYAE6OF02GT8NB.49.20.B09.1.454.CMB.1.raw
  modified_base (175)..(175): a, c, t, g, unknown or other
  misc_feature (175)..(175): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcacccgtggtntctgtgtcctcaggacagaccggcaggatccactgctcgtggcatgactattcgaacccaaaaatatatcgtacttacgtacggtaaccagacgaagacggccgacggaccgacggtacccctgttcgttaggtagttattttaaagaaacgttacgtttaggaacggtaccggtaccctacggaacccgggtaccccgtaggacggtacgtacgtttcccgttcgtcgggtcctaccgacgtaccgtacggaacgggtaaccaacgtacgtacctaccgttacggacctaacgtacggtaggtacggtaccggtaccgggaccgagggtaacggacggacgtcgttaacgacgtttacttacgtcgtacgtacggaccgacgtacgacgacggtacgtacggtcgtagtaagttacgttacggttacggttacggttcgggaacgggtacgggtacctacggtccgtaccggtaccggttaccgttacggtacgacccgccggtaccgtcccgtcccggtccccggtacgttacccg

SEQ ID NO: 75478 - DNA, 660 bp, Homo sapiens
  misc_feature: GYAE6OF02F02YP.49.20.B09.1.454.CMB.1.raw
  modified_base (224)..(224): a, c, t, g, unknown or other
  misc_feature (224)..(224): n is a, c, g, or t
  modified_base (240)..(240): a, c, t, g, unknown or other
  misc_feature (240)..(240): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggatcacctgctcgtggagatgnattcgaccaaaaccgntatgtcttagttcggtaccagacaagaacggccgggccacggcccctgttggttggtgagtgtataaacggacacgtgaggcggccctgagggactcccgtgacgcgtattcctcgtcggcctcgtacggtcgaagggaaccgtaacggtccacgtacgttacggtcacgttcgaggtggacgtccgagggcgaaggtagggacgagggcttaggtacttagtttattacgtactaaactaccgaacgtagaacctacgtagtttacggtaacgtttagttacggtttaccgttacgggtaaccgttcgtaccggtaaccgtaacgggtcccgtaacccggtttccggtacggtaacctacccggaacccggtaaccgggtacccccctaacccgtaccgttaccgtaccgttaccccgg

SEQ ID NO: 75479 - DNA, 693 bp, Homo sapiens
  misc_feature: GYAE6OF02GADMD.49.20.B09.1.454.CMB.1.raw
  modified_base (252)..(252): a, c, t, g, unknown or other
  misc_feature (252)..(252): n is a, c, g, or t
  modified_base (272)..(272): a, c, t, g, unknown or other
  misc_feature (272)..(272): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacagtccaccctcggtgtctgtcgtcctcgaggacagaccggccaaggactccaccgtgcctcgtggacgtatgctattcgaaaccaaaaanatactgcttacgtcggtacngacaggacgccgaggccacggtccctagtcgttggtagtatttaagtaaacgttcgttgacgtacggtccctacggaccggtccctaggacgtacgtacttcgtacgtcggtcctaccgacgtcgtacgagggtaccaacgtacgtactaccgttacggaacctacgtacgtacgtacgggaccgtaccggcgaacgggacgtacggacggtactacgtacttaacgttcgtacggtccgtacgtaccgacgtacgacgtacgtacggtacgtcgggtacgttaggttacgttcgggttacgttaccgggttcgggtaccgggtagggtacccttacggcccgttacggtacccggtaaccggttcgtaaccggaccgtacccggaccgttcccgtaccccggtccccggttgtaaccccg

SEQ ID NO: 75480 - DNA, 767 bp, Homo sapiens
  misc_feature: GYAE6OF02IXOWP.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctcccctcctcactctctgcacgaggtctctggacgtcctactagtgagtctagaacacgtagtccacccggttggtcgtcgtggttccgtacctggaacggaccgacgggaccggacctaaggtactaccgtacgtcgtccgtacggtcgggaactagtcgtacctaagttaccgaaaacctaaaaaatattaagtccgttaccgttaacgttacggtaaccaggacgaacggaccggaccgacggaccgtaccggtcccttcggttacgttaggttagttaaagtttaacgaaacgttacgttaggaacgtccggtaccgtacggaaccggtacccaggtacgtccgttaagttccgtagtccgacctacgcggtaccgtaggaacgaactacgtaacgtccgttaacgtacgacgttaacgcgacgtacggtaccgtaccggacgaacggagacggacgtcgtaacgttacgttacgtacgtagtacgaccgtcgaacgaagtaccgaacgcggtagtacgtacgtacgttaacgttcggttacggttacggtaacggtaccgggtaacgttaccggtaccgtaccgttccggaacccggttacgtaacggaccgttacgaccggttacggccgtacccgtcccgtacgtaccg

SEQ ID NO: 75481 - DNA, 940 bp, Homo sapiens
  misc_feature: GYAE6OF02HQFQS.49.20.B09.1.454.CMB.1.raw
  modified_base (179)..(179): a, c, t, g, unknown or other
  misc_feature (179)..(179): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacgagtccacccgttggtntctgtcgtcctgaggacaggaccggccaggactccaccgtgcttccgtgggacctagtgtacctaagttccgaaaccccaaaaaatacttagtcggtacctttaacggtcggtaaccccaggaccgaaggaccggacccgaacgggaccccgtaaccgggtccccccgtttggtttccggtttagggttacgttaaacgtttttaaaacgtaaaacggttaccgttttagggaaccgggtcccggtaacccccttaccggggaaaccccggggtaccccgtggtaaccggttacgttaaccgttttccgtacggttaccggtacccgtaacccggtaacgtacccggtttaaacggaaaccggggtaaacctaaaccgtaaccggttaccccgttaaacccggttacgtaaacccgtaacgttaccgggtacggggttaaccggggttaacccgggtaccccgggtaaccggaaaccggggtaaaccgggtaaaccgggtacgggttacccgttaaccgggttaactttaaccggttaaccggttcgtaaccggttaacccggtaccgtaacggaccggtaacgtaccggtacggtaacgggtacgtaccggtttaagtttccgttaacggttacggttaggttaccgggggacgggttacggtacgttaccggtccggtaccgggtaccgtaccggttacggtaccgtaccgggtaccccggaggttccccgtacccggtaccccggtaccggttacccg

SEQ ID NO: 75482 - DNA, 777 bp, Homo sapiens
  misc_feature: GYAE6OF02I3IO8.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagaccggccaggatcacctgctctggcgatgactattcgaaccaaaaactaatatcgtactttaacgtacggtaaccagacgaaggacggaccaggcccgacggtccccctggttcgttggtataattttaacgtaaagtacgtttgaggacgccctacgaccggaccctgacgtcgtacttctcgtcgcctcacggtctacgtaacgggaacctaaacgacgttacctaaccgttacgaacctaactacggtacggtacgggtaaccgggtcccgggaacccggaaagggaacggggtaaacgggaacgggtccttaacgggtaaaccgttttaacgtttaccgtttacggttacccgtacggttaccccggtaacgaaccggtaacgtaacggaccgtaacgggtacgggtaacgtttaacggtttacgttcggtaccggtttaacggttccggggaacggggtacggtacggttacccgggtacggttaccgggttaacccggttacccggttaacgggtacccgtaccggtaacccggtaccgggtaccccgttccccggtacccccgttcgggtaaccccg

SEQ ID NO: 75483 - DNA, 741 bp, Homo sapiens
  misc_feature: GYAE6OF02HOVRR.49.20.B09.1.454.CMB.1.raw
  modified_base (187)..(187): a, c, t, g, unknown or other
  misc_feature (187)..(187): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtccctnaggacagacggccaggactcacctgctcgtggcatgcattgaccaaaanaatntntacttactcggtaaccagcgaagtacggaccaggtacccgaccgggtaccccttgttaccgttgggtagttaattttaaagtaaaacggtacgttttacggaaggaaccggtcccttaccggaaacccggggtacccccgttaggaacgtccgtatttccgtcgtcgggtccttaccgacgtcgtacggaacgggaactaaacgacgtacctaacccgtttagaaccctagtccgagggttaccggtaacggtcccggaccgaagggaacggtacggaacggtcacggttaactagtactgtccgaacgtccgctaagacgtacggacgtacggtagtcggttaacgtttacgtacgttacggttacgtttcggggaccgggtacggggtaaccgttaacccggtcgggttaaccgtacccgggtacccgttaacgggttccgaaccggtaccggaaccgttcccggtaccccggttaccccccgttcggttaaccccg

SEQ ID NO: 75484 - DNA, 804 bp, Homo sapiens
  misc_feature: GYAE6OF02FTEPS.49.20.B09.1.454.CMB.1.raw
  modified_base (300)..(300): a, c, t, g, unknown or other
  misc_feature (300)..(300): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacaggacggccaggatcacctgctctggcatgctattcgaaccaaaaacatagtcgtacttaacgtggtaccaggcaagacggccaggccaacggtcccctgtcttgggtntaatttataaagtctttaggacgaggccctacgacgggtacccctggacgtcgtattccgtacgtgggccttaccgagtccgtacgaacggggtaaccaaacgtacggtaccctaacccgtttacggaaccctagttaccgtaagggtacgggtacgggttaccccgggacccgtaacggggaacgggtaaccggaacggggtcccgttaacggtaaaccgttaacgtttaaccgtccggttaaccgtaaccgggttacccgacgtaaacgggaaccgtaacgggtacggtaacgggtacggttaccgtaacgggttttaacgttacgggtttaccgttaacggggtttaccggggtaaccggggtaacggggtaacccgttaacccgggtaccgttaccgggtaaccccggtttacccggttaacgggtacccggtaacccggtacccggtaaaccgggtccccggtttacccggtacccccccgggttacggttacccccgg

SEQ ID NO: 75485 - DNA, 806 bp, Homo sapiens
  misc_feature: GYAE6OF02GYADP.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacacggctctgacggtcctcctatgagctgacacacgtccacccgttcggtgtctgtcgtcctcgacggacaggacggccgaaggactaccgacctgtctcgtggcgagtcgactattacgaacctaaaaacaatactcgtaccttaacgtacggtaaccgagaccgaaggaacggccgaacgggccaacgggccccttaggttcgttcgggtaagtaattttaaagtaaaacgtacgttttaggaacggtaccgggtacccttacggaaacccggggtacccccttagggacggtaaccgttacgtttccgttcgtacgggtcccttaccgaaccggacgtttaccggaacggggtaaaccaacgtaacggtacctaccgttacgacctaacgtcaacgggttacggaccggttacccggaccgtaaacggggacggaaacggtccgggtaactacgtaacccgtttaagttaccgtacggtcctaaccggttacccggaacaccggtaacgacggtacgacgggttagaccgttaaggtttagttacgttccggttaagacccggggtacggtacgggtacctaccgggtccgtttaccggaacccgttccgtaacgttccggaaacccgaccggttaacgccggttaacccctcccggtaccgttaaccccg

SEQ ID NO: 75486 - DNA, 671 bp, Homo sapiens
  misc_feature: GYAE6OF02HAXFV.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtgtctgtcgtcctcgaggacaggacggccaggactccacctgctcgtggctagtgctagttacgaaccaaaaactatacgtcgtacttaccgtacggtacagacgaacgacggaccgacggaccgaccggtcccccgttggttaccgttgggtagttaactttaaagtaaacgttacgtttacgaacggtccggaccctacggaaccgggtaccccgtggacgtcgtacgttctcggtcgcctccgaggtcctacggaacggaaccaaaccgtcgtacctaccttacgacctagtacgtaggtccggacggtcccgacgaagggacgacggacgtcgtacgtacgtacgttacgtcgtacgtacgtccgacgaagtccaaggcccgtaaggtcgtacgtagttcgtacgttacggtagttccgggacggtacggtcgtacgcgtaccgaccgttcggagtccgacgtaccggcgtcccgtaccggtccctgtaccg

SEQ ID NO: 75487 - DNA, 751 bp, Homo sapiens
  misc_feature: GYAE6OF02GYVBL.49.20.B09.1.454.CMB.1.raw
  modified_base (620)..(620): a, c, t, g, unknown or other
  misc_feature (620)..(620): n is a, c, g, or t
tcagagtcgagagacacgaccggtgctcgatttagtgtagtgtgaagggggctgtgggtccaggaggcagaactctgggtgtctcaccatggcctggactccctctacttctcccctcctcactctctgcacgaggctctgacggccttctatgagctgacacacgtccacccgtcggtgtcgtgtcgtcctgaggacaggaccggccaggtactccaccgtgccttcgtggacgtatcgactagttacgaaaccaaaaacgtattacgtacgttaccgtttaaccgtcgggtaaccacggacgtaacgggaccggtaccggaaccggtaccccgacccggtccccgtttagggttccggtttacgggtaagttaaacgttttaaacgtaaacggtttacggttacgggaaccgggtacccggtccccgtaacggtaacccgggtccctagggtaccgtacgttcgttccgtcgtcggacctcgacgcgtacggacggaactacgtactacctacgttccgaactgtacggtacggacggtaccggtcccggaagacgggtacgtaacgcggtactacgtctttacgtacgtcgtacgaccggtctacgaacgcgtacgngtacgggtcttaacggttgccgttacgggtacggttacggtcgggaggtacgtccggtaacggtccgttaccgtaccggtacggtacgtccgacgttaacccgcggtccctcccgggttcccgttaggccc

SEQ ID NO: 75488 - DNA, 782 bp, Homo sapiens
  misc_feature: GYAE6OF02FIVUC.49.20.B09.1.454.CMB.1.raw
  modified_base (222)..(222): a, c, t, g, unknown or other
  misc_feature (222)..(222): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctctatgagctgacacagtccacccgtcggtgtcttgtgtcctcgaggacagacggccgaggactcaccgtgcttcgngggacgtatacgctattcggaacctaaaaaacgtaacttattcggtactttaccggtacggtaaccaggacgaacggaggaccccgagggaccccgaccggtccccgttggttccggtttggtagttaattttaacgtaaaacgttcttttgggacggtaaccggtcccctacgggtaccgggacccccgttaggtaacggaccgttacggttttctaccggttcgggtccctaacggtaacgttccgtaacggacggggtaaacctaaccgtaacgtacccgttaacccttacgaaccttacgtacggtacggttacgggaaccgttaccgggccgtaaggaccggtacgggaaacggtcgttacggactttaagttacgttcgtaacgtaccggtaccgacacggtacgaacggtcgttagggacgtacgtacgtttaaggcgttacgttaggtccggggtaacggtagtaccggttacgtaaccgtccgggtaccgttaccgtacggaccggtacgtaacccgtacggtccaccccggttacccggtcgttaccccg

SEQ ID NO: 75489 - DNA, 567 bp, Homo sapiens
  misc_feature: GYAE6OF02FKH7I.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaaacatatgcttactggtaccagcagaggccaggccaggcccctgtcttggtgtatttataaagtctttgagacggccctcgacgggacccctgacgcgattctctggctccagctacgagggacaactagtccaccgttgacctatcaggtgacgtccggccaaggtacggacgaggctacggacttaagttactcgtacacggtccactacgactaggcaggtcgactaagtttactggttcgtacgttcgggacgggtacgggactacggtcgtacgtacccggttcgtaacggtcacgtcccgaaaggccctccggtcccccgtggttacccc

SEQ ID NO: 75490 - DNA, 775 bp, Homo sapiens
  misc_feature: GYAE6OF02I3N9Z.49.20.B09.1.454.CMB.1.raw
tcagagtcgagagacacgaccggtgctcgatttagtgtagtgtgaaggggggctgtgggtccaggaggcagaactctgggtgtctcaccatggcctggatccctctacttctcccctcctcactctctgcacaggctctgaggtcctcctatgagctgacacagtcaccctggtgtctgtcgtcctcgaggacaggacggcaggatcaccgtgcctcgtgggctatgcattcgaccaaaaacatactgtcttactggtaccagctagacggccagggccaacgggcccctggttccttgggtcgtagttttaacgtaaacggtacttttaggaaggtacgggtaccccttacggaacggggtaaccccctagggaacggtccggtaaagtttccgtcgttacgggccttcccgacggtaccgttcggaacgggaacctaaacgtacggttacctacccgtttagaaccctaactacgaacggttacgggtacggttaccccggggaccgaacgggacgggtaaccggaacgggtccgttaacggtaaccgttaagttaccgttacggttacgtaccggtacccgacgtaccggaacgtacggaccgtaagggtacgggacttaaggtttacgttcggttacggttacggttaccgggtacgggtaacggggtaccttaaccgggcggttaccgggacccggttaccggtacgggttaccgtaccgggacccgtaaacggggtcccgttacccggtcccccggttacggtaccccg

SEQ ID NO: 75491 - DNA, 599 bp, Homo sapiens
  misc_feature: GYAE6OF02G67CR.49.20.B09.1.454.CMB.1.raw
  modified_base (185)..(185): a, c, t, g, unknown or other
  misc_feature (185)..(185): n is a, c, g, or t
  modified_base (242)..(242): a, c, t, g, unknown or other
  misc_feature (242)..(242): n is a, c, g, or t
  modified_base (286)..(286): a, c, t, g, unknown or other
  misc_feature (286)..(286): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctnacggacagaccggccaggactccgactgctcgtggcgatgcattcgaccaaaacatntgcttactgtaccagcagagccaggccacggccctgtcttggtntattataagtcttgacggtcgccctacgacggaccctgacgtcgtattcctcgtcggcctcgacgtctacggacggtaacaacgtcgtacctacgtacgaccgtatacgagtcgggtacgtcccgggacagggacggacggaggtctacggtaacttagttacgtagcgtacgtccgaacgagtacgaagccgaggtcggacgttagttagtcggttaccgttaggttccggggaacgggtggtaccgtacggtcgtacgtaccggtcgtacggcgacggtacccgaggtcccgtccgtaccccggtcgtacc

SEQ ID NO: 75492 - DNA, 665 bp, Homo sapiens
  misc_feature: GYAE6OF02GZ83Z.49.20.B09.1.454.CMB.1.raw
  modified_base (297)..(297): a, c, t, g, unknown or other
  misc_feature (297)..(297): n is a, c, g, or t
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgacggcctctatgagctgacacagtcaccctcggtgtctgtgtcctcaggacagacggccaggatcactgctctggcatgcattcgaccaaaaacattatcgcttacgtggtaccagcagacgccacggccacggccccttgtcttggtagtatttaanaaagtactttggaaggtacgccctacgacgggtacccctggacgcgtaattctacgtcggcctcgagtccgtacgacgggaaccaaacgtacgtacctaaccgtttacggaacctacgtacgtaggtacgggtaacggtcccgggaccgaagggaacgggtacggacggtacgtaggtaacttagttacgttacgtacgtaccgttaccgacgacgaacgacgtacgaggtcgacgtagtttacgtaggttacgttaggtcgggtaccgggtaggtaccgttaccggtacgttccggtaccggttaacccgtacggttaccgaccggaccgtaaaccggtccgttacccgtccccggttcggtaaccc

SEQ ID NO: 75493 - DNA, 793 bp, Homo sapiens
  misc_feature: GYAE6OF02JJRYU.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacaggaccggccaggatccacctgctcgtggcgatgcattgaccaaaaacatatgctttacgtcggtaccagcaagacggccaggccacggtccccctgttccgttgggtacgtattttaagtaaaacgtacgttttaggaacggtacgggtcccctaccggtaacggggtacccccttggaacggtacgtaacttttccgtaccgtgggtccctaccgtaacgtccgttacggaacggggaaccaaaccgtacgttaccctaaccgtttacggaaccctagttaccgaacgggttcgggaaccggttccccggaaccgtagggaacgggtaacggacgggtccgtacgtaaccttacgtttaacgtcgttaccgaccggttacccgacgaacggtaccgaaggtaccgaacgggttacggtaaccgttaacggttttacgttaccgggtttaccggttacggtttacccggggaccggggtacgggtaacccgttaccgggtaccgttaccgggtaaccccgttccggttaacggttaccgaacccggtacccggtaaccgggttacccgtcccccgggttacccccgttaccgggttacccc

SEQ ID NO: 75494 - DNA, 548 bp, Homo sapiens
  misc_feature: GYAE6OF02FHH0I.49.20.B09.1.454.CMB.1.raw
  modified_base (466)..(466): a, c, t, g, unknown or other
  misc_feature (466)..(466): n is a, c, g, or t
  modified_base (477)..(477): a, c, t, g, unknown or other
  misc_feature (477)..(477): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcacaggctctgaggcctcctatgagctgacacagtcaccctcggtgtctgtgtcctcaggacagacggccaggatcacctgctctggcgatgcattgaccaaaaacatatgcttactggtaccagcagaggccaggccacggcccctgtcgttgggtgtaatttaataaagtactttgaagacggccctcgacgggaccccctggacgcgattctcgtcggcctccgacgctcgaagggacaacgagtccaccgttcgaccatcgagtggacgtcccggccaggacgggacgagggactagacttacgttacgtagtcacgtccgcacgcagcgtagnggactagttangtcgtcgtcggacggtaggactacggctcgaccgtcgtagccgacgcccgaaggcctccgcccgtcggtcc

SEQ ID NO: 75495 - DNA, 766 bp, Homo sapiens
  misc_feature: GYAE6OF02IO858.49.20.B09.1.454.CMB.1.raw
  modified_base (439)..(439): a, c, t, g, unknown or other
  misc_feature (439)..(439): n is a, c, g, or t
tcagagtcgagagacacgaccggtgctcgatttagtgtagtgtgaagggggctgtgggtccaggaggcagaactctgggtgtctcaccatggcctggactccctctacttcctccccctcctcactctctgcacaggctctagcggcctcctatgacgctgaccacgagtccaccccgttcggtgtcgtgtcgtacctcgaacggacaacggaccggaccgtaaggactcctaaccgtcgtccgtcgtacgggcgtaactcgacagttacgaaacctaaaaactatacgtgtaccttacgcggtaaccaagctaggacggccacggccgaccgtcccgtgttacggttggtataatttaacgtaaacgttacgttggaacgccgtcccgtacggaccggtaccctggacgtctacttccgtcgtcgcctacaccgtacncgaaacgacgaaccacgtactacgttacggtacaccgtaactacggacgtacgggtacggtacccggacggaacgggacggaaggtacggaccgttagtaacgttaaacgttacgtgttaccgtaacggtactaaccgtcgtaaaaccgtataacgggttagggttaccggtacctttaagtttcccgtttaaggtaaccgggttttcgacccgggggacgggtaaaccggtaccgtaaaccggttcgttacggtaaccccgggttacggtaccggtaccggacccggtaaccggaccggtttcccgacccgttacccccggttacg

SEQ ID NO: 75496 - DNA, 721 bp, Homo sapiens
  misc_feature: GYAE6OF02GUWCF.49.20.B09.1.454.CMB.1.raw
  modified_base (176)..(176): a, c, t, g, unknown or other
  misc_feature (176)..(176): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtggtntctgtgtccctcgaggacaggacggcctaggactccacgtgctctgggacgtatgacctagttacgaaccctaaaaatattagtcgtactttacgtcggtaacacgacgacggaggcccgaaggacccgacggtcccccttggttaccgttgggttacgttaatttttaacgtaaaacggtcgtttttaaggacggtaacgtccccgtacgaacccgggacccttggagtaccgtcttcgttcgtcggtccttaccgaggtcctaccggagggaaccctaacgtaccgtacccgtacgttacggaaccagtccgtaggtaccggacggtcccggaccgaggacggacggacgtctaggtaccgttagttcgtgttaccgacgttcccgagtacgaaccgtcgagtacgggtcgtaacgtagttgtttcggtacgtttaacgggtggtacccgggtacggtactaccggtcggttaccggacccggtttcgaacgggttcccgacgtaccggacggttcccgtacccgtccccgttacgtaccccg

SEQ ID NO: 75497 - DNA, 760 bp, Homo sapiens
  misc_feature: GYAE6OF02IV9L9.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctcccccctcctcactctctgcacaggctctgaggcctcctatgagctgacacagtcaccctcggtgtctgtgtcctcgaggacagacggccaggatccacctgctctggcgatgctattacgacccaaaaactaatagtgtacctttacgtacggtaccaggtacaggacggcccgacgggcccgaaccggtccccccgttggttccgttttacggggtgttaagtttttaaagtaaaacggttaccgttttacgggaaggtacccggtccccgttacgaacccggggtaccccctagggaacgtccgttaattccgtacgttcgggtacctcccgacgtccgtaccgtaacggggaaccaaacgtaccgtacctaaccccgtttacggaacccctagttaccgtaagggttacgggtaccggttccccggggtaccgtaagggtaaccggggaccgggtaacggtaccgttaccggtaaccgttaacgtttaaccgtcggtttacccgtacggttacccgaccgtaaccggacgtaccggtactagggtccgacgttagttagttccggttacggttacgttcgggacgggtcgtacgtcggctacggctaccgtgtccgacgtaccgcgcctcccggtccccgtgtcc

SEQ ID NO: 75498 - DNA, 757 bp, Homo sapiens
  misc_feature: GYAE6OF02HZMZ8.49.20.B09.1.454.CMB.1.raw
  modified_base (315)..(315): a, c, t, g, unknown or other
  misc_feature (315)..(315): n is a, c, g, or t
  modified_base (700)..(700): a, c, t, g, unknown or other
  misc_feature (700)..(700): n is a, c, g, or t
  modified_base (726)..(726): a, c, t, g, unknown or other
  misc_feature (726)..(726): n is a, c, g, or t
tcagagtcgagagacacgaccggtgctcgatttagtgtagtgtgaagggggctgtgggtccaggaggcagaactctgggtgtctcaccatggcctggactccctctacttcctcccctcctcactctctgacacgaggtctcgtggacggccttacctagtgaacgtcgtagaaccacgtacgtcctacccgttggtacgttcgtcggttccgtaccgtacggaacggaacacgggaccggacgtaaggtactacctacccgtgtccgtcggtacgggacgtactacgtaccgtaagttaccgaaaaccaaaatnttacgtacgtaccttacggtacggtaaccgacgacgtaggaccgccgacggaccgtaccgttccgtacggttcgttagtaacgttttaacgtttaaaaggtaacggtacgttttacggaacggccccgttaccgtaccgggaaccggttaccccgaggttaccgtcgtaccgtttccgtaccggtacgtcccttaaccggacgtccggtaagtaaccggaacttacgaaccgttaaccgtacgttaccacgttactcgggtaggtacggtaccggaccggtacgagggacgacggtcgcgtaacgttacgttacgtacgttccgtagtccgacgtagacgtagaccgtgaaggtcgtaatcggtttatcggtacgtcggtacggngtacgtacgtgcgtacgcttcggacncgtacgaccgtccgaccgtccctacgctacg

SEQ ID NO: 75499 - DNA, 747 bp, Homo sapiens
  misc_feature: GYAE6OF02IZG1Q.49.20.B09.1.454.CMB.1.raw
  modified_base (131)..(131): a, c, t, g, unknown or other
  misc_feature (131)..(131): n is a, c, g, or t
  modified_base (176)..(176): a, c, t, g, unknown or other
  misc_feature (176)..(176): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcanaggctctgaggcctctatgagctgacacacgtccacccttcggtntcgtgtcgtcctagacggacaggaccggacgaggtatccgtacctgtctcggtcggacgtatcgactacgttcgaaacccaaaaactatactcggtacttaaccgtcggtaaccagacgaaggacggaccgacggcctaccggtccccgttggtttcgttacgggttataacgttttaagtaaacggttacgtttaggaacggtccggaccctaccggaccgggtacccgtaggacggtacgttaccgtcgtacggtcggtacctccgaagtccgtacgaacggtaccaacgacgttaccaaccgttacgactacgtaggtaccggtaggacccggttacggaccggaggtaacggaccgacgggtaccttaacgtaacgttttcgttaacgtcggttaaccgaccgggtaccgaactaacgggactacggcgtaggttacgacgtttacgttaacgttcgtaacggttacgggtccgggacggtcggaaccgtccggtagtaccccggttaggtaccctgggttacccacgtccggtacgtcccggttaacccggccctcgggttacccc

SEQ ID NO: 75500 - DNA, 726 bp, Homo sapiens
  misc_feature: GYAE6OF02HCLHP.49.20.B09.1.454.CMB.1.raw
  modified_base (575)..(575): a, c, t, g, unknown or other
  misc_feature (575)..(575): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagaccggccaggactccactgctcgtggcatgccattcgaaccaaaaacatagtcgtacttacgtacggtaccaagccgaaggaacggccaacgggaccctaccggcccccgttggttaccgtttgggtagttaactttttaaacgaaaagttaccttttgggaaacggtccggtaccccttacgggacccggggtacccctgggaacgtccggtaactttccgttccgtacgggtcctccgtaacggtccttacggaacgggaactaaacctaaccgttcaacccgtttcgaacctagtaccgaaggtccgggacggttccgggaccgaagggaacggtacggacgtacgtaactacgttatttacgtcgtacgacggtaccncgaacggactacggcgtaacgggtgtaactacgtttagtcggttacggttcggtcgggggtacggtacggtaaccgtcgtaacggtcgtaacccggtacgttaccgggacaccggacggaccggtccgaccccggttcccgtcgtacccgg

SEQ ID NO: 75501 - DNA, 539 bp, Homo sapiens
  misc_feature: GYAE6OF02ILQY5.49.20.B09.1.454.CMB.1.raw
  modified_base (130)..(130): a, c, t, g, unknown or other
  misc_feature (130)..(130): n is a, c, g, or t
  modified_base (165)..(165): a, c, t, g, unknown or other
  misc_feature (165)..(165): n is a, c, g, or t
  modified_base (179)..(179): a, c, t, g, unknown or other
  misc_feature (179)..(179): n is a, c, g, or t
  modified_base (243)..(243): a, c, t, g, unknown or other
  misc_feature (243)..(243): n is a, c, g, or t
  modified_base (246)..(246): a, c, t, g, unknown or other
  misc_feature (246)..(246): n is a, c, g, or t
  modified_base (309)..(309): a, c, t, g, unknown or other
  misc_feature (309)..(309): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (400)..(400): a, c, t, g, unknown or other
  misc_feature (400)..(400): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
  modified_base (427)..(427): a, c, t, g, unknown or other
  misc_feature (427)..(427): n is a, c, g, or t
tcagagtcgagagacacgaccggtgctcgatttagtgtagtgtgaaggggctgtggtccaggaggcagaactctgggtgtctcaccatggcctggatccctctacttctccccctctcactctctgcacnggtctctgacggtccctctatgagctaggacacgngttccaccctggtntctgtgtccagaggacagaccggcaggtatccgctgctcgtggcaatgcaattgaaccaaaaanatntgcttaccgtggtaccaggacagacgcaggcacggccctgtctgtgattataagctttgaacngcctacgaggtacctgacgcattactcgtcgctcgagcctgaggacaactagcaactttgacctanccgancggagtccgcagagacgagntcgatnttaacncgttacgcgacgcanacgtacgaacgcgtaggacgtagttacctgtctacgttaagccggaggaacgtacgtcgtcgaccgtactaacggttcacgccctaagccggtaactccccgtaggttaccc

SEQ ID NO: 75502 - DNA, 689 bp, Homo sapiens
  misc_feature: GYAE6OF02FTSBP.49.20.B09.1.454.CMB.1.raw
  modified_base (173)..(173): a, c, t, g, unknown or other
  misc_feature (173)..(173): n is a, c, g, or t
  modified_base (184)..(184): a, c, t, g, unknown or other
  misc_feature (184)..(184): n is a, c, g, or t
  modified_base (238)..(238): a, c, t, g, unknown or other
  misc_feature (238)..(238): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcacctggtntctgtgtcctnaggacagacggccaggatcacctgctctggacatgcattcgaccaaaacattangacttactggtaccagtcagtaggccaggccaggcccctgtcttggtgtattagtaaagtactttaggagtacggccctcgacgggtaccccttggacgcgtattcctcgtcggtctccgtacgtacctaccgtaacggggaccaaacgtagtacctacccgttaggaacccagtaccctaagggtacggtacgggttcccgggacccgagggtaaccgggacggtaaacgggtccgtacggtaaaccgttattaaccgtgttaccgacgttcccgacgtacggacgacgacgtacggtcggacgtacgttacgtcggtacgttacggttacgggtacgggtacgggtacgtaccggtcgttaaccggtacccggttaccgttaacgggtaccgtacggtacccggttaaccggaccggtttcccgggaccccccggtagggttaaccccg

SEQ ID NO: 75503 - DNA, 725 bp, Homo sapiens
  misc_feature: GYAE6OF02IAT6K.49.20.B09.1.454.CMB.1.raw
  modified_base (437)..(437): a, c, t, g, unknown or other
  misc_feature (437)..(437): n is a, c, g, or t
  modified_base (719)..(719): a, c, t, g, unknown or other
  misc_feature (719)..(719): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacgcctcctagtgagctgacacagtccacccgtcggtgtctgtcgtcctacgaggacacgacgcaggactccaccgtgcgtcgtacggctagtcgtctaacgttacgaaacctaaaaacgtattagtcgttaccttacgtacggtaaccgagacgtacggaccggtaccgacgggacccgaccggtccccgttagtttcgttagggttactttaagttttaaacgtaaacggttcgtttaggaacgtaccggtcctacggacccggtacctgacgtctacttccgtcgtccgctacncggtactacgggaacgaacctacgtcgtacctaccgtacgtacctagtcggtaggtcgggtacccggtacccggcggtaagggtaccggacggtcgtactaacggttaacttacgttcgaccgttacgacggtccgaagtacgacgtacggtacgtacgtcggggtataacggttacgttacgggtaccgttagggtcggggacgttaccgggtacctacggtccgtaaccgtcgttaaccgtcgaccgaaccggtccgaacgtcccgtacccgtcccggtntacccg

SEQ ID NO: 75504 - DNA, 683 bp, Homo sapiens
  misc_feature: GYAE6OF02JT4RG.49.20.B09.1.454.CMB.1.raw
  modified_base (141)..(141): a, c, t, g, unknown or other
  misc_feature (141)..(141): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctcgnggacggcctcctagtgacgctgacacgacgtccacccgttcggtgtctgtcgtcctacgagggacaggaccggccaggactcctacctggccttcgtgggacgattgctattacgaacccaaaagtactagtcgtcttacgtggtaccagcgacggacggaccgacggaccctacgggccctagttacggttggtacgtaattaagtaactacgttgacgtccggcctacggaccggtcccgtagacgtcgtacttctcgtcgtcctacggctcgtacggaacggtacaacgtaccgtactaccgttacgacctacgtacgacggtcggaccggtccggaacgtacggaggacggacgtcgttacggaacttcgtaacgtcggtacaccggtaccgagtaccgagtacggcgtacgggcggtaactacggttacgttcgttacgtcggtacggggacgtccggacgttaccgcggtacctaccggtccgacgtacccgacggtacccgtccggacccgtcccggttaccccgtcgtaacccg

SEQ ID NO: 75505 - DNA, 745 bp, Homo sapiens
  misc_feature: GYAE6OF02I7Q29.49.20.B09.1.454.CMB.1.raw
  modified_base (246)..(246): a, c, t, g, unknown or other
  misc_feature (246)..(246): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtggtgtctgtcgtcctcgaggacaggaccggccaaggactccacctgctcgtgggcgatgcattcgaccaaaaanatatcgcttacgtacggtaccagcgaagacggcccgacggccaccggccccttgttcgttggtagtactttaagtaaagtcgttttaggacggtacggtacccctcggaacccgggtaccccttaggacgtcgttacttccgtacgtggtccctaccgacgtcctacggaacgggaacctaaacgtacgtcctacccgttacgacccagttaccgtacgggtacgggtaaccggtcccggaaccggaagggaaccggggaacgacgggtaccgtacggaactttaacgtttacgtaggtaccgtaaccgtacgtaactaccgtaacggtacgtaacggttggtaccggtaccttaacgtttcgttaggttaccggttaacggttccggggacgggtaaccgggtacccgtacggtccggttaacggtaccccggttacccgtagggttacccaacggtacccggaacggtcccgtcccccggtaccccgttggtacccc

SEQ ID NO: 75506 - DNA, 825 bp, Homo sapiens
  misc_feature: GYAE6OF02GLIJ9.49.20.B09.1.454.CMB.1.raw
  modified_base (176)..(176): a, c, t, g, unknown or other
  misc_feature (176)..(176): n is a, c, g, or t
tcagagtcgagagacacgaccggtgctcgatttagtgtagtgtgaagggggctgtgggtccaggtggcagaactctgggtgtctcaccatggcctggatccctctacttctccccctcctcactctctgcacaggctctgaggcctcctatgagctgacacagtccaccctcggtntctgtgtcctcgaggacaggaccggccaggatcacctgctcgtggcatgcctagttcgaaccaaaaacatagtgtaccttacgtacggtaccagacgaaggacggccgacggacccgaccgggtacccccgttggttccgtttaggggtagttaaacgtttttaaacgtaaaacggttaccgttttagggaacgggtaccggggtccccgttaccgggtaacccggggtacccccgttagggaacggtacccgttaattttcccgttccggttcgggtacccttaccggtacgtccgttacgaacggtaccgaaacgtaaaccgttacggttaaccgtaccggtttaccgaaccgtacgttacggtacgggtacgggacgggtacccgggacggaacgggaacgggaacggacggtacgtacggtaacgttacgttaccgtcgtacgtacgtctaacgtcgaacggtaacgtaggtacggttcgtaccgttacgttaccggttcggttacgggttaccgtttaccgggggtaccgggtaacggggaacccgtaacgggtacgttaacccgggtaccccggttacggtaaccggtacccgaaccggtaccccgtaaccggtccccgttaccccggccccccggttaccgg

SEQ ID NO: 75507 - DNA, 723 bp, Homo sapiens
  misc_feature: GYAE6OF02GJ74Y.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgctattcgaccaaaaacatatgcttactggtaccagcagagccaggccacggcccctgtcttggtgtatttaataaagtactttagaaggtacggccctcgacgggacccctgacgcgtacttctcgtcggtctcagctacgacgggtaccaaacgtacgtacctaccttacgaacctacgtcgtaggtacgggaccggttacccgggaccgtaacgggacgggaaccggtacggggccgttaaggtaacctttaacgtttaccgtcggttaccgtaacggtccccggacgtaaacggaacgacgtaccggtagggttacgggacgttaacggttttagtaacggtttccggttaagggtttccggggacggggtacggggttaaccgtccgggtacgttaccggttaacccggttaccggttaaccgggtaccgttaacccgggacccgtaaacggggttccccgttaccccgggttaccccccggttacgggttaaccccg

SEQ ID NO: 75508 - DNA, 882 bp, Homo sapiens
  misc_feature: GYAE6OF02H2YHF.49.20.B09.1.454.CMB.1.raw
  modified_base (819)..(819): a, c, t, g, unknown or other
  misc_feature (819)..(819): n is a, c, g, or t
tcagagtcgagagacacgaccggtgctcgatttagtgtagtgtgaaggggcgtgtgggtccaggaggcagaactctgggtgtctcacatggcctggatcctctacttctcccctcctcactctctgcacaggctctgagcctcctatgagcctgacacacgtcaccgtcggtgtctgtcgtcctcgaggtaccaggaccgcaggactacaccgtgctcgtcggacgtagtcgacttattcggaacccaaaaagtacttaagtacggtacttttaacggtacggttaaccgagtaccgaaggtacgtaccgtaaacggcccggtaaaccggtacccctttacgggttacccgtttgggggttaacctaaggtttttaaacaaaaaacggttcccgtttttaggaacggtaacggtccccggtaacgtaacggggttaacccccgtaggtaacggtacccgtaacgtttccgtcgtacgggtacccttaccgaaggtccctttaacgggaacggaaaccttaaaccgaaggtttaccctaaccggtttacgaaacccggtttactaccgttaaggtacggtaaccgggttcccggaaaccccgtaagggaacgggtaaacccggtaggtacccgtaggtaaccttaacggttaaccgttaccgtacgtacgttacccggtacaaacggtcggtaaccgttacggacggtttaccgggaccgttaagtaacgtttcggtaacgtttacgggtacgggttaccggaaacgggtttacggaacccgtttccgtaccgggttaccgttaccggttaaacccggtntttaacccgggacctaacggtttaaccccggtttaccgacccccggtttaccgggttaacccg

SEQ ID NO: 75509 - DNA, 718 bp, Homo sapiens
  misc_feature: GYAE6OF02I89VU.49.20.B09.1.454.CMB.1.raw
  modified_base (241)..(241): a, c, t, g, unknown or other
  misc_feature (241)..(241): n is a, c, g, or t
  modified_base (290)..(290): a, c, t, g, unknown or other
  misc_feature (290)..(290): n is a, c, g, or t
tcagagtcgagagacacgaccggtgctcgatttagtgtagtgtgaagggggctgtgggtccaggaggcagaactctgggtgtctcaccatggcctggatccctctacttctcccctctcactctctgcacgaggctctgaggcctctatgagctagacacagtccacccgtggtgtctgtacgtcctcgaggacagacggaccaggatcacctgctcgtggcatgcaattcgaccaaaaanatatgacttactggtaaccagcagagccaaggcaggccctagtcttggngactttaagaaacgtactttgaacgtacggtacccctacgacggggtaacccctggtaacgtccggtaaacgttaccttaccggtacggggtccctttacccgtaacggacccgtttaaggaacggggaaacctaaaaccgtacgggttaccctaaacccggtttaggaaaccctaacgtttccgaagggtttaccgggaacgttacccgggtaccgaaaggacggaacgaagggttctaacgggtaacttaacgttaacgtagtaaccgtaggtacccgtagaaacggtacgaacgtaccgtacggtacgacgtacgttaacgtcggttacggttaaacgtacgggtacgggtaagggtacctacggtaccggttacgaccgtacgtaagttcgacggtaccaacggccgtacgtcccgacggttac

SEQ ID NO: 75510 - DNA, 723 bp, Homo sapiens
  misc_feature: GYAE6OF02GHCIK.49.20.B09.1.454.CMB.1.raw
  modified_base (429)..(429): a, c, t, g, unknown or other
  misc_feature (429)..(429): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcacccgtggtgtctgtgtcctcaggacagacggccaggactcaccgtgctcgtggcgatcgcattcgaccaaaaacatacgtgacttacgtcggtaccagacaggacggccacggccacggtcccctgttccgttggtactaattttaacgaaagttaccgtttggagtaccggtcccctagaccggtaccccgtggagtaccgtattccgtcgtacgggtcctccgaacgtccgtacggaaggaacaacgacgtctaccgtttnaacccgtaatacgacgggttacggaccggttaccggaacgaacgggacggaaccgtacgggtaccgtacgtaaactttacgttaaccgtggtaccgaccggttaccgaacgacgtaacgtacgacggttaaggcggtactaaggtttactcggtttaccgtaggttccgggtacgggacgttaccggtaacggtcggttaaccggtacccgggttaaccgttaaccgggtcctaaccgggttaccccgtaacgggttaccccgtacccggttacccccggttccgttaaccccg

SEQ ID NO: 75511 - DNA, 760 bp, Homo sapiens
  misc_feature: GYAE6OF02GNAPB.49.20.B09.1.454.CMB.1.raw
  modified_base (603)..(603): a, c, t, g, unknown or other
  misc_feature (603)..(603): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcacaggctctgaggcctcctaatgagctgacacagtcaccccgttcggtgtctggttcgtcctagaacggacaggaccgcaggactccacctgcctcgtggcatcgctagttacgaacccaaaaataatacgtcgtactttacgttcggtaaccagaccgtaggaccggaccacgggacccaccggttcccccttaggttcgtttagggtagttaacgttttaaacgtaaacgttacgtttaggaacggttacccggtcccttaccggaaccggggtaccccgttggacgtaccggttactttaccgtccggttacggtccttaaccgagtaccgtacgaacgggaccaacgttacgtccctaaccgttccgaactactacggacggtcggaccggtccgggtacgaacgggtacgggaccgggacgtccgttaactaaccgtttacgttaccgttgtaccgtaacggtccgaanagtacgagtacgacggtcggtaaccttaggttacgttacggttacggttagtaccggggacggtacggttccgtaccggcggttaccggtacccgttaccgttcggtaaccgtccggaccggtaaccgtccggttacccgtacccggtgtaaccccg

SEQ ID NO: 75512 - DNA, 761 bp, Homo sapiens
  misc_feature: GYAE6OF02JLVO5.49.20.B09.1.454.CMB.1.raw
  modified_base (177)..(177): a, c, t, g, unknown or other
  misc_feature (177)..(177): n is a, c, g, or t
  modified_base (251)..(251): a, c, t, g, unknown or other
  misc_feature (251)..(251): n is a, c, g, or t
  modified_base (752)..(752): a, c, t, g, unknown or other
  misc_feature (752)..(752): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagcctgacacagtcacccgtcggtntctgtcgtcctacgaggacagacggccaggactcacctgccttacgtcggcgatcgactacttcgaaccaaaanatatcgtacttacgtacggacctagcgaaggaccggtccgacggaccgtaccggtccccgtggttacggttggatagtagtaaagtaacgacctacgtaggacgaccgtacccgtagaacggtactccgtaggacgtcgttacttccgtcgtacggtcctaccggtacggtaccggaacgggtaacccgtaaccgggtactaaccgtacggttaccgggtacccgttaagttacccggtaaggggtaccgggttaaaccccgggtaccgtaaccgggggacgtaacggggggaaaccgggtaacccgggcggttaaacggttaggtaacccgtttaagttaccgttacggtaacttaacgaccgaaaccggtaactacccgtaacgttagttaaaccgggttcttacgttacgttccgtaacggacttagacccggtaacgtaccgttcccggtacgtccggtacgttacgaccgacccgtaaccgaccccgtaacccttntaccgtccc

SEQ ID NO: 75513 - DNA, 692 bp, Homo sapiens
  misc_feature: GYAE6OF02IZLX1.49.20.B09.1.454.CMB.1.raw
  modified_base (134)..(134): a, c, t, g, unknown or other
  misc_feature (134)..(134): n is a, c, g, or t
tcagagtcgagagacacgaccggtgctcgatttagtgtagtgtgaagggggcgtggtgggtccaggaggcgagaactctgggtgtctcaccatggcctggatcctctacttctcccctcctcactctctgcacnggctctgaggcctcctatgagctgacacagtcacctcggtgtctgtggtacctcgaggacagacggtccaaggatccacgtgctcgtggcatcgctaattcgaaccaaaataatatcgtctacgtacgtacgagacagacggaccgacgaccgacgtcccgtcgttacgttcggtagtatttaagtaaacgtacgtttagacggacggtcctacggaccgggacccctggagtccgtagttctcgttcggctccaggctacgcggaactaacagtccaaccttcgacctacgtacgtacgtacgggttacggccggtacgagggtacggaaacgggtcggtacgtacgtagttaccgttacgttacgtacgtacgaccgtcgaaccgtaacggcaacgtcggtacgtacggaagttttacgtgttacgggtacgtttacggggccgtagggggacctttaacgggccgtttacggaaccgggttcccttaacggggttccggtaacgggtccccctaaaggggtccccgtacgggtaacccccccttcgggttccccg

SEQ ID NO: 75514 - DNA, 806 bp, Homo sapiens
  misc_feature: GYAE6OF02G96LK.49.20.B09.1.454.CMB.1.raw
  modified_base (626)..(626): a, c, t, g, unknown or other
  misc_feature (626)..(626): n is a, c, g, or t
  modified_base (635)..(635): a, c, t, g, unknown or other
  misc_feature (635)..(635): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcacaggctctgacgcctctatgacgctgacacgagtccacccgtggttgtcctagtcgtcctagacggacacggacggccaagggacttaccgaccttggaccttacggtacggactattcggacgttaagttaccgaacctaaaaaaacgtagtttcgtaccggttaccgtttaaccgtacgggttaaccctacggacgtaacggtaacggtacccgtaaccgggaccctaaccgggtcccccttagggtttaccgtgggttaaccggtaattttaaacgtaaacggttcgtttaaggaaccggtacggttcccttaagggaccgggtacccctaggtacgtaccgtatttccgacggttggacccttcgagtacctacggacggtaactaacgtacggtacttaacccgtgaaccgttagacgtaacggtcgtaaccgggtccgacgacggacggtaacgtcggacgtacgactttaacgttaacgtcggttaacnccgtaccgngtaacgacgtacggtaaccgtacgggtacgtacttaacggttagtcgttaacggacggtttacgaccgggtaacggtactaccgggaccgttaccggtaaccggttccgttaacggtacccgtaaccggtaccgtaacggttcccgtaacccggtcccgttaagttccccg

SEQ ID NO: 75515 - DNA, 914 bp, Homo sapiens
  misc_feature: GYAE6OF02JWBIF.49.20.B09.1.454.CMB.1.raw
  modified_base (142)..(142): a, c, t, g, unknown or other
  misc_feature (142)..(142): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctagnggtccctacctaagtcgacgctgtacaacgtcgtccacccgttcggtgtcgtcgtcgtcctacgagggaccgagaccggccgaggtacaccgtaccgcgtctccgtaggcgtactcggactcttaccggaactaaaaaccggtatacgttccgtacgttacgacggtaccagaccgtacggacggacgaacggacccgtacggaccccgttgttccgttagggttacgtaatttaacgtaacgtacctttaggaacggttacccgccggttaccgaaccggggtaccccgttagtacggggtacctacggtttcctaccggttaaccggtcccttaccggaccttacgggtaccggaaaccgggtaaccgttaaacggtccgtaccggttaaaccccttacggtaacccgtcggtttaaacgtaccgggttacgggttacccggaaacccgggttccggtaaaccgggtaacggggtaaccgttacggggttaacgttaacccggtagttttaacccggttacgttaacgggtttacccggttacccggtaaacccgttacggtaaaccggtaccggtaacggtaaccggtacggtaaaccgggtcgtttaaacgggttcgtttaaccgggttaccggttacggttaacgggtaccgggtacgggtacggttacccggtacgggtttaacccggtacggttccggttaccggtaacgtacccgtccggtaaccgggttcccgtttcccgggtacccgttcccgttaaccggg

SEQ ID NO: 75516 - DNA, 753 bp, Homo sapiens
  misc_feature: GYAE6OF02IWQBM.49.20.B09.1.454.CMB.1.raw
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (728)..(728): a, c, t, g, unknown or other
  misc_feature (728)..(728): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacgaggctctgaggcctctatgagctgacacagtccacccgtggtgtctgtgtacctcgaggacaggaccggtccaggactcaccgtgctcgtggacgatgcctattcgaaccaaaaatatatcgtcttacgnggtaaccngacgaggacgccgaggaccctacgggccccctggttcgttcgggtagtaagttttaacgtaaaacggtacgttttaggaacggtaccggtccccgtacggtaaccggggtaccccgtaggtaacggtccgtaagttttcccgcggtttccggacttccccgaagtccgttacgaaggggaacctaaccgagttccctaaccggtttacgaaccgacgttcgaagggtacggtaaccggtcccggtaccgaacggacgggacggtacgggtaccgttaggaacctttagttaccgtacgttacgaccgttaccggacgtaacgacgacggacgtagttacgggtactacggtttaaattccggttcgttaaacgggtcgggtaccgggagggtaaccttagggcccgttacggtacccggttacgacgggttacccaagggtcccgaaccggttcccnccggtacccccggttggtaaccccg

SEQ ID NO: 75517 - DNA, 668 bp, Homo sapiens
  misc_feature: GYAE6OF02HOI9V.49.20.B09.1.454.CMB.1.raw
  modified_base (242)..(242): a, c, t, g, unknown or other
  misc_feature (242)..(242): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgagcctcctatgagctgacacagtcaccctcggtgtctgtcgtcctacgaggacacgacggccaggactcacctgctcgtggcgatcgctattcgaccaaaanatatgtcttactggtaccagcagacggccgaacggccgacggccctgtcgttggtagtatttaagtaagtacgtttgacgacgtccctacgacgggtaccctgacgacgtacttcgtcgtcggcctccgagtcctacgacgggtaacaaacgacgtacctaccgttacgaacctacgtaccgtagggtacgggaccggttaccccgggaccgaaaggggtaaccgggaaccggtacgggtccgttaacgtaaaccggtttaacttaacgttcggtaaccgtaccgcccgaactaacggaactacggaccgtaggtcgacgtagtttacgtggttacgtacggttacgggacgggtacggtacgtacgtcgtacgtcccggtacgtacggcaccggaccgtacggtcctcccgtcccgtgttacccg

SEQ ID NO: 75518 - DNA, 722 bp, Homo sapiens
  misc_feature: GYAE6OF02FQ8L6.49.20.B09.1.454.CMB.1.raw
  modified_base (296)..(296): a, c, t, g, unknown or other
  misc_feature (296)..(296): n is a, c, g, or t
  modified_base (327)..(327): a, c, t, g, unknown or other
  misc_feature (327)..(327): n is a, c, g, or t
  modified_base (411)..(411): a, c, t, g, unknown or other
  misc_feature (411)..(411): n is a, c, g, or t
tcagagtcgagagacacgaccggtgctcgatttagtgtagtgtgaagggggctgtgggtccaggaggcagaactctgggtgtctcaccatggcctggatccctctacttcctcccctctcactctctgcacaggctctgacggcctcctatcgagctgacacacgtccacctcggtgtctgtcgtcctcgaggacgaggaccggccaggactccgacctgctcgtgggcaagtcgcctagttaccggaaaacctaaaaactaacgttatcggtacctttacgtcggtaacgaacgngacggacgaccgacgccacggtcccctcgtntggtcgtaattaataagtacgttggacggtaccgtcctacggacggtaccccgaggacggtccgtattcctcgtacgcctaccncgtccgtacggacggtaacaacgtacgtccgtacctacgaccgactacggtacggtacggtacggtaccggccgtagggaacggacgggtacgacggttacgtaacgttaacgttacgtacgttcgtacgggtaccgacacggaccgtcggacggtacgtacggtacgttacggtttagtacggttccggttacgtacggggtacggaccgggttcggtaaccggtccggttaccggttaccggttacgtccggttaacgacccggtccccggtaacggttcccgtcccggtaccccgttccggtaccccg

SEQ ID NO: 75519 - DNA, 764 bp, Homo sapiens
  misc_feature: GYAE6OF02HUIJO.49.20.B09.1.454.CMB.1.raw
  modified_base (163)..(163): a, c, t, g, unknown or other
  misc_feature (163)..(163): n is a, c, g, or t
  modified_base (581)..(581): a, c, t, g, unknown or other
  misc_feature (581)..(581): n is a, c, g, or t
  modified_base (599)..(599): a, c, t, g, unknown or other
  misc_feature (599)..(599): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacncgtccacccgtcggtgtcgtgtcgtcctcgacggacacggaccggccaggactccacctgctcgtcggcgtatcgacctacttacgaaaccctaaaaactaattacttcgttaccgtttaacgtacggtaaccgacgacgtacgggacggaccggacggacccgaccggtccccgttcggttcggtttaggtacgtttaaagttttaacgtaaaacggtttacgttttacggacggtacccggtacccgttacgggtaacccgggtaccccgtaggtaccgtaccgtactttccgttacgtcggtccttaccgacgtccgtaacgacggaaccaacgtacgttaaccctacgttaccactacgtcgacgggttacggcggtaccggacgaacgggacggaccggtagctacgtacttntttaacgttcactaaacncaaaccgagtaacctaacgttagttaacgttacttacgtacgttacgtaccgtaagcgaaccgaaccgttacgggccttaccggtccggtacggtaccgacccggtaacccgaacccggtacccctaaccgtacccgttccaccgttacccgttccccttacccg

SEQ ID NO: 75520 - DNA, 978 bp, Homo sapiens
  misc_feature: GYAE6OF02GNTAL.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgacggcctcctatgagctgacacgagtccacccgtcggtgtctcggtcgtcctcgacggacaggaccggccaggactccaccgtgccttctcgggcctagtcgctagttcgaaccaaaacatagtcgtacttacgtacggtaccgacgcgaaggacggtccgacggccgaccggtccccgttggttccgtttggtacgtaattttaaacgtaaacggttccgtttaggaacgggtacccggccccgtacggaaccccggggtaccccgtcggacgtacccggttacgttcccggtccggtcgggtaccccttaccggactacccggttacgggaaaacggggtaaaccctaaaacggtacccgttacccgttaaacccgtttaacccggaaccccgttaacgttacccgggtaacggggtacccggggtaaccggtttacccccgggaaccgggttaacggggaaacccgggtaaccgggggtaaccggttaccggtaacccgggtaaacgtttacgttttaacccggtccggttacccgtaacccggggttacccgaaccggtaacgtaaacccggtaacgggtaccctaaccggggttcggttacccggtttaaggttttaaccggtttaccgggtttaccgggtttacgggttttaaccgggggtccggggttaaccggggttaacccggtttacccgggttcccggttaacccggggtttacccgggtttaccccggttaaccgggttaaccccggtaaccccgggtaccccggggtaacccgggtttcccccggttaccccggttccccccccggttaaggtttaccccccgg

SEQ ID NO: 75521 - DNA, 726 bp, Homo sapiens
  misc_feature: GYAE6OF02GD0RG.49.20.B09.1.454.CMB.1.raw
  modified_base (178)..(178): a, c, t, g, unknown or other
  misc_feature (178)..(178): n is a, c, g, or t
  modified_base (207)..(207): a, c, t, g, unknown or other
  misc_feature (207)..(207): n is a, c, g, or t
tcagagtcgagagacacgaccggtgctcgatttagtgtagtgtgaagggggctgtgggtccaggaggcagaactctgggtgtctcacatggcctggatccctctacttcctccccctcctcactctctgcacaggctctgacggcctcctatgagctagacacagtccaccctcggtntctgtgtcctcaggacagacggccaaggntaccacctgtcctctggcgatgctattcgaaccaaaaacattactgtccttacgtacggtaaccacgcgaacggacggacccgacggacccgaacggtccccccgttggttccgtttgggttacggttaacttttaagttaaaacggttaccgttttagggaaggacgggtcccctaccgggtaaccgggtaacccccgttggaccggtcgtaactttccgtccgtgggtacctcccacgtcgtacgaacgggaactaaacgtacgttacctacccgtttaccgaccactacgaggtcgggtaccggtccggaccgagggaacggacgtacggctaggtaacttattacgtgtaccgcgtcgactacggacacggacgagttggacgttagtttagttacggttcggttaacggtccggggtggtaccggggtaacgttccggtccgtaccggtacccggttcggtaccgtaccggacgtacccggacgtccggtaccccgtccccgtaccggttcccg

SEQ ID NO: 75522 - DNA, 754 bp, Homo sapiens
  misc_feature: GYAE6OF02G015M.49.20.B09.1.454.CMB.1.raw
  modified_base (176)..(176): a, c, t, g, unknown or other
  misc_feature (176)..(176): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcacaggctctgacggcctctatgagctgacactagtccacccgtggtntctgtcgtcctcgaggacagaccggccaggtactcaccgtgcttcgtggactatcgacctagttacgaaccaaaaactatcgtcgtaccttacgtacggtaccaggcgaacggaccggaccgacgggacccgtaaccggtccgttacgttcggttaggttagttaaattttaacgtaaacgttcgtttacggaacggtaccggtccctaccgggtaaccggtaccccgttgggaaccgtcgtttaacttccggtcggtcgtccgtaccgtacgtccgttaacggaccgggtaacaaccgttacgtacctacccgttacggaacctaacgtacggtaggtacggtaccggttacccggacggtaacggacgggtaccggacggtactaacggttaccttaagttaccgttcggtacgtaccgtccggcgtaaacgtcgacggacgttcggtacgttaacggtcgtttagtcggttacggtaccgggttaggaccgggtagtacccgttacggtccgtaccggtaccgtcggtaaccgtcgaccggacgttaccggcccgtaccgttcccggtctacccg

SEQ ID NO: 75523 - DNA, 748 bp, Homo sapiens
  misc_feature: GYAE6OF02JF8DI.49.20.B09.1.454.CMB.1.raw
  modified_base (173)..(173): a, c, t, g, unknown or other
  misc_feature (173)..(173): n is a, c, g, or t
tcagagtcgagagacacgaccggtgctcgatttagtgtagtgtgaagggggctgtgggtccaggaggcagaactctgggtgtctcaccatggcctggatccctctacttctcccctcctcactctctgcacaggctctgaggcctcctatgagctgacacagtcaccctggtntctgtgtcctcgaggacagacggccaggatcacctgctctggacatgcattcgaaccaaaaacgatatcgtacttacgtcggtaccagacgaggacggaccacggcccacgggtcccctggttccgtttaggtagttaattttaaactaaaggttacgtttaggacggaaccggtccctacggaaccggtaccccgtggacgtcgtacgttctcgtcggccttaccagtacctacggaacgggaactaacggtacgtacctacccgttagaacctagtacggtacggtacgggtaccgggtacccggacggaacggtaaacgggaccggtacgggtactaacggtaactttaagttaaccgttgtacccgtacggtacccgtagaaccggtaaccgtaggaacttacggggacgtaacgtttaggttacgttacggttaccggttaagggtcggggaccgggtaccggttaaccggtaccggttcggtaacccgggtaccggttaccgttacgggtaccacccggttacccggtaacggttcccccggtacccgtccccggttaccgttacccgg

SEQ ID NO: 75524 - DNA, 853 bp, Homo sapiens
  misc_feature: GYAE6OF02JJ5Y0.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacagctctgacggcctcctatgacgctagacactacgtccacccgtcggttgtcctgtcgtccctagacggtaccaggaccggccgaaggtatcccactggcttcgtcggcgtatcgacctagttccgaacccaaaaagtagtagtacgtacctttaacgttcggtaaccgtagacgtacggacggtaccgacggtaccgtaccggtccccgttagttccggtttaggtacgttaacgttttaaacgtaaacgggttaccgtttaggaccggtaaccggtcccctacgggtaaccccggtacccgttacggtacggtaccgtaacgtttcgtacccggttaccgcccgtttaccggaccgtccgtaacggtaaccgggtaaaccaaccggtaacgttacccggtaacccttacggtacctaaccggttaacgtaccggttaaccgggacccggttacccggacccggtaacggaaccgggtaaccggtagggtaacccgtacggttaaccgtttaaacggttcctttaccgtaaaccggtcgttcccggaaacggtacgaacccgtagtaccggtacggtaaccgtcgtttaaccggttacgttccggttacgttaaccgggttcgggaaaccgggttcgtaacccgtacggccgtttaccggaccggtttccgaacgttcccgaacgtaccgaacgtccggtaccgtcccgttacgtcccg

SEQ ID NO: 75525 - DNA, 733 bp, Homo sapiens
  misc_feature: GYAE6OF02F5B6B.49.20.B09.1.454.CMB.1.raw
  modified_base (170)..(170): a, c, t, g, unknown or other
  misc_feature (170)..(170): n is a, c, g, or t
  modified_base (178)..(178): a, c, t, g, unknown or other
  misc_feature (178)..(178): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (558)..(558): a, c, t, g, unknown or other
  misc_feature (558)..(558): n is a, c, g, or t
tcagagtcgagagacacgaccggtgctcgatttagtgtagtgtgaagggggctgtgggtccaggaggcagaactctgggtgtctcaccagtggcctggatccctctacttcctccccctcctctactctctgcacgaggctctgacgcctcctatgagctgacacagtcnccctggtntcgtgtcgtccctagacgacgacgacggccagactcacctgccttacgngggacntgactgtacgaaaccaaaaacngttatacgtacttacgtacgtacgcgagagacggccgtacggctaccgccttcgtacgttgtacgttaattaagtaacgttcgttaggacgaacgtcccgtcgacgggtaccctgaccgtgtctcgtttacgcggtcacccgtagccgtacgacggtaactaaccgtgttaccctaccgttacgaacccggttactacgaccgtacgggtaaccggttccgggaaaccggaaacggcgggtaaacgggtacggttcgtaccgaccgttttaagttaccccgtaggtaagtaccgttacccggntaaaacccggtgaacgtaaccggtgtacccgtaagttaaggttaaccgggtcgtttaccggtttaagttcgggggtacccgggagttacccgtaggggtccctacggcccgttacggttaagccggtacgaacccggttccgtcgggtaaccccttacccgggtacgtaccccgg

SEQ ID NO: 75526 - DNA, 725 bp, Homo sapiens
  misc_feature: GYAE6OF02ISYCB.49.20.B09.1.454.CMB.1.raw
  modified_base (136)..(136): a, c, t, g, unknown or other
  misc_feature (136)..(136): n is a, c, g, or t
  modified_base (194)..(194): a, c, t, g, unknown or other
  misc_feature (194)..(194): n is a, c, g, or t
  modified_base (239)..(239): a, c, t, g, unknown or other
  misc_feature (239)..(239): n is a, c, g, or t
  modified_base (665)..(665): a, c, t, g, unknown or other
  misc_feature (665)..(665): n is a, c, g, or t
tcagagtcgagagacacgaccggtgctcgatttagtgtagtgtgaaggggctgtgggtccaggaggcagaactctgggtgtctcaccatggcctggactccctctacttcctccccctcctcactctctcgcacgngctcgtgcggcctctagtgagcctgacacgacgtccacccgtggtgtcgtgtcgtccngaggacgacgaccggccgaggactcctacgtgtctacgtggacgntcgctagttcgaaaccgaaatcgtaaattgtacgtacgttacgtacgtacgagtacgaacgacgccgacgccgtaccgtcccgttgtcgttagtactacgttaagttaaactaaggtttaccgttaagggtaccgggtaccggttaccgtaccgggtaaccggtaaccgtacggtacgtacgtaccgtttcgtccgtaccgtccgtacgccgtacgtaccggaacggtaccaaccgttaacggtaaccgttcgtaccgttaacgaaccgtacgtacggtacgggtccggtacgggtaccggacgtaacgggaccgacggtacgtaccgtaacgttacttaagttccgtacgtactacgtatacgtacgaaggacgtaggtcgtacgcgttacgttcgttacgtcgtagggtaccgacgggtaaccncggtaccgtccgtacgtaccggtcgttacgaccggtaccggtacggccgtcgtaccccgg

SEQ ID NO: 75527 - DNA, 1032 bp, Homo sapiens
  misc_feature: GYAE6OF02JLX1V.49.20.B09.1.454.CMB.1.raw
  modified_base (292)..(292): a, c, t, g, unknown or other
  misc_feature (292)..(292): n is a, c, g, or t
  modified_base (927)..(927): a, c, t, g, unknown or other
  misc_feature (927)..(927): n is a, c, g, or t
tcagagtcgagagacacgaccggtgctcgatttagtgtagtgtgaagggggcgtgtgggtccaggagcagaactctgggtgtctcacatggcctggactcctctacttctccccctctcactctctcgacacgaggctcgtcggacggtcccttaccttagtcgggaacgtccctagaaccctaacgtacggttcctaacccccgttgggtttcgtccttgggttacgttcccttacgaacgggaactaccggaccgggtacctagggaacttcccaccgttggcctttcgngggggtacctaacgttgggaccttaagtttacccggaaaccgtaaaaactagttacgttccggttaacttacgtaccggtaccgacgacgtacggtaccgaccgtaacgccgtaaccgtccctaggttccgtttaggtacgtaacgttttaagtaacgttcggttacggaacggaccggtcccttacgggtacccgggacccttaggaccggtttacgtaccgtttacgttaccgtcggtaccgttaccgtaacggttaccgttacgggaaaaccgggtaaccttaacggtaccggttaaccttacccggtaccgttaaccgtaacgttttccggggaacgggggtttacgtaacccgggttaccccggggtaaacgtaccgggggttaaccgggaacgggtaacccgggttaaacccgtttagggtaaacccgtttttttaacggtacccgggttaaccggtttttcccgtaaaacccggggttcccggggtttaaaaccacgggttttaaaccggaacccgggtttaaccgggttcggggttaaccgggttaaacttacggttttaacggggttaccgtttttaaaacccgggtcggggtttaaccgggtaacccgggtaacggggtttaccncccggggtttaaaccgggtccgtttaaacccggtccggttaaaccggacgttacccggtacccgtaaacggttccccggtacccggttaccgtccgtttacccgg

SEQ ID NO: 75528 - DNA, 781 bp, Homo sapiens
  misc_feature: GYAE6OF02I9Q7A.49.20.B09.1.454.CMB.1.raw
  modified_base (667)..(667): a, c, t, g, unknown or other
  misc_feature (667)..(667): n is a, c, g, or t
tcagagtcgagagacacgaccggtgctcgatttagtgtagtgtgaagggggctgtgggtccaggaggcagaactctgggtgtctcacatggcctggatcctctacttcctcccctcctctactctctgcacgacggctctggacggcctccttaagtgagctcgacgacacgtcctacccgtcggttcgtcttgtcgtcctcgacggacgacggaccggaccaaggtactaccgtaccgacgtcttcggtcggaccgtacgtcggtactaacttacgaaaacccaaaaaacgttaactagttacgtaccgtttaacgtaacggtaccgaacggaccgaacggtacggaaccggaaccgggacccggtacccggtaccccgttacggtttcggtttaacggggttacgtttaaacgtttaaaacgtaaacggtttaacctttaacgggaacgggttaaccggtccccggtaacgggtaaacccgggaccccggtttaaggacggtaccggttaactttacccgtcggtaccggttccctacgtacgaccgtaggaaccggaacaacgtacgtacctaaccgtacaccgtacgtacgaggtacggacggtaccgacgacggagcggtagactacgtactacgttaactagtacgacgtacgacgagacncggacgtaggtacgtacgtagttagtcgtacgttcgacggtacggtacgaacggtcgtacggtacgtacgtacgacgtacgacgacgaacggtccctaccgtcccgtacgtacg

SEQ ID NO: 75529 - DNA, 731 bp, Homo sapiens
  misc_feature: GYAE6OF02FVJHE.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtcctcaggacagacggccaggactcacctgctcgtggcatgctattcgaccaaaaacatatgcttacgtggtaccagcagacggccaggccacggtcccctgtcgttggtgtaactttaagtaaagttacgtttaggacgtacggcccgtacgtaacgggaccccttgacggtcgtacttccgtcgttcggcctccgagtccttaggaaacgggaccaaacgacgttaccaacccgtttacgaccctagttacgacggttacgggaacggttccccgggaaccgaacgggtaaacggggaccggaacgggtaccgtacgtaaccgtttaacgtttaccgtacgtttacccgtaacggttcccggaacgtaacgaaccgtaacgacgtagggttccggacgtaacggtttagtacggtacggtttaacgttccgggggaccggtaacggggtacctaccgggtaccgtaccgggtacccggttccgttaacggggtcctaccggtaccccgtaacgggtccttaccccgggtcccccgttccggttaccccg

SEQ ID NO: 75530 - DNA, 712 bp, Homo sapiens
  misc_feature: GYAE6OF02G20O0.49.20.B09.1.454.CMB.1.raw
  modified_base (234)..(234): a, c, t, g, unknown or other
  misc_feature (234)..(234): n is a, c, g, or t
  modified_base (280)..(280): a, c, t, g, unknown or other
  misc_feature (280)..(280): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacgacagtcaccctcggtgtctgtgtcctcaggacagacggcaggatcacctgctctggcatgcattcgaccaaaanatatgcttactggtaccagtcagaggccagccacgccctgtcttgngattataaagtacttgagcgcctcacgggaccctgagcgtattcgtcgtcggctccagtctacgaacgggtaaccaaacgtacggtacctaaccgtttacggaaccctaagtccgtaacggttagggaacggtttaccccggggaacccgaaagggttaaccgggaaacggtacgggtaccgttacgaaaccgtttaacgtttaacgtacggttaccgacgggttaccgaccgaacggaaccgtacggtaaccgtaggttccgggtacgttaaccggtttaagttacggttacggttaacgttttaccgggggaccgggtaagggaccgttaaccgggtccgtacggttaaccccggtaccggttaacggttaccgaccggttacccggaaacggtcccggtacccggtaccccccggtcggtttaaccccg

SEQ ID NO: 75531 - DNA, 610 bp, Homo sapiens
  misc_feature: GYAE6OF02F2IAQ.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaaacaatatgcttactcggtaaccagcaagacggccacggcccacggcccctgttcttggtgtatttaagtaaagtactttgagacggccctacgacgggacccctggacgacgtattctcgtcggcctccacgctcgaacgggaacaacgacgtacctaccttacgaacctactcgtaggtcgggacgtcccgggaccgaggacggacgacggctacgacttattactgtacacgtccgcacgacgagcgaggtcgacgtagttagtcgttcgttacggttcgggacgggacggtaccgtacggtcgtaccggtacccggtacgtacggtaccgaccggaccgtaaccggtccgtacccggtccccgtacggtacccg

SEQ ID NO: 75532 - DNA, 823 bp, Homo sapiens
  misc_feature: GYAE6OF02HSQNY.49.20.B09.1.454.CMB.1.raw
tcagagtcgagagacacgaccggtgctcgatttagtgtagtgtgaagggggctggtgggtccaggaggcagaactctgggtgtctcaccatggcctggatccctctacttctccccctcctcactctctgcacaggctctgaggcctcctatgagctgacactagtccacccgtggtgtcctgtcgtcctcgaggacaggaccggcgaggactccactggctcgtaggctatcgtacctagttaccgaacctaaaaactagttaattccgtacgtttacgtacgtaaccgacgtacgtaaggaaccggaccggacggaccccgtacggcccccgttgttccggttggtaggttaattttaaacgtaaacggtaacgttttaggacggtaccgggtccccgtacggacccgggtacccgtacggtacggtaccgtacttcgttcggtcggtacctacgtccgtcctacggtaacgggaaactaacggtacgttacctaacccgttcgaacctacggtacgacgggttacggaaccggggttcccggaacggtaacggaacgggtaaccgggtacggccttaacggtccgttaaaccgttacgttacggttaaccggtaccgtcggtaaccacggtaacccaggtacggtacgggtaccgtccgtttaccggttactttaccggttccggttacccgttgggggaacccgggtaccgggtaaaccgtccggtaacggttccccgggttaaccggtacccggttaaggtaccggtaacggtcccgtaacccggtcgtaccccccggttcccggtacgttaccccgg

SEQ ID NO: 75533 - DNA, 711 bp, Homo sapiens
  misc_feature: GYAE6OF02F09JI.49.20.B09.1.454.CMB.1.raw
  modified_base (177)..(177): a, c, t, g, unknown or other
  misc_feature (177)..(177): n is a, c, g, or t
  modified_base (275)..(275): a, c, t, g, unknown or other
  misc_feature (275)..(275): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacagtccaccctcggtntctgtcgtcctcgaggacacggacggccaaggatccacctgctcgtcggctagtgactagttcgaaccaaaaacatatcgtcttacgtcggtaaccanacgaaggacggaccgacggccgaccggcccctgttcgttaggtagtaatttaagtaaagtacgtttagaggtaccggtccctacggaccggtaccccgtaggacgctacttcctacgtcggtccctaccgtagtccgtacggaacgggaacctaaacgtacgttaccctaaccgttaccgaacctagtacgaacggttcgggacccggtacccgggacgtaaacgggacggaacggtacggcgttacggactttacgttacgtgtaccgtacggtaccgacgacgacgacgtacgacgggtcgaacgtttagttagttcggttaccgttacgggtccgggtacgggtacgggtcctacgggtccgtaacgttcccgggttaccgtacgtaccgaccggaccggtaccggacccgttcccgcccggttacgtacccg

SEQ ID NO: 75534 - DNA, 643 bp, Homo sapiens
  misc_feature: GYAE6OF02GNUI7.49.20.B09.1.454.CMB.1.raw
  modified_base (128)..(128): a, c, t, g, unknown or other
  misc_feature (128)..(128): n is a, c, g, or t
  modified_base (176)..(176): a, c, t, g, unknown or other
  misc_feature (176)..(176): n is a, c, g, or t
  modified_base (261)..(261): a, c, t, g, unknown or other
  misc_feature (261)..(261): n is a, c, g, or t
  modified_base (264)..(264): a, c, t, g, unknown or other
  misc_feature (264)..(264): n is a, c, g, or t
  modified_base (272)..(272): a, c, t, g, unknown or other
  misc_feature (272)..(272): n is a, c, g, or t
  modified_base (470)..(470): a, c, t, g, unknown or other
  misc_feature (470)..(470): n is a, c, g, or t
  modified_base (494)..(494): a, c, t, g, unknown or other
  misc_feature (494)..(494): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctncacaggctctgaggtcctcctatgagctgacacagtccacccgtggtntcgtgttacgtcctacgagggaccagaccggaccagggaacttccgacctgcctacgtggccgtatcgcaattcgacctaaaaanatntgcttacncggtaccaagcagcgaccacggcccacgtccctgtacgttggacgtatttaacaagtcttggagtcggtccctacgaaccggaccctgacgtccgttatcctcgttggcctaccgtagtacctacgggaaggtaccaaactcggtactaaccgtgacctagtacccgtaagtcggtacgccggacacggtagaccggnggtacctagtaactacgtttacgnggtccgtaaagtcccgacgaaccgacgttacgaccgtaagggtccgtataccggttattccggagttacgtacgggacgggtagacttacgcgtacggtacccgtacgttcgacgacgtaccggagtcctacccggtccgtagtacccg

SEQ ID NO: 75535 - DNA, 738 bp, Homo sapiens
  misc_feature: GYAE6OF02HMTLJ.49.20.B09.1.454.CMB.1.raw
  modified_base (137)..(137): a, c, t, g, unknown or other
  misc_feature (137)..(137): n is a, c, g, or t
  modified_base (168)..(168): a, c, t, g, unknown or other
  misc_feature (168)..(168): n is a, c, g, or t
  modified_base (175)..(175): a, c, t, g, unknown or other
  misc_feature (175)..(175): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
  modified_base (484)..(484): a, c, t, g, unknown or other
  misc_feature (484)..(484): n is a, c, g, or t
  modified_base (607)..(607): a, c, t, g, unknown or other
  misc_feature (607)..(607): n is a, c, g, or t
tcagagtcgagagacacgaccggtgctcgatttagtgtagtgtgaagggggctgtgggtccaggaggcagaactctgggtgtctacaccatggcctggactccctctaaccttcctcccctcctcactctctgcacnggctctggacgcctctatgagtctagacacncgtaccncccgtggtcgtcgtgtcgtcctacggaggacgacgaccggacgtaggactccgtaacgtnaccgtcgtggactagtcncaagttaccgaaaccaaaataattacgtcgtaccgtttacgacgtaaccaggacgaacggacggacccgacggtacccggtacccggtcccgttcgttaggtttacggttattaaaacgtttaaacggtaaaaccggtcgtttaggaaccggtaccggtaccccgtaaccggggacccgttaacccggtagacgtacggtttaccttaccggtccgtccgtacctaccggnttaccgtaacgggacgaaaccgaccgttacgtacccgttacccgttacgaacttagtaccggtaggtcggtacggaccccggtagaacggggtgaccgtaggccttaataaccgtatccggtnacgtcgaccgacgtaagcgcgtgtacggtcgtactagttgtacgttagaccggttcgggacgacgggtacctcggaacgtccgtaaccgtacgacggactccggaactcgacccgtccacccggtgtaccg

SEQ ID NO: 75536 - DNA, 791 bp, Homo sapiens
  misc_feature: GYAE6OF02FZF2N.49.20.B09.1.454.CMB.1.raw
  modified_base (630)..(630): a, c, t, g, unknown or other
  misc_feature (630)..(630): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtcaccctggtgtctgtgtccctgaggacaggaccggccaaggactcgacctggcctcgtggcctagtcgccagttcgaacccaaaaactacttatcgtacctttacgttcggtaaccgaacggcgaaggacggaccgtaacgggcccgaacgggtcccccgttcggttccgtttgggttacgttaacgttttaaagttaaaacggttacgttttagggaaggaaccgggtcccgtaccggtaaccggggtacccccgttaggacggtacgtaacgttttccgtcgttacgggtacctccgacgtcgtacgaacgggtaaccaaacgtacgtacgtacccgttacgaccgtactacggtaaggtcgggtaccgtaccgggaccgtacgggaacgggaaccggtacgggtaccgtacggtaaccttaacggtttaccgtacgttacgtaccgtccgtacgaacggtaanacggtacggtaacgggtaccggagttacggtttacgtcggttacggttcggttaccggggacgggttacgggtaacctacggtcggtacggtacccggttaccgtaacgggtacgtaaccgtccgtaacggtcccgtacccggtccccgtacggttccccg

SEQ ID NO: 75537 - DNA, 774 bp, Homo sapiens
  misc_feature: GYAE6OF02GQC84.49.20.B09.1.454.CMB.1.raw
  modified_base (692)..(692): a, c, t, g, unknown or other
  misc_feature (692)..(692): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtcgtcctcgaggacaggacggccaggactcaccttgctcgtggcgatgactattcgaacccaaaaataatatacggtacttacgtacggtaaccagacgaaggacggaccgacggacccgaccggtcccccgttggttaccgtttagggtagttaaattttaaacgttaaaacgtacgttttaggaacggtaccggtccccgtaccggaacccgggtaccccgtagggaacgtaccggttaactttccgtcggtaccggtcccttccgacggtccgtacggaaacgggtaaccaacgtacgttacctacccgttacgaacctacgtcgtaggggttaccgggtcggacccgggtacgaagggacgggaacggtacggtaccgttacggtaacctttacggttaacgttcgtaccggtaccggtccgacgtacgacgtacggacgtagggtacggttactaaggtttacgtcgggtttaccggttaagggtcggggaccggtacgggtaaccnccggttacgtaccgggacccgttacggtaacggtccgtaccggacccggacgttacccgtcccggtaccccgttggtacccc

SEQ ID NO: 75538 - DNA, 721 bp, Homo sapiens
  misc_feature: GYAE6OF02F46WJ.49.20.B09.1.454.CMB.1.raw
  modified_base (336)..(336): a, c, t, g, unknown or other
  misc_feature (336)..(336): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacgcctctatgagctgacacagtccaccctcggtgtctgtcgtcctcaggacagacggccaggactccactgctcgtggcgatgctattcgaacctaaaacatactcgtcttacgtacgtaccgagcaaggacgccgacggccacggccctgtcgttggtgtacttataaagtcttgagtgccctgacggtacccngacgcacttctcgtcgctaccagcgtacgacggaactaacgacgtacctaccgttacaaccctactacgtaacgtcggggtaaccgtccccgggaaccgtacggaacgggaaacgggtaccgggtacgtaccggtaactttaacgtttaccgttacggttacggacgttacccgacgtaaaccggacgaacggtaccgtacggttacgggacgtttaacgggttacttacggttaccggttaacggttccgggggaacgggtaacggggtaccgtaaccgggtcccgttaaccggtaaccggttcccggttaacgggtaccgttaaccggaccccggtaaaccgggtcccgttaaccccgggtcccccggttaccggttaccccg

SEQ ID NO: 75539 - DNA, 777 bp, Homo sapiens
  misc_feature: GYAE6OF02H9LMG.49.20.B09.1.454.CMB.1.raw
  modified_base (209)..(209): a, c, t, g, unknown or other
  misc_feature (209)..(209): n is a, c, g, or t
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgaggcctctatgagctgacacagtccacccgtggtgtctgtacgtcctgaggacaggacggccaggacncacctgcctcgtgggcatgactagttagaacccaaaaaatatacgtgtacctttaacgtacggttaacccgaggcgaacggaaccggaccgaacgggacccgtaaccgggtccccccgttaaggttccgttagggtttaagttaaacgttttttaaaagtaaaaacggttaccgtttttaagggaacggaaacccgggttccccgttaaggaaacccgggggtacccccttaagggaccggtaaccggttacttttaccggtaccgtacgggtacctccgaacgttaccgtacggaaacggaacctaacgtacgtacttacccgttacgactacgtacgtacggtacgggtacgtaccggacgtagggaacggacgacgggtactacggtaacttaacttacgttgtacgtacgtccggactaagacgacgtacgagtacgacgtagtttacgttcgtacggttacgttacgggacggagggtaccgtacggtcgttaccggtaccgtaaccgttacggaccgaaccgaccggaaccggtccgtaccgtacccccggttagttacccg

SEQ ID NO: 75540 - DNA, 753 bp, Homo sapiens
  misc_feature: GYAE6OF02HNVPU.49.20.B09.1.454.CMB.1.raw
  modified_base (132)..(132): a, c, t, g, unknown or other
  misc_feature (132)..(132): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcanaggctctgacggcctcctatgagctgacacacgtcacccgtcggtgtctgtcgtcctcgaggacaggacggccaggactccacgtgctcgtggcgagtcgactacgttacgaaccaaaaactagtagtcgtaccttaacgtacggtaaccgagtacgaggaccggccgacggcccgaccggtcccttggttcgttaggttacgtaattttaaacggtaaacgttacgtttacggacggtacgggtacctaccggaaccgggtaccctagggacgtaccgttacttcgtacggtcgtccctacgacgtcctacgaacgccgtaacgaaacgtcgtaccgtacgttaccgacgtagtacgaggtcggacgggttcggacgaggtacggacggacggtactagtacgttacgttacgtagtacgacgtacacgtacgacggtaacgtaacggtacgtacgtaccgttaccgttacggttacggtaccggtttacgggccggggtaacgggtaacgggtaaccctaacgggccgttaaccgggttaccccggttaacggtaccggtaaccgtaacccgggtacccgtaacgggttcccccgtaccccggtacccccggttaaccg

SEQ ID NO: 75541 - DNA, 784 bp, Homo sapiens
  misc_feature: GYAE6OF02FW2KC.49.20.B09.1.454.CMB.1.raw
  modified_base (207)..(207): a, c, t, g, unknown or other
  misc_feature (207)..(207): n is a, c, g, or t
  modified_base (262)..(262): a, c, t, g, unknown or other
  misc_feature (262)..(262): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgacggcctcctatgagctgacacagtccacccgtcggtgtctgtcgtcctcaggacaggacgccaggntcacctgctcgtggcatgcattcgaccaaaacattatcgtctacgtcggtaaccngtcgagacgaccacggccgacggtcccctagttcgttggtagttatttaagtaaacgtactttaggaggtaccggtcccgtacggaccgggtaccccgtggtaacgccgttacttcctccgttcgggtccctccgtacggtaccgtaccggaacgggtaaccgtaactaaccgggttaccctaacccgttaccgaacccgtacgtacggtaaggtaccggggtacgggttaaccccgggaccgaaccggggtaacgggacgggtaccgggtccgtaaccgggtaccctttaaacggtttaccgtacggtttaccgaaaccggttcccggaccgttaaccggacgttaaccggaccgttagggtacgtacgttaacggtttagttacgttacggtttaacgttaccgggtacgggggttaccgaacggttcccggtggtacccggttacccggttaccggttaccggtacgtaccggacccggtaccgggacccttccccggttcccccggtagtttccccgg

SEQ ID NO: 75542 - DNA, 644 bp, Homo sapiens
  misc_feature: GYAE6OF02GBINL.49.20.B09.1.454.CMB.1.raw
  modified_base (247)..(247): a, c, t, g, unknown or other
  misc_feature (247)..(247): n is a, c, g, or t
  modified_base (371)..(371): a, c, t, g, unknown or other
  misc_feature (371)..(371): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccacccgtcggtgtctgtgtcctcaggacagacggccaggactcacctgctcgtggcgatgctattcgaaccaaaaactatangtacttacgtcggtaccagcgaagacggaccgacggccgacggccctggttcgtttaggtacgtatttaagtaaagtgtttggagtacggccctcgacgggaccctaggacgcgtacttctcgngtcctcgagtccgtacgacggacaacgtacgtcctaacgtcgacatcgtacggtcggtacgtccggaccgtaggaggacgacggtcgtacgtaacttacgttacgtacgtacgtacgtaccgtacgacgacgacgacgaggtacgtacgtagttacgtcggtacgttacggtcgggtacgggacgggtacgtacggtccggtaccgtaccggtaccgtacggtacaccgggggggtaccctaacggtccgtcccggtcccggtccgtaccccg

SEQ ID NO: 75543 - DNA, 710 bp, Homo sapiens
  misc_feature: GYAE6OF02FM8M6.49.20.B09.1.454.CMB.1.raw
  modified_base (477)..(477): a, c, t, g, unknown or other
  misc_feature (477)..(477): n is a, c, g, or t
  modified_base (629)..(629): a, c, t, g, unknown or other
  misc_feature (629)..(629): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacacgtcacccgtcggtgtctgtgtcctcaggacacggacggccaggtactccacctgccttgcggcgagtcgactagttacgaacccaaaaacgattagtgtaccttaacgtaggtaccaggcaggtacggccgacggccgacggtcccccttggtctttgggtcgttaattttaagtaaacggtaccgttttaggacggtaccggaccctacggaccggggtacccctaggacggactagtttacctcggtaccggtcctccgtacggcttaacggaacgggtaaccaaacgtacgttactaccgttacgacctanccgtaggtaggtaccgtcccggaccgaacggaggaccgtacgggacttacgaacgtttacttaccgtcgtacgtaccgtcggtacaacgacgtaggacgtaggtgtaaccgtagttagttcggtacggttaagtcggggtcgggaccggtanccgggtccgtacggtacccgttacgttaccggacggtaccggaacctaccgggtccctacccggtccccgttacggtaccc

SEQ ID NO: 75544 - DNA, 693 bp, Homo sapiens
  misc_feature: GYAE6OF02GVZG4.49.20.B09.1.454.CMB.1.raw
  modified_base (174)..(174): a, c, t, g, unknown or other
  misc_feature (174)..(174): n is a, c, g, or t
  modified_base (187)..(187): a, c, t, g, unknown or other
  misc_feature (187)..(187): n is a, c, g, or t
tcagagtcgagagacacgaccggtgctcgatttagtgtagtgtgaagggggctgtgggtccaggagcagaactctgggtgtctcaccatggcctggatccctctacttctccccctctcactctctgcacaggctctggaggcctcctatgagctgacacagtccaccctggtntctgtcgtacctnaggacaggaccggccaaggactcaccttgccttagtcgggcatcgactattacgaaacctaaaaactattatcgtaccttaacgtacggtaccaggtaccaggacggaccgacggccgaccggtccccgtgttccgtttagggttacgttaattttaagtaaacggttcgtttaggaacggtaccggtcccgtacgaaccggggtacccctggtacgacgttacttccttcgtacgacctccgacgtcgtacgacggaactaacgacgtaccctaccgttacgacctatacggacgtacgggaccgttaccggaccgtagggaacggtacggacggtctagtacttagttacgtacgactcgccgtcgaagacgagacgtacgtggtacgtacgttacgtgttacggtacgttcgggacggtacggtaccgtacgtcgttacggcccgttacgtacggaccgtacgacccgtacggtaccgtcccggtacccggtaccgttacccg

SEQ ID NO: 75545 - DNA, 836 bp, Homo sapiens
  misc_feature: GYAE6OF02FSNPP.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctgacggcctcctatgagctgacacagtccaccctcggtgtctgtcgtccctcgacgggacacggacggccaggactcctacctggcctcgtgggacgatggactacttacgaaccaaaaactaattacgtacgttcctttaacgtacgggtaacccaggaccgaagggacggaccgaacgggcccgaaccggttcccccgttggttccgtttaggggttacgttaaaacgtttttaaactaaaaacgggttccttttaaggggaacggtaaaccgggtccccccttaacgggtaaacccggggtacccccgttaagggtaaccggtaccgttaacgttttccgtccgttacgggacccttacccggaacggtcccgttaacgaaacggggtaaccctaaaccgtacggttacccgtaacccgttacgaacccgtaagttaccggtagggttaccgggacgggttaccccggaaccggtaacgggacgggaaccggtacgggtacctacggtaaccgttaattaacgttacgtacgtaccgtaccgacgagacgacgacgtacggtcgtcgtaggtttaacgtgttaccgttacggtacgggtacgggtacggtaccgtacggtacgtaacggtacggtacggttaccgtacggtaccgcggtaacccggacggtcccgtcccggtaccccgtaccgg

SEQ ID NO: 75546 - DNA, 793 bp, Homo sapiens
  misc_feature: GYAE6OF02JFYT6.49.20.B09.1.454.CMB.1.raw
  modified_base (154)..(154): a, c, t, g, unknown or other
  misc_feature (154)..(154): n is a, c, g, or t
  modified_base (225)..(225): a, c, t, g, unknown or other
  misc_feature (225)..(225): n is a, c, g, or t
  modified_base (250)..(250): a, c, t, g, unknown or other
  misc_feature (250)..(250): n is a, c, g, or t
  modified_base (386)..(386): a, c, t, g, unknown or other
  misc_feature (386)..(386): n is a, c, g, or t
tcagagtcgagagacacgaccggtgctcgatttagtgtagtgtgaagggggcgtggtgggtccaggaggcagaactctgggtgtctcaccatggcctggatccctctacttctcccctcctcactctctgcacaggctctgacgcctctatganctgacacagtcaccctggtcgtctgtcgtcctcgaggacacgacggccaggctcacctgactcgtggacgntcgacattcgaccaaaaacgaattnacgttacttacgtacggtaaccagtcaacgagccgaggccaccggccctagtcttaggtactaagttttaacaacgtactttagacggtacggtcccctagtacgggtacccctaggaccgtacgtacgtttaccngttccggtaccttccgagtaccgtacggtaacggaccgtaaactcggtacctaccgtacgacctaatccgaggttcgtaccggtcccggaacgtacgggaaccggaggtaaccggtacgtaacgggtacctttaaaggtttaccttacggttaacccgtacggtacccggtaacgacctaacgtaggacccgttaacgggtaccgggtaacgtttaacgggttacgtttacgggttccggtttaaccgggttaccggggaccgggtttaccgggtacggtaaccggtcccgggtttaacggttacccccgggtaccgtttaaaccgggcccttaacccgggaacccccggtaaccgggttaacccggttcccccggttaaccccccggttcccggtttaaaccccgg

SEQ ID NO: 75547 - DNA, 754 bp, Homo sapiens
  misc_feature: GYAE6OF02HVZJA.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtctgtcgtcctcgaggacaggaccggccgaaggactccacctgccttcgtggcgtatcgacctattacgaacccaaaaactaattagtcgtacctttaacgttacggtaaccacgacgacggacggaccgaacggcccgaccggtcccccgttggttccgtttaggtacgttaagttttaaagtaaacgttacgtttcggaacggaccggtaccctacggaaccgggtaaccccgtaggaacggtaccgttacgtttaccgttaccggtcggtaccctccggtaacgtccgtaaccggaacggaaaccctaaacgtaacgttacccctaaccgtttaccgaacctaccgttacgtaacggtacgggtaccggtacccgggacccgaacgggtaacggaaccggtacggacgttaacgtaccgttaactttacgtcgtaccgtaccggtaccgacgtaacggacgacgtacgaggtcgtacttaggttacttcggttacgtacggtcggacgggtacgtacgtacgcgtaccggtacgtccgtgacgtaccgaccgaccgtccgtcccgcccgtgtccc

SEQ ID NO: 75548 - DNA, 723 bp, Homo sapiens
  misc_feature: GYAE6OF02HC4AH.49.20.B09.1.454.CMB.1.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctgacacagtccaccctcggtgtcttgtcgtcctcgaggacaggaccggccaggactccactgcctcgtggctatcgctatacgaacccaaaaaanattacncgtcctttacgtacggtaacccagaccgaaggaccggcccgacgggaccccgacggccccccgtttggttaccgtttggggtagtttaattttaaaacgtaaaacgttaccgttttaggaaacggtccgggtacccctacggaaccggggtacccccgtggaaccggtcgtacttttccgacgttccgggcctaccgacgtccgtacgggaacggaaccctaacgtcgttacctaaccgttaccggactacgtacgagggttacggccgggtcccgggaagacgggacggtaggacggtcgtagtacttattcgtgtacngttacncgtacgagcggtagttagcgtcctacgttcgttggttacgtacggtagggaccgggacgccgtacggtccaccgggtaccgttaccgcggtaacccgcggaacccgtcggtaccccggtccgttaccccgtggtaaccccg

SEQ ID NO: 75549 - DNA, 796 bp, Homo sapiens
  misc_feature: GYAE6OF02HPKRL.49.20.B09.1.454.CMB.1.raw
  modified_base (691)..(691): a, c, t, g, unknown or other
  misc_feature (691)..(691): n is a, c, g, or t
tcagagtcgagagacacgaccggtgctcgatttagtgtagtgtgaagggggctgtgggtccaggaggcagaactctgggtgtctcaccatggcctggatccctctacttcctccccctctcactctctgctacgaggctcgtggacggtccctactatggagtctagaccactagtccgacccgtgggtcttcgtggtcgtcccgtcgaacggacgacggtaaccggccgaaggaactccgtaccgtcgtaccgttccgtacgggacctagtcggacctaagttacgaaaccctaaaaaataccttacggtcttaccgttaacgtaccggtaacgacgaccggaacggaccggaccgtaaccggtacccgtaccggttaccgttcgttacggttaggttaacgtttaacgtttaaacggtaacggttacgttacggaaccgggtaccgtacccggtaaccggtaacccgtaccgtaaggtaccgtacgttcgttaccgtcgtacgaccgtccgtacgtaccgtaacggaacgtaacctacgtaccgtacccgtacgtaccgtacgtagtaacggtggtaccggtaccgtaaccggtacggacggtaacggacgtacgtactaacgtaacgttacgttacgtagacggtacgacgtaacgacggtacgagacgtacgtgtacgttagttcgngggttacgacgggtacggagtacgtaccgtacgtccggtaccgtaccggtacgtaccgaccgtacccggacggtacccgttccgacccggttccgtaccgtaccg

SEQ ID NO: 75550 - DNA, 788 bp, Homo sapiens
  misc_feature: GYAE6OF02HMPNW.49.20.B09.1.454.CMB.1.raw
tcagagtcgagagacacgaccggtgctcgatttagtgtagtgtgaaggggctgtgggtccaggaggcagaactctgggtgtctcaccatggcctggatccctctacttctccccctcctcactctctgcacaggctctgaggcctcctatgagctgacacagtccaccctcggtgtctgtgtcctcaggacagacggccaggactcacctgcctcgtggcgatagcattgaccaaaaacagtatgcttactggtaccagcagacggccgaggccacggtccccgtagttccttgggtcgtaattttaagaaaacggtaccttttggaaggtacggtccccttacggacggggtaacccccttggacggcgtacttcgtctaggggcctccgacgccgttacgacgggacaaaccgtcgtacccaaccgtttgaacccgttaatccgtaaggttacgggaccgttacccggggaccgaaacggggacgggtaaccgggaacgggtcctaaggtacccgttaagtttaaccgtacgggtttaacctaaaccgtacgtaaaacccgtacggtaaccctaaccgttaacggtttacgggttaaccctttttaaaggttccgggttttacccgtttaaccgggtaaaccgttcggtaaccgtaacccggtaacgggtttacccgtaacccgggttccccgttacggggttacccaaccgggtacccccgtaaacgggtacccctaaaccccctaccggtttaggtacccctacccgttccggtttaaccccgg

SEQ ID NO: 75551 - DNA, 689 bp, Homo sapiens
  misc_feature: GYAE6OF02GGPMX.49.20.B09.1.454.CMB.1.raw
  modified_base (222)..(222): a, c, t, g, unknown or other
  misc_feature (222)..(222): n is a, c, g, or t
tcagagtcgagagacacgaccggtgctcgatttagtgtagtgtgaagggggctgtgggtccaggaggcagaactctgggtgtctcgaccataggcctggatccctctacttctccccctcctcactctctcgcacaggctctgaggcctcctagtgagtctgactacagtcaccctcggtgctgtgtcctcacggactagacggccaggatcacctgctacnggtacatgcatttggacctaaaaaccaattatcgctttactcggttacccagcagaggtccaaggtcccaggacccccttgtccgttaggttggaacttttaagtaaacgtaacgtttttacggaggtaaccgggacccccgttcgaacgggggtacccccttacggaaggtcccggtaattccgttaccgttcgggtaccttcccgtcgacttaccccgtaaggggaaccaaccgagttcccaccttacgggtaacccagttaccgacgttgggacggttaccggccgaaccgtagggacgtacgacggtgtacctagttacctagttccaggtccgtacacgtactacgacgacgtgcgtaagttacgttgtcgttaatcggtcggaggtaccgtacgcggttacgacgtcccgtaggttccgaacggccccgtaggaccccgtttgacccccggtcgttacccg

SEQ ID NO: 75552 - DNA, 744 bp, Homo sapiens
  misc_feature: GYAE6OF02HG9CS.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacgaggctctgaggcctcctatgagctgacacagtccacccgtcggtgtctgtcgtccgtcgaggacaggaccggccgaggactccacctgccgtcgtaggcgtactgtactagttacgaaaccctaaaaagtattagtcgtaccgttacgtacgggtaaccagacgtaacggccggaccgtacggaccccgtacggtcccctgttcgttggtaataagttaactaaagtcgttgaaggaccgtaccgacggaccgggtacccgtaggtacgaccttacgttccgtcggtcggtcccgtaccaacggtccgtacggaacggaactaaacgtacgtacccgtaaccgttacgaaccttagtaccggtaaggtaccggacccgtaacccgggacgtaaacggggaacggaacgggtacgtacttacgtaaaaccgttgttaccggtacgtaccgtccgggtacacggacggtaacaacgggtgtaccggtagtacggttaagttacgttacgtagtacgggtccgtaacgggactacggtaccgtcggtaaaccgtccggtaacgtacggaccgaccgtacgtcccggtccgtaccccggtcccgtacggtaccg

SEQ ID NO: 75553 - DNA, 737 bp, Homo sapiens
  misc_feature: GYAE6OF02HN0RR.49.20.B09.1.454.CMB.1.raw
  modified_base (194)..(194): a, c, t, g, unknown or other
  misc_feature (194)..(194): n is a, c, g, or t
  modified_base (293)..(293): a, c, t, g, unknown or other
  misc_feature (293)..(293): n is a, c, g, or t
  modified_base (426)..(426): a, c, t, g, unknown or other
  misc_feature (426)..(426): n is a, c, g, or t
tcagagtcgagagacacgaccggtgctcgatttagtgtagtgtgaagggggctgtgggtccaggaggcagaactctgggtgtctcaccatggcctggactccctctacttcctcccctcctcactctctgcacaggctcgtgacggtcctcctatggagctgacactacgtccaccctcggtgttctgtgtccncgacggcacggaaccgcgaggactcctacgtcgtctcgtggacgatggactacttacgaaaccaaaactagttacgtcgtaccttacgtacggtaaccnggtacgacgggacggtccgaacgggaccaccggtcccctgttcggttagggtaatttaactttaaagtaacgtgttacggacggaccggtaccctacgggacccggtaccgtagacggtaccttatttcccgngtcggtctaccgacggtcgaccggaaacggtaccctaaacgtcggtaaccctacggtacgtaaccctggtctagggtcggtaccggcgaccggagggaacggacgtagggctaacggtacttaacgtacgttcgacgaccggtccgaacgtaccgtaagcggtaacgtacggtacgcgttaagtttacggtcgttaagttacgggtcgggtacgggacgtaccggttaccgtccggaccggttacggtccggttaaccgtacggtaccgacccggtaccggttccgaccccggtcccggtacgttaacccg

SEQ ID NO: 75554 - DNA, 723 bp, Homo sapiens
  misc_feature: GYAE6OF02GJJF2.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctgaggcctcctatgagctagactacagtcacccgtggtgtctgtcgtcctacaggacaggaccggccgaggactccaccgtgctcgtaggcgatgactacgttacgaaccaaaaacatacgtcgtcttacgtcggtaaccagacagacggccgagtccgacggtcccctgttacgttggtacgtaagttttaacgtaaacgtacgtttacggagtacggtcccttaccgaaccgggtaccccgtcgacgtacggtacttcctcgttcggtcctccgacgtctacggaacggaaccaagtaccgcctaaccgttcgaaccctaactcggtaacggtacggtaccggtaccccgggtacaagggtaaccgggaaacgtcggtacccgttagtaaccttaacggttacgttacggttaacgtccggttaccgaccgtaacggacacggacgttaggtaccggtcgtaaggttttacgtcgttacggtacgttccgggaacggggtagtaccggtacgtcgaccggttcccgaacgttcggtaccaacggacccggttagacccggtccggtaccccgttacggtcccg

SEQ ID NO: 75555 - DNA, 798 bp, Homo sapiens
  misc_feature: GYAE6OF02HZN68.49.20.B09.1.454.CMB.1.raw
  modified_base (139)..(139): a, c, t, g, unknown or other
  misc_feature (139)..(139): n is a, c, g, or t
  modified_base (162)..(162): a, c, t, g, unknown or other
  misc_feature (162)..(162): n is a, c, g, or t
  modified_base (226)..(226): a, c, t, g, unknown or other
  misc_feature (226)..(226): n is a, c, g, or t
tcagagtcgagagacacgaccggtgctcgatttagtgtagtgtgaagggggctgtgggtccaggaggcagaactctgggtgtctcaccatggcctggatccctctacttctccccctctcactctctgcacaggctcgngaggcctcctatgagctgaccanagtccacctcggtgtctgtacgtcctacgaggaccaggacggccaaggctacacctgcttacgnggcatcggactagtcgaaaccaaaacaagttagtacgtaccgttacgtacggtaaccaggtacgaacggacggtaccgacggcccgtaccggtaccccgttggttacgtttacggtaacgtaacgttttaaacgaaacggttacgttacgaaccggtaccggtccccgtaccggaaccgggtaccccgtaggtaacggtccgtaacgttccgttacgtaccgggtcctaccgtaaggtaccgtaaccggaaacggtaaaccaacgttaacgtcccgtaaccgttaccgaaccgtagttacggacggtacggacgttccgggaaccgtaggaccgagtacgccgtaatacttaagtccgtgtaccgaacggtcccgtacggtaacgactacgggtactaaccggggttgtaccgttaacgggtaacgtttcggttacggttaacccgtacggggtacggttaacggacccgttaccggtcggttaccgtaaacccggttttccgaacccgttaacggtacccggaaacccgttaccccgggtaactccccggttaccccggtacgtaccccgg

SEQ ID NO: 75556 - DNA, 979 bp, Homo sapiens
  misc_feature: GYAE6OF02G3OUG.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttctccccctcctcactctctgcacaggctctggaggcctcctatgagctagacacagtccacccgtcggtcgtctgtcgtcctacgaggacacggaccgccgaaggactaccaccgtcgtccgtcgtcggacgtagtcgaccttagttaccgaaacaaaaactaatacgtacgttacgttacgtacgtaccagtacacggtacggaccgacggaccgtaccggtccgtggttcgttggtacgttaatttaacgtaaacgttacgtttacggaacggtaccggtaccccgtacggaacccgggtacccgtaggtaccgtacgttcgttacctccggttccgtaccgtaccgtacggtcccgttacggaaacgggtaacctaaccgtaacgttacccgttaacccggtaccgaacccgtttaaccgttacgggtaacgggtacccgggtaccccggggttaccccgggaaccggtaaaggggtaaaccccggggaacggggttacggttacccgttaaaccggttaacccggttttaacgtttaacccggttaccgggttacccgtaaaaccggggtttccccgaaacgggaaaccgttaacccggggtaccgggtaacggtaccggggtttacggggttaccctttaaacgggtttaccgggtttacggggttaaccgttttaaaccggggggttcccggggtaaccggggttaaccgggtaccggtttaaccccgggccgggttttaccccgggtaaaccccggtttacgggtttaccggaacccccgggttaaccgtaaccccgggggtttaaccgggccccccgggtttaccccggtttacccccccgggtaccggggtttaaaccccg

SEQ ID NO: 75557 - DNA, 776 bp, Homo sapiens
  misc_feature: GYAE6OF02JYY6H.49.20.B09.1.454.CMB.1.raw
  modified_base (133)..(133): a, c, t, g, unknown or other
  misc_feature (133)..(133): n is a, c, g, or t
  modified_base (577)..(577): a, c, t, g, unknown or other
  misc_feature (577)..(577): n is a, c, g, or t
  modified_base (655)..(655): a, c, t, g, unknown or other
  misc_feature (655)..(655): n is a, c, g, or t
tcagagtcgagagacacgaccggtgctcgatttagtgtagtgtgaagggggctgtgggtccaggaggcagaactctgggtgtctcaccatggcctggatccctctacttcctccccctctcactctctgcacnggctctggacgcctacctagtgagtcttgaactacgtagtcccgtacccgttcgggtgttccgtggtcgtccgtacgaacggacacggaccggcgagactccgacgtcgtctcgtggctatgctatacgaaacctaaaacattacgtacgtacttacggtaccggtaaccgacggtacgaacgggacggtaccgacggtaccccgtaccgggttccccgttggttaccggtttagggtaattaacgtttaaacgttaaacggtcggtttggaacggtccgacccggtacgtaccggggaacccttggaccgtacgttaccgttcgtcggttaccgtacccgtacgacgttaccgtaaccgggaagaaccctaaaccggtccgtaaccgttaacccgttcggaaccttacacggggttaggaccgggtaccgggtcggaaccggnggtaacgggtaccggaggttactaaccgttacgtacgttacgacggttcgtaaccggcgtaacgacgagcggtaccgngtacgatacgttgtacgtaccgtgggacgtaagtgtaaccgtgaccggttacccggtagtaccccgtgacccggtaacggtaccacccggttcccgtaccccggtccgttaccggtaaccg

SEQ ID NO: 75558 - DNA, 759 bp, Homo sapiens
  misc_feature: GYAE6OF02IGMT2.49.20.B09.1.454.CMB.1.raw
  modified_base (135)..(135): a, c, t, g, unknown or other
  misc_feature (135)..(135): n is a, c, g, or t
  modified_base (182)..(182): a, c, t, g, unknown or other
  misc_feature (182)..(182): n is a, c, g, or t
  modified_base (186)..(186): a, c, t, g, unknown or other
  misc_feature (186)..(186): n is a, c, g, or t
  modified_base (232)..(232): a, c, t, g, unknown or other
  misc_feature (232)..(232): n is a, c, g, or t
  modified_base (474)..(474): a, c, t, g, unknown or other
  misc_feature (474)..(474): n is a, c, g, or t
tcagagtcgagagacacgaccggtgctcgatttagtgtagtgtgaagggggcgtgtgggtccaggaggcagaactctgggtgtctcaccatggcctggactccctctacttcctccccctcctcactctctgcanaggctctgaggtcctcctatgagctgacaacacgtccaccgtcggtnttcngttcgtctacgaggacagaccggccaaggctccactgctcgtcggntactggactacgtcgaaaccctaaaaagtactagtacgtccttacgtacggtaaccagaccggaacggaccgaccgaacggcccgtacgggtccccgttagtttccgttacgggttaacttaaaggttttaactaaacggttaaccgttttagggaaccggtaccggtaccccgttacggaaccccggggtaccccttagggaccgtacgttacgttccgtacgttacggtcctaacccggngtaccgtaaaggaaccggtaacgaacgttagacctaccgtacgaaccttacgtacgtaggtacggtaccgtacccgggactaacgggaacggtacggccgtaacgttcggtacttacggttactcggtacgtaccgtcaacgtcaacgttgaacgtacggtgtaacgttgttagtcgggttacgtaacgggtcgggaacggtcggtacgtaccgtcggttaaccggtcggtaccgttaaccgcgaacccgtacgaccgtccccggttaccgcccgttacggtccc

SEQ ID NO: 75559 - DNA, 812 bp, Homo sapiens
  misc_feature: GYAE6OF02HKVEN.49.20.B09.1.454.CMB.1.raw
tcagagtcgagagacacgaccggtgctcgatttagtgtagtgtgaagggggctgtgggtccaggaggcagaactctgggtgtctcaccatggcctggactccctctacttcctcccctcctcactctctgcacaggctctgacggcctctatgagctgaacaagtcgtccacccgtcggtgtctgtcgtcctagaggacacggaccggacaggtactccacgtgctcgtacggcgtagtcgactagttacgaaacctaaaaatatagtcgtaccttacgtcggaccagcgaaggacggccagggtccctacgggtccccttggttcttagggtagttaactttaacgtaaaacgttcgtttggaacgtaaccggtccctacgggaacccgggtaccctaggacgtaccgtagtttccgacgtcgggtaacctcgacggtaccttaccggaaagggaaacctaaacgttcccgttaaacccgtacccgtttacggaaacctcgttacggtaacgggttcgggtacccgggttaaccgggcccgaacggggtaacgggaccgggaacggggttaccaagggttaaccttaaggttaaccgttccgtaaacggtcccgttaaccgggacgtaaccggaacgtaacggtacggttaaccggggtcgttaacggttaacgtttcgttaacggttacggttaccgggttaccgggtacgggaacgggtccgttacggtccgtacggtaacccggttcgttaacggtaccgacccggtaccgacggttaccccgtcccgtcccccggttagtaacccgg

SEQ ID NO: 75560 - DNA, 735 bp, Homo sapiens
  misc_feature: GYAE6OF02JZNRX.49.20.B09.1.454.CMB.1.raw
  modified_base (134)..(134): a, c, t, g, unknown or other
  misc_feature (134)..(134): n is a, c, g, or t
  modified_base (184)..(184): a, c, t, g, unknown or other
  misc_feature (184)..(184): n is a, c, g, or t
  modified_base (242)..(242): a, c, t, g, unknown or other
  misc_feature (242)..(242): n is a, c, g, or t
  modified_base (565)..(565): a, c, t, g, unknown or other
  misc_feature (565)..(565): n is a, c, g, or t
  modified_base (646)..(646): a, c, t, g, unknown or other
  misc_feature (646)..(646): n is a, c, g, or t
tcagagtcgagagacacgaccggtgctcgatttagtgtagtgtgaagggggcgtggtgggtccaggaggcagaactctgggtgtctcaccatggcctggatccctctacttctcccctcctcactctctgcacnggctctggacggcctctatggacgtctggaacactagtccacccgtggtntctggtcgtcctcgagggtaccaggaccgggtccaggtactccaccgtggccttcggnggccgaattcgcctattcgaacccaaaaatatacgttggtccttaacgtcggtaaccagtacaggtacggaccgaggccgtaccgggtccccttaggttccgttagggtagtaacttttaagtaaaacggtacgtttggaacggtcgggccccttagggaaccggtacccgtgaagtccgtattcgtacgtcggtacctccgtaagccgtaccggtaacgggaacacgtacgtaccgtaccttacggaacttacgacgtaaggtccgggacgtaccgggcaagggacgacggacggtacttacgactttaacttcgtacgtanaacccggtcgagaacggtcgaacgtcgtaggtacgtaccggtaatttaacgcggtttacggtacggttcgggtaaccgggngtaaccttacggcgttacccggtaccggtcgtacggttccaaccgggtacccgtagggtcccttacccgggtaccccgtcggttaaccg

SEQ ID NO: 75561 - DNA, 783 bp, Homo sapiens
  misc_feature: GYAE6OF02F8AOL.49.20.B09.1.454.CMB.1.raw
  modified_base (175)..(175): a, c, t, g, unknown or other
  misc_feature (175)..(175): n is a, c, g, or t
tcagagtcgagagacacgaccggtgctcgatttagtgtagtgtgaagggggcgtgtgggtccaggaggcagaactctgggtgtctcaccatggcctggatccctctacttctccccctctcactctctgcacaggctctgaggcctcctatgagctgacacagtcacccgtggtntctgtgtccctgaggacaggacggccaggatccacctgctctgggcagtcgctagttcgaacccaaaaacgtattacgtgtacctttaaccgtgggttaacccaggtacgaagggaccggtaccgacgggtacccgacggtcccccgttggttcgtttaggggtacgttaacttttaagtaaaacggttaccgtttttagggaaggtaccgggtacccccgttaacggaacccggggtacccccgttaggaacggtaccgttaacgtttcccgttacgttccggggtaccttaccgacgttaccgttacggaacgggtaacctaaacgttacggtaccctaccgtttaccgaacccgtacgttacgtacggtacgggtaccggtacccggaccgaacgggtacggtacgagggtactacgtacttacgttacgtagtaccgtacgtccgtacaacgaccgtaacgcggtaacggtcgacgttaagtttacgttacggtacggttacgttcggggacggtaccggtaacgtcgtaccggttaccggacccgttacggtacgtaccgtacgcccggtacggtcccgtcccggtcccccggttagtacccg

SEQ ID NO: 75562 - DNA, 826 bp, Homo sapiens
  misc_feature: GYAE6OF02FYG7Z.49.20.B09.1.454.CMB.1.raw
  modified_base (186)..(186): a, c, t, g, unknown or other
  misc_feature (186)..(186): n is a, c, g, or t
  modified_base (205)..(205): a, c, t, g, unknown or other
  misc_feature (205)..(205): n is a, c, g, or t
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (513)..(513): a, c, t, g, unknown or other
  misc_feature (513)..(513): n is a, c, g, or t
tcagagtcgagagacacgaccggtgctcgatttagtgtagtgtgaagggggctgtgggtccaggttttaggcagaacctctgggtgtctcaccagtggcctggactccctctacttctccccctcctcactctctgcacaggctctggaggcctccgtagtgagctgacacagtccacccgtggtntctgtcgtcctagaggacnggacgccaggatccacctgctcgnggactancgctagttcgaaccaaaacatgtagacttacgtcggtaacctagacaggtacggccgagggtcccgaacgggtccccccgttacggtcgtttcgggtagttaatttttaaacgttaaaacgttaccggtttaggaacgggtaaccggtaccccgtacggtaaacccgggtacccccggttaggacggtacgttaccgttcgttccgtacggccctaacgtaccggaccttacggaacggggacctaacgtaacgtaccgttaaccctacggtaaccncgtacgtaacggtacggggtaccgggtacccgggaccggtaacggaaccggggaagggtaccgggtacttacggtaaccgtttaaccgttttacgtacggttacccgacggttacccggtacaaccggaacctaacgggtacctaggggtacggcctaaagggtttaccgtggttaaccggtttcgtaccgggggtaaccgggtacgggtaccgtaccggttaggtacccggtaaaccggttcccgttaacggtacccgtaccggtaccccttacgggaccccggaccccggttacccggtccggttaacccg

SEQ ID NO: 75563 - DNA, 702 bp, Homo sapiens
  misc_feature: GYAE6OF02INSUT.49.20.B09.1.454.CMB.1.raw
  modified_base (182)..(182): a, c, t, g, unknown or other
  misc_feature (182)..(182): n is a, c, g, or t
tcagagtcgagagacacgaccggtgctcgattttagtgtagtgtgaagggggctgtgggtccaggaggcagaactctgggtgtctcaccagtggcctggatccctctacttctccccctctcactctctgacacaggctctgacggcctctagtgagctgacactagttccacccgttggtntcttgtcgtcctgaggacacggacggccaggacttcgaccgtgtcctcgtggacagttagctattacgaaacctaaaatattgtacgctttaacgtacggtaacacgtacgaaggaccggccgacggcccgacccggtcccgttggtttacgttagggtaacttaattttaaacggtaacgttagtttagaaccggtaccggtacccgtacggtaacccgggtaaccctaggtaacgtacgtttaacgttcgtaccgtccgtaccgttaccaaggtccgtacggaacggtaaacacgtacgtacctacgttacgactacgtaggacgtggtaccggcctacgaggtaagacgcgtactagtacttagttcctagtaccgtacgtccgacgtaacgacgacgtacgttggacgtacgttagtcgttaacgtcgtagtcgggagaaccggttcgtcggtctacgtaccggttagttaccgacgtacgtaccgtacggtccctacccgtacccggtcgtaccg

SEQ ID NO: 75564 - DNA, 779 bp, Homo sapiens
  misc_feature: GYAE6OF02H16DT.49.20.B09.1.454.CMB.1.raw
tcagagtcgagagacacgaccggtgctcgatttagtgtagtgtgaagggggctgtgggtccaggaggcagaactctgggtgtctcaccatggcctggatccctctacttcctccccctcctcactctctgcacaggctctggacggcccttcctatgacgctcgaccacacgtcccacccgtggtgttctgtcgtcctacgaggaccacggaccggccaggactaccgaccgtcgtctccggtgggacgtatcggtacctacgtttacgaaacccgaaaaaatagttaacgtccgttacgttaaccgtacggtaaccgaacgcggaacggaccggaccgaacggtaacccggaccggtccccgttacgttcgttcggttagttaaacttttaaacgtaaacgtacgtttggaaccggaccggtccccgttacggaacccgggtaccctaacggacgtaccgtaccgtttccgacggtccggtacctaccgaacggttaccgtaacggaaacggaaacgtaccgtaccgtacccgttaccgtacgaactacgtacggacggtacgggcccggtaccggacgaacgggaacgggcggtaactcgtagtaaccgttactcggtacgtaccgtaccgtccgacgtaacggaacgtcggaccgtaggttacgaccgttacgttacgtcggtacgtaacgggtccgacgggtacgtacgtaccggtcggtaccgtaccggtacgttacggacgtcgaccgacgttcccgtccgtacccgtgtacc

SEQ ID NO: 75565 - DNA, 758 bp, Homo sapiens
  misc_feature: GYAE6OF02JOK4G.49.20.B09.1.454.CMB.1.raw
  modified_base (135)..(135): a, c, t, g, unknown or other
  misc_feature (135)..(135): n is a, c, g, or t
  modified_base (176)..(176): a, c, t, g, unknown or other
  misc_feature (176)..(176): n is a, c, g, or t
tcagagtcgagagacacgaccggtgctcgatttagtgtagtgtgaagggggctgtgggtccaggaggcagaactctggggtgtctcaccatggcctggatccctctacttcctcccctcctcactctcctgcacnggctctgaggcctctatgagctgacacagtccacctcggtntctgtcgtcctcgaggacacggaccggccagggtactacaccgtgcctcgtaggcgatggctattcgaaccaaaacaatatcgtacttacgtacggtaccaggacaggaccggaccacggccgacggtcccctagttcgttgggtagtattttaagtaaacgtacgtttaggaaggcggtccccgtacggaccgggtacccctggacggcgtactttccgtcgtagggcctaccacggttcctacgggaacgggtaaccctaaacgtacccgttaccgtaaacgttccgtacccgtaatccggtaagggtccggggtaaccggttccccgggaacaacggggaacggggttaccggagggtaccgttaacggtacctttaacggttaacctttcgggtacgttacccggacgtaccgaaacgttaccggacgtaccgtaaccgggttggtaactacgggtttaagtttcggtacgtttaccgggtacggggaccggggttacggtaccgtcgggtaacgtcgtttaccggaccgttgtaccggtcgaccggttaccgcccgttcccggtcccgtcgtacccg

SEQ ID NO: 75566 - DNA, 692 bp, Homo sapiens
  misc_feature: GYAE6OF02J04XQ.49.20.B09.1.454.CMB.1.raw
tcagagtcgagagacacgaccggtgctcgatttagtgtagtgtgaagggggctgtgggtccaggaggcagaactctgggtgtctcaccatggcctggactccctctacttcctccccctctcaccttctctgcagaggctctagacggccttactatcggagtcctgaaccacgagtacccgacccgttcggtgtccgtggttcgtcctacgagggaccacggaccggccgtaagggtaccttccgaccgttggccttacggtgggaccgtattcggtactagtttaccgaaacccaaaattatagttcgtacttaacgtacggtaccagacgtacggacggccgtacggacccgtacgtcccgtgttacgttaggtatacttaagtaacgtagttcgagtacggtcccctacgaccggtaccctaggtacgccgttacttccgtacgtccgtactacgacgtcgtacggtaacggactaacgtcgtttacgaccgttcacctagtcgtacggttacgacggtaccgacgtaggacggtaggtacagtccgtaactagttccgtcgccgtaggacctagacgtgacgtagcgtcggctttggagttcgtacgtacgtcggacgttacggctacggtccgtaagtccgtacgttacggcgacgtacccggagtcccttccggaccttccgtcg

SEQ ID NO: 75567 - DNA, 690 bp, Homo sapiens
  misc_feature: GYAE6OF02IS2SR.49.20.B09.1.454.CMB.1.raw
  modified_base (156)..(156): a, c, t, g, unknown or other
  misc_feature (156)..(156): n is a, c, g, or t
  modified_base (212)..(212): a, c, t, g, unknown or other
  misc_feature (212)..(212): n is a, c, g, or t
  modified_base (242)..(242): a, c, t, g, unknown or other
  misc_feature (242)..(242): n is a, c, g, or t
tcagagtcgagagacacgaccggtgctcgatttagtgtagtgtgaagggggctggtgggtccaggaggcagaactctgggtgtctcaccatggcctggatccctctacttctccccctcctcactctctgcacaggctctgacggcctcctatganctgactacagtcaccgtcgtgtctgtgctcgagacagacgcaggatcactgctcgnggctatcgactattcgaaccaaaatatagngtactttacgtcggtactacgatagacggccaacgccacggtccctaggttcgttaggtagtaagtttaactaaagtaccgttttgaaggtaccgtcccgtacgtaccgggtacccgtcggaacgtcgtaacgttctacgttcgggtacctaccgtacggtaccgtacgaaccgggtaaacaaacgtagttaacccaacccggtttacgaaccaacgttacgtaacgggtacgggaaccggtacccgggtaaccggtaaggtaacggtaaccggtaacggggtacctaacggttaacccttaagtttaccggtacttaccggtaacgtacccggaaccgtaagtacgaacgtcggacgtgacgtagttaacgtcttaggttactacggcgggtagacgtccgaatccgactcgtcgacgacgtccgtaacgtcctccgccctacgtcc

SEQ ID NO: 75568 - DNA, 331 bp, Homo sapiens
  misc_feature: GYAE6OF01D0KSA.17.57.F02.1.454.CMB.1.raw
  modified_base (327)..(331): a, c, t, g, unknown or other
  misc_feature (327)..(331): n is a, c, g, or t
tcagcgtagactagcacgaccggtgctcgatttagctcgatatagttgggtttaggggctttccctgatctatactgcatccaatttgcaaagtggggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaacgaactgtggctgcaccatctgtcttcatcttcccgccatctgactagtctacgctgagcgggctggcaaggcgcatagnnnnn

SEQ ID NO: 75569 - DNA, 336 bp, Homo sapiens
  misc_feature: GYAE6OF01BHVR4.17.57.F02.1.454.CMB.1.raw
  modified_base (326)..(336): a, c, t, g, unknown or other
  misc_feature (326)..(336): n is a, c, g, or t
tcagcgtagactagcacgaccggtgctcgatttagctcgatatagttgggtttaggggctttccctgatctatactgcatccaatttgcaaagtggggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaacgaactgtggctgcaccatctgtcttcatcttcccgcatctgactagtctacgctgagcgggctggcaaggcgcatagnnnnnnnnnnn

SEQ ID NO: 75570 - DNA, 355 bp, Homo sapiens
  misc_feature: GYAE6OF01DRHQT.17.57.F02.1.454.CMB.1.raw
  modified_base (336)..(336): a, c, t, g, unknown or other
  misc_feature (336)..(336): n is a, c, g, or t
  modified_base (344)..(355): a, c, t, g, unknown or other
  misc_feature (344)..(355): n is a, c, g, or t
tcagcgtagactagcacgaccggtgctcgatttagctcgatatagttgggtttaggggctttccctgatctatactgcatccaatttgcaaagtgggtcccatcaaggttcagtggcagtggatctgggacagatttcactctcaccatcagcagtctgcaactgaggtattttgactaacttactactgtacaacgtagggttacacgtacccgtactacgtttggaccgagggaccaagcgtggagatacaaacgactgtgctgcacatctgtcttcactccttcccgctatctcgtactagtacacgctggacggcggctggacgaagggccncgtatagnnnnnnnnnnnn

SEQ ID NO: 75571 - DNA, 372 bp, Homo sapiens
  misc_feature: GYAE6OF01CE0RP.17.57.F02.1.454.CMB.1.raw
  modified_base (352)..(372): a, c, t, g, unknown or other
  misc_feature (352)..(372): n is a, c, g, or t
tcagcgtagactagcacgaccggtgctcgatttagctcgatatagttgggtttaggggctttccctgatctatactgcatccaatttgcaaagtggggtcccatcaaggttcagtggcagtggatctgggacagatttcactctcaccatcagcagtctgcaacctgaggattttgcaacttactactgtcaacagggttacacgtacccgtactacgttttcggccgagggaccaagtctaggagagtacaaacgtaactggtagctcgcaccatctgtcttcacgttccttcccgctactcctgactagtcgtacgtctgacgcgggcttgggcaacggccgacaagtgnnnnnnnnnnnnnnnnnnnnn

SEQ ID NO: 75572 - DNA, 410 bp, Homo sapiens
  misc_feature: GYAE6OF01C2D11.17.57.F02.1.454.CMB.1.raw
  modified_base (171)..(171): a, c, t, g, unknown or other
  misc_feature (171)..(171): n is a, c, g, or t
  modified_base (271)..(271): a, c, t, g, unknown or other
  misc_feature (271)..(271): n is a, c, g, or t
  modified_base (365)..(365): a, c, t, g, unknown or other
  misc_feature (365)..(365): n is a, c, g, or t
  modified_base (370)..(410): a, c, t, g, unknown or other
  misc_feature (370)..(410): n is a, c, g, or t
tcagcgtagactagcacgaccggtgctcgatttagctcgatatagttgggtttaggggctttccctgatctatactgcatccaatttgcaaagtggggtcccatcaaggttcagtggcagtggatctgggacagtatttcactctcaccatcagcagtctgcaactgagtntttgctactactactgcaacgtaggtacacgtacccgtactacgtttcggacgacgggaccaagcgtaggagactacaacgacgtggtgctacgccaacntctgtcttctacttccgttacccgactacttcctagtactacgtccttacgctggaccggtacgggtccgtacgggacgacggtaccgctaagngtacnnnnnnnnnnnnnnnnnnnnnnnnnnnnnnnnnnnnnnnnn

SEQ ID NO: 75573 - DNA, 130 bp, Homo sapiens
  misc_feature: GYAE6OF02G7DEZ.17.57.F02.1.454.CMB.1.raw
  modified_base (130)..(130): a, c, t, g, unknown or other
  misc_feature (130)..(130): n is a, c, g, or t
tcagcgtagactagcacgaccggtgctcgatttagctcgatatagttgggtttgggcacagcggccctgggctgcctggtcaaggactacttccctagtctacgctgagcgggctggcaaggcgcatagn

SEQ ID NO: 75574 - DNA, 130 bp, Homo sapiens; identical to SEQ ID NO: 75573
  misc_feature: GYAE6OF02ITB2J.17.57.F02.1.454.CMB.1.raw
  modified_base (130)..(130): a, c, t, g, unknown or other
  misc_feature (130)..(130): n is a, c, g, or t

SEQ ID NO: 75575 - DNA, 390 bp, Homo sapiens
  misc_feature: GYAE6OF02JEZSU.17.57.F02.1.454.CMB.1.raw
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (365)..(390): a, c, t, g, unknown or other
  misc_feature (365)..(390): n is a, c, g, or t
tcagcgtagactagcacgaccggtgctcgatttagctcgatatagttgggtttaggggtcgtttccctgtatctatactgcatccaatttgcaaagtgggtcccatcaaggttcagtggcagtggatctgggacagatttcactctcaccatcagcagtctgcaacctgaggattttgcaacttactactgtcaacagggttacagtaccccgtacacttttggccaggggtaccaagcctgggacgatcgaaaccgaactgtgctgcaccatctagtccttacatcttcccgcctatctgaccttagtctacgccttgagtccgggactcggactaacgggccnctaaatcggntnacgcancnnnnnnnnnnnnnnnnnnnnnnnnnn

SEQ ID NO: 75576 - DNA, 351 bp, Homo sapiens
  misc_feature: GYAE6OF02JIJLU.17.57.F02.1.454.CMB.1.raw
  modified_base (326)..(327): a, c, t, g, unknown or other
  misc_feature (326)..(327): n is a, c, g, or t
  modified_base (329)..(329): a, c, t, g, unknown or other
  misc_feature (329)..(329): n is a, c, g, or t
  modified_base (331)..(351): a, c, t, g, unknown or other
  misc_feature (331)..(351): n is a, c, g, or t
tcagcgtagactagcacgaccggtgctcgatttagctcgatatagttgggtttaggggctttccctgatctatactgcatccaatttgcaaagtggggtcccatcaaggttcagtggcagtggatctgggacagatttcactctcaccatcagcagtctgcaacctgaggattttgcaacttactactgtcaacagggttacagtaccccgtacacttttggccgagggaccaagctggagatcaaacgaactgtggctgcaccatctgtcttcatcttcccgcatctgactagtcacgtctgaggcggctggcaaggcgcatagnngncnnnnnnnnnnnnnnnnnnnnn

SEQ ID NO: 75577 - DNA, 439 bp, Homo sapiens
  misc_feature: GYAE6OF02JWJHC.17.57.F02.1.454.CMB.1.raw
  modified_base (210)..(210): a, c, t, g, unknown or other
  misc_feature (210)..(210): n is a, c, g, or t
  modified_base (378)..(382): a, c, t, g, unknown or other
  misc_feature (378)..(382): n is a, c, g, or t
  modified_base (384)..(439): a, c, t, g, unknown or other
  misc_feature (384)..(439): n is a, c, g, or t
tcagcgtagactagcacgaccggtgctcgatttagctcgatatagtttggggtttaggggctttccctgatctatactgcatccaattgcaaagtgggtcccatcaaggttcagtgcagtggatctgggacagatttcactctcaccatcagcagtctgcaacctgaggattttgcaacttatactgtcaacaggttacagtacccgtanacttttggcctagggaccaacgctggagaactacaaaacgaactaggtcgtactaggtcaacccaagttccgtgttcttctaagttccttaccccgctaactcgtacggattaacgtctacccgtacgtcgaacggtcgggtctaggccaaagggcaccgtatacggnnnnntnnnnnnnnnnnnnnnnnnnnnnnnnnnnnnnnnnnnnnnnnnnnnnnnnnnnnnnn

SEQ ID NO: 75578 - DNA, 534 bp, Homo sapiens
  misc_feature: GYAE6OF01APLMF.17.39.D06.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
  modified_base (367)..(367): a, c, t, g, unknown or other
  misc_feature (367)..(367): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccacctctcctgcagggccagtcagagtgttggcagcaacttagcctggtatcagcagaacctggccaggcctcccaggctcctcatgtatggtncatctaccagggccagtggtctcccagccaggttcaggtggcaggtgggtctgggacaggtagttcncttctcatcatcagcagctgctagtctagaagtattttggcgttttattactgtcagtcagttataatcagtcgccttcggtcggtacgttccgggaccgtaacggggtaccgaagggtacggaaacgtaccgaaaacggtacgtgggtacggtcgtgccgtaaccg

SEQ ID NO: 75579 - DNA, 487 bp, Homo sapiens
  misc_feature: GYAE6OF01BDFIT.17.39.D06.1.454.CMB.1.raw
  modified_base (205)..(205): a, c, t, g, unknown or other
  misc_feature (205)..(205): n is a, c, g, or t
  modified_base (405)..(405): a, c, t, g, unknown or other
  misc_feature (405)..(405): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccagggggaaangccaccctctcctgcagggccagtcagagtgttggcagcaacttagcctggtatcagcagaacctggccaggctcccaggctcctcatgtatggtgcatcctaccgagggcccacgtggtcgtcccagccaggttcagtggcaggtgggtctggggacaggtagttctctctcatcatcagcagcctgcagtctgaagtnttttgcgttttatactgtcagctagtatatcagtgcctcgtgcgtcggcgagggacaggtgaatcaacgtacngtgcngcac

SEQ ID NO: 75580 - DNA, 516 bp, Homo sapiens
  misc_feature: GYAE6OF01EXHMX.17.39.D06.1.454.CMB.1.raw
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
  modified_base (410)..(410): a, c, t, g, unknown or other
  misc_feature (410)..(410): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaagngccaccctctcctgcagggccagtcagagtgttggcagcaacttagcctggtatcagcaagaacctggccaggctcccaggctcctcatgtatggtncatctaccgagggccacgtggtctcccagccaggttcaggtggcaggtgggtctggggacaggtagtttctcgtctcatcatcagcagcctgccagtctagaagtnttttggcgttttatctgtcagctagtatatcagtcgcctcgtggtaccgttcggaccgaagggacaagggtagaaactacgaaaacgtacgtgtaggctgctaacg

SEQ ID NO: 75581 - DNA, 522 bp, Homo sapiens
  misc_feature: GYAE6OF01BGD8J.17.39.D06.1.454.CMB.1.raw
  modified_base (204)..(204): a, c, t, g, unknown or other
  misc_feature (204)..(204): n is a, c, g, or t
  modified_base (405)..(405): a, c, t, g, unknown or other
  misc_feature (405)..(405): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaacctggccaggctcccaggctcctcatgtatggtgcatctaccagggccacgtggtctcccagccaggttcaggtggcaggtgggtctggggacaggtagttctctctcatcatcagcagcctgcagtctagtaagttnttttggcgttttatacgtgtcagtctagttatatcagtcgccgtcggtggtaccgttcggaccgaagggaccgtaagggtcgaaactacgaaacgtacgtggtaggctggcctaccg

SEQ ID NO: 75582 - DNA, 522 bp, Homo sapiens
  misc_feature: GYAE6OF01EIT3D.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaaacctggccaggctcccaggctcctcatgtatggtgcatctaccagggcccacgtggtcgtcccagccaggttcagtggcaggtggtctgggacaggagttctctctcatcatcagcagcctgcagtctagaagtattttgcggttttatactgtcagctagtataatcagtcggcctcggtggtaccgttcggaccgtaacgggtaccgaagggtcggaaactacgaaaacggtacgtaggaggactgctaaccg

SEQ ID NO: 75583 - DNA, 515 bp, Homo sapiens
  misc_feature: GYAE6OF01EZ880.17.39.D06.1.454.CMB.1.raw
  modified_base (203)..(203): a, c, t, g, unknown or other
  misc_feature (203)..(203): n is a, c, g, or t
  modified_base (406)..(406): a, c, t, g, unknown or other
  misc_feature (406)..(406): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaangccaccctctcctgcagggccagtcagagtgttggcagcaacttagcctggtatcagcagaacctggccaggctcccaggcctcctcatgtatggtgcatctaccagggccacgtggtctcccagtccaggttcaggtggcaggtgggtctggggacaggtagtttctctctcatcatcagcagcctgcagtctagtaagttnttttggtcgttttatacgtgtcagctagtatatcagtcggcctcggtcggtacgtcggaccgtaagggacgtaagggtgaaacgtcgaaacgtactggtagctgctacg

SEQ ID NO: 75584 - DNA, 532 bp, Homo sapiens
  misc_feature: GYAE6OF01C1HZH.17.39.D06.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagngccaccctctcctgcagggccaatcagagtgttggcagcaattagcctggtatcagcagaacctggccaggctcccaggcctcctnatgtatggtgcatctaccgagggcccagtggtctcccaagccaggttcaggtggcaggtgggtctgggacaggtacgttcncgttctcatcatcagcagcctgcagtctagaagtnttttgacgttttattacgtgtcagtctaagtataatcgagtcgtcctcggtagaccgttcggaccgtaaagggacctaagggttacgaaacgtcaaaaccggtgtagtagggcttggaccgtacg

SEQ ID NO: 75585 - DNA, 620 bp, Homo sapiens
  misc_feature: GYAE6OF01AVWQS.17.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttggcagcaacttagcctggtatcagcagaaacctggccaggcctccaggcctcctcatcgtatggtgctatctaccgagggcccacttgggtctcccagccgaggtttccaggttggccgtaggttcgggtctggggacctaggtacgtttcctacttccgtctattcattccgaagccaacggcctgcctagttccgtagtaaagttagtttttcggtacggttttattaccgtgttcagtctaaggttattaagttcgtaaggtcgtacccgttccggtaggtaccggtttaccgggaccgaaacggggtacccgtaaaggggtacggaaaacgttaacccgaaaacggtacgttaggtacggtacgtcgtccgtaaacccg

SEQ ID NO: 75586 - DNA, 545 bp, Homo sapiens
  misc_feature: GYAE6OF01CUI2D.17.39.D06.1.454.CMB.1.raw
  modified_base (205)..(205): a, c, t, g, unknown or other
  misc_feature (205)..(205): n is a, c, g, or t
  modified_base (355)..(355): a, c, t, g, unknown or other
  misc_feature (355)..(355): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttggcagcaattagcctggtatcagcagaacctggccaggctcccaggcctcctcatgtatggtgcatctaccgagggccacgtggtctcccagccaggttcaggtggcaggtgggtcngggacaggngttcnctctcatcatcagccagcctgctagtcgtaggtaagttgttttcggtacggttttattacgttgttcagtactaagttattaatcgagtcggtcccttcgggtggtaccgttcggaccgaacgggtaccaaggggtacgaaacgtacgaaacgtacgtaggtaggactgctaaccg

SEQ ID NO: 75587 - DNA, 561 bp, Homo sapiens
  misc_feature: GYAE6OF01CXEL0.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctaggtatcagcaagaaacctggaccaggcctccgaggcctcctcatgtatggtgcatctaccgagggccacgtggtcgtcccagccgtaggttcagtcggctaggtgggtctggggacaggtagttctcgtctacatcatcagcacgctgctagtctagtaagtgttttgtcggttttaatacgttgtacagtactaagttataattcgtaaggtcggacccgttcggtacggtaccggttcggacccgtaaaggggaccctaaggggtacgaaacgtacgaaacgtaacgtggtcggctgcctaacc

SEQ ID NO: 75588 - DNA, 519 bp, Homo sapiens
  misc_feature: GYAE6OF01DQATP.17.39.D06.1.454.CMB.1.raw
  modified_base (406)..(406): a, c, t, g, unknown or other
  misc_feature (406)..(406): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggcctcccaggcctcctcatgtatggtgcatcctaccagggcccagtggtctcccagccaggttcaggtggcaggtgggtctgggacaggtagttctctctcatcatcagcagcctgcagtctagaagtnttttggcgttttatacgtgtacagctagtataatcaggtcgccttcggtggtaccgttccggaccgaaagggaccgaaggtaggaaatccgaaaagtactggtggctgctacc

SEQ ID NO: 75589 - DNA, 574 bp, Homo sapiens
  misc_feature: GYAE6OF01BSP87.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaacctggccaggctccgaggcctcctcatgtatggtgctatctaccgagggccacgtggtcgtcccagtcccgtaggttcaggtcggcgtaggtcgggtctggggactaggtacgttctctctcatcatcgagcagcctgcagtctagtaagttgttttgacggttttatacgtgtacagtactagttataacgttcgaggtcggtacccgttcggtagggtaccgttacgggacccgtaaaggggtacccgaagggttacggtaaactaaccgaaaacggtacgtcggtaggcctaggccgtaaaccg

SEQ ID NO: 75590 - DNA, 548 bp, Homo sapiens
  misc_feature: GYAE6OF01A5RL5.17.39.D06.1.454.CMB.1.raw
  modified_base (205)..(205): a, c, t, g, unknown or other
  misc_feature (205)..(205): n is a, c, g, or t
  modified_base (417)..(417): a, c, t, g, unknown or other
  misc_feature (417)..(417): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangcccaccctctcctgcagggccagtcagagtgttggcagcaacttagcctggtatcagcaagaaacctggaccaggcctccccgaggcctcctcagtgtatggtgctatcctaccgagggccacgtggtcgtcccagccgtaggttcaggtggcgtagggtggtctggggactaggtacgttctctcgtcactcatcgagcagcctgcagtntagtaagttgtttcggtacgttttatacgttgtacagtactagtaattactcgtagtcggtccgtcggtggtaccgttccggacgaacgggtacgaagggtgaaactacgaaacgtacgtgagtctgctac

SEQ ID NO: 75591 - DNA, 533 bp, Homo sapiens
  misc_feature: GYAE6OF01A7KS0.17.39.D06.1.454.CMB.1.raw
  modified_base (204)..(204): a, c, t, g, unknown or other
  misc_feature (204)..(204): n is a, c, g, or t
  modified_base (406)..(406): a, c, t, g, unknown or other
  misc_feature (406)..(406): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttgcctggtatcagcagaacctggccaggcctcccaggcctcctcatgtatggtgcatctaccgagggccacgtggtcgtccccagccaagggttcagtggcaggttgggtctgggacaggtagttctctctcatcatcagcagctgcagtctgaagtntttgcgttttatcgtgtcagtctagtataatcgaggtcgccttcggtggtaccggttcggaccgtaaacgggtaccgtaagggtacggaaacttacgaaaacggtactaggtaggctggcctaaccg

SEQ ID NO: 75592 - DNA, 582 bp, Homo sapiens
  misc_feature: GYAE6OF01EPXN5.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttggcagcaacttagcctggtatcagcaagaaacctggccaggcctccccgaggcctcctcatgtatggtgctatcctaccgagggcccagtggtcgtcccagccaggttcaggtcggcgtaggtgggtctaggggactaggtacgtttctcgtctctactcactcgacgcacgtcctgacctagtcgtaagtaagtttagttttcggtacgttttactacgttgtactagtacgtagttaataacgtcgtacggtcgtccgttcggtacggtaccgttccggacgaacgggtacgaagggttacgaaacgtaccgaaaacgtcgtaggtaggtcgtcgaccgtac

SEQ ID NO: 75593 - DNA, 530 bp, Homo sapiens
  misc_feature: GYAE6OF01ETSUU.17.39.D06.1.454.CMB.1.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (408)..(408): a, c, t, g, unknown or other
  misc_feature (408)..(408): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtgtctccaggggaaangccaccctctcctgcagggccagtcagagtgtggcagcaacttagcctggtatcagcagaaacctggccaggctcccaggctctcatgtatggtncatctaccgagggccacgtggtcgtcccagcctaggttcaggtggctaggtgggtctggggactaggtagttctctctcatccatcagcagctgctagtctagaagtnttttggacggttttattacgtgtcagtactagttataatcgtagtcggtacctcggtgtacgttccggaccgaacgggtaccgaagggtagaaactacgaaacgtactcgtaggctgctacg

SEQ ID NO: 75594 - DNA, 525 bp, Homo sapiens
  misc_feature: GYAE6OF01E4MA1.17.39.D06.1.454.CMB.1.raw
  modified_base (379)..(379): a, c, t, g, unknown or other
  misc_feature (379)..(379): n is a, c, g, or t
  modified_base (413)..(413): a, c, t, g, unknown or other
  misc_feature (413)..(413): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccagggggaaagagccaccctctcctgcagggccagtcagagtgttggcagcaacttagcctggtatcagcagaaacctggccaggctcccaggctcctcatgtatggtgcatcctaccagggcccacgtggtgtccccagcccagggttcaggtggcaggtcggggtctggggacaggagtttcnctctcatcatcagcagtcctgcagtctagaagtnttttgcggttttattacgtgtcagctagtaataatcagtcggccctcggtcggacgttcggaccgtaagggaccaaagggtgaaactacgaaacgaacgtgaggctgcctac

SEQ ID NO: 75595 - DNA, 521 bp, Homo sapiens
  misc_feature: GYAE6OF01B0XRF.17.39.D06.1.454.CMB.1.raw
  modified_base (204)..(204): a, c, t, g, unknown or other
  misc_feature (204)..(204): n is a, c, g, or t
  modified_base (411)..(411): a, c, t, g, unknown or other
  misc_feature (411)..(411): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgtggcagcaattagcctggtatcagcagaacctggccaggctcccaggcctcctcatgtatggtgcatcctacgagggccacgtggtctcccgagccaggtttcaggtggcgtaggttcggggtctggggactaggtagttctctctcatcatcagcacgctgctgtctagaagttntttgtacgttttatacgtgtcagtctagtatatcgagtcgtcctcggtggtaccgttcggacgaagggtacaagggtgaaactacgaaacgtactggtacgctgcctacg

SEQ ID NO: 75596 - DNA, 537 bp, Homo sapiens
  misc_feature: GYAE6OF01BIBZZ.17.39.D06.1.454.CMB.1.raw
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggcctcctcatgtatggtncatctaccgagggcccatggtctcccagccaggttcaggtgcaggtgggtctgggacagngttctctctcatcatcagcagcctgctagtctagaagtgttttggcggttttatacttggtcagtctagtattaagtcaggtcggtcccttcggtgggtaccgttccgggaaccgaacggggtacccgaagggtacgaaactacgaaaacgtacgtggtaggcctgccgtaacc

SEQ ID NO: 75597 - DNA, 735 bp, Homo sapiens
  misc_feature: GYAE6OF01DXE8X.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgcccaccctctcctgcagggccagtcagagtgtgcagcaacttagctggtatcagcaagaacctggaccaggcctcccaggtcctcctagtagtttcggtaagttcgggtcactaacgttacccgtaacccggacggggtacccctaacggttcgggtccgtacccccgtaggtacccgttaaggggtttcccaaggggttcgggacccgttaaggggtcggggttacctagggggaacctagggtacttttccaccttctacgtactcgaacttcgaacggtcctacgccgttacgtccgtaacggttccgtaggttaacgtttagtttttacgggtacgtttttaacttacgttcgtaaccgtaagtaccgttaagttattaaccgttcggtaacggttccgggtacccgttccgggtagggttacccggttaccgggaaccggtaaacggggtaacccgtaaagggggttaccgaaaacgtaccggtaaaacggtcggttacggacggtactccggtcctaaccgg

SEQ ID NO: 75598 - DNA, 535 bp, Homo sapiens
  misc_feature: GYAE6OF01AL6KG.17.39.D06.1.454.CMB.1.raw
  modified_base (205)..(205): a, c, t, g, unknown or other
  misc_feature (205)..(205): n is a, c, g, or t
  modified_base (303)..(303): a, c, t, g, unknown or other
  misc_feature (303)..(303): n is a, c, g, or t
  modified_base (387)..(387): a, c, t, g, unknown or other
  misc_feature (387)..(387): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctctcctgcagggccagtcagagtgtggcagcaactagcctggtatcagcagaacctggccaggcctcccgaggcctcctcatgtatggtncatctaccgagggccacgtgggtactcccgagccgtaggttcaggtggctaggtcgggtcgtagggactaggtcgttctctctnatcatcagcagtcctgcagtctagaagttgttttgacgttttattcgtgtacgagtctagttactactgacgtcgcctcggtgtaccggtcggaccgtaagggtaccgtaagggtacgaaatccgaaacgtagtgagctcgactaccg

SEQ ID NO: 75599 - DNA, 504 bp, Homo sapiens
  misc_feature: GYAE6OF01BZ50V.17.39.D06.1.454.CMB.1.raw
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggcctcccaggctcctcatgtatggtgcatctaccgagggcccacgtggtcgtcccagccaggttcaggtggcaggtgggtctggggacaggtagttctctctcatcatcagcagcctgcagtctagaagtnttttgcggtttattactgtcagctagtatanctagtgcctgtggtggcgttcggcaagggacgaggtacgaaatacaaacgtactaggtgctgacc

SEQ ID NO: 75600 - DNA, 570 bp, Homo sapiens
  misc_feature: GYAE6OF01EDQM9.17.39.D06.1.454.CMB.1.raw
  modified_base (221)..(221): a, c, t, g, unknown or other
  misc_feature (221)..(221): n is a, c, g, or t
  modified_base (328)..(328): a, c, t, g, unknown or other
  misc_feature (328)..(328): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (399)..(399): a, c, t, g, unknown or other
  misc_feature (399)..(399): n is a, c, g, or t
  modified_base (406)..(406): a, c, t, g, unknown or other
  misc_feature (406)..(406): n is a, c, g, or t
  modified_base (479)..(479): a, c, t, g, unknown or other
  misc_feature (479)..(479): n is a, c, g, or t
tcagcgtagactagcacgaccggtgctcgattttagtgacatctcgtcgtagggttctttgggggaggaactgctccagttaggacccagacggaaccagtggaacgccccagccgcgagcttcctcgttcctcctgctactctggcctcccagataccacgtggagaagtagtgatgacgcagtctccagcccaccctgtctgtgtctccgaggggaaancgccaccctctcctgcagggccagtcagagtgtggcagctaacttagcctggtatcagcaagaaacctggccaggcctccccgaggcctccgtcatgtacgtggtcnctatcctaccgagggccacgttggtcgtccagccgtagttcaggtcgcaggtggtcngggacngagtttcncgtctantcatcgagcagcctgacctaggtctagacgttagttttcgacgtttttatactgtacagtactaagtattaancgtaaggtcgtccgttcggtggtaccgttcggaccggaaagggtacctaagggtacgaaacttacgaaacgtactggagtctacgctaccg

SEQ ID NO: 75601 - DNA, 577 bp, Homo sapiens
  misc_feature: GYAE6OF01BUPCD.17.39.D06.1.454.CMB.1.raw
  modified_base (208)..(208): a, c, t, g, unknown or other
  misc_feature (208)..(208): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagcccaccctgtctgtgtctccgagggggaaangcccaccctctcctgcagggccagtcagagtgtggcagcaacttagcctggtatcagcagaacctggccaggcctcccgaggcctcctcatgtagtggtgcatcctaccgagggcccacgtggtcgtcccgagccgtaggttccaggtcggcgtagggttcgggtcgtggggactaggtacgttctctctacactcactcagcagcctgctagtctagtaagttagtttcgtacggttttattacgtgtacagtctaagttacttatcgaggttcggcccgttccggtacggtaccgttaccgggaccgtaacgggtacgtaagggtacgaaacgtacgaaaacgtacgtcggtaggctcgcctaaccg

SEQ ID NO: 75602 - DNA, 618 bp, Homo sapiens
  misc_feature: GYAE6OF01C62NM.17.39.D06.1.454.CMB.1.raw
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccagggggaaanagccacctntcctgcagggccagtcagagtgttggcagcaacttagcctggtatcagcagaaacctgccaggctcccaggctcctcatgtatggtgcatctaccagggccactggtgtcccagccaaggttcaggtcggctaggtggggtctggggaacaggtacgtttcacgttctctatcattcaagcagcctgcctagtctagtaagtatttttggtacggtttttattaccgttggttacaaggtacctaagggttaataacgttcgaaggttcggtacccgttccggtttacgggaacccggtttccgggtacccggaaaacgggggtaacccctaaaggggttacgggaaaaacgtttaccgaaaaccggtaacgttaggtacgggtacccgttggacctaaacccg

SEQ ID NO: 75603 - DNA, 560 bp, Homo sapiens
  misc_feature: GYAE6OF01AP15M.17.39.D06.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaaacctggccaggctccaggctcctcatgtatggtncatctaccagggccacgtggtcgtcccagccaggttcaggtcggcaggtcgggtctggggactaggtacgtttctcgtctcactcatcgagcacgcctgctagtctaggaagttattttggcggttttatacgtgtacaggtactaagttaataattcgtaggtcggtacccgttcggtacgggtaccggttcggaccgtaagggtaccgaaagggttagaaactacgaaacggtaacgtggtaggacgtcgaccgtacg

SEQ ID NO: 75604 - DNA, 535 bp, Homo sapiens
  misc_feature: GYAE6OF01D8QB7.17.39.D06.1.454.CMB.1.raw
  modified_base (206)..(206): a, c, t, g, unknown or other
  misc_feature (206)..(206): n is a, c, g, or t
  modified_base (416)..(416): a, c, t, g, unknown or other
  misc_feature (416)..(416): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaagngccaccctctcctgcagggccagtcagagtgttggcagcaacttagcctggtatcagcaagaacctggccaggcctcccaggcctcctcatgtatggtgctatctaccgagggccacgtggtctcccagcctaggttcaggtggctaggtgggtctggggactaggtagttctctctcatcatcagtcagcctgcagtctagtaacgttnttttggcggttttatactgtctagctaagttataatcagtcgcctcggtggtaccgttcggaccgaagggacctaagggtcggaaaactcgaaaacggtatacggaggcctgctaaccg

SEQ ID NO: 75605 - DNA, 537 bp, Homo sapiens
  misc_feature: GYAE6OF01BOHJR.17.39.D06.1.454.CMB.1.raw
  modified_base (204)..(204): a, c, t, g, unknown or other
  misc_feature (204)..(204): n is a, c, g, or t
  modified_base (303)..(303): a, c, t, g, unknown or other
  misc_feature (303)..(303): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaacctggccaggctcccgaggcctcctcatgtatggtncatcctaccgagggccacgtggtcgtccccaggccctaggttcaggtcggcaggtgggtctggggactaggtacgttctctctcatcatcagcagcctgcagtcgtagaagttagtttcgtcgttttattacgtgtcagtctagttatatcgagtcggcctcggtaggtaccgtcggacgacgggtacaagggtcggaaactacgaaacgtacgtaggtaggtcgtgcgtaccg

SEQ ID NO: 75606 - DNA, 534 bp, Homo sapiens
  misc_feature: GYAE6OF01DUVMA.17.39.D06.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (373)..(373): a, c, t, g, unknown or other
  misc_feature (373)..(373): n is a, c, g, or t
  modified_base (406)..(406): a, c, t, g, unknown or other
  misc_feature (406)..(406): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttggcagcaacttagcctggtatcagcagaaacctggccaggcctcccaggcctcctcatgtatggtncatctaccgagggcccacgtggtcgtcccagccaggttcaggtggcaggtgggtctggggacagagttcnctctcatcatcagcagcctgcagtctagaagtnttttggcgttttatacgtgtacagtctaagttataatcgagtcggcccttcggtggaccgttcggaccgtaaagggacccaagggtacggaaaatccgaaaacggtactaggtaggctggcctaaccg

SEQ ID NO: 75607 - DNA, 555 bp, Homo sapiens
  misc_feature: GYAE6OF01BFK5K.17.39.D06.1.454.CMB.1.raw
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
  modified_base (414)..(414): a, c, t, g, unknown or other
  misc_feature (414)..(414): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtgtctccgagggggaaanacgccaccctctcctgcagggccagtcagagtgtggcagcaacttgcctggtatcagcagaaacctggccaggcctccaggctcctcatgtatggtncatcctaccgagggccacgtggtctcccgagcctagggttcaggtgcgaggtgggtcgtgggacagtacgttctctctcattcatcgagcacgcctgcagtctagaagtnttttgacgttttattacgtgtcgagtctaagttataagtctaggtcggccttcgtacgtacggttccgggacgtaacggggtaccaaagggttcgaaaacgtaccgaaaacggtacgtaggtacggcttggaccctaaccg

SEQ ID NO: 75608 - DNA, 555 bp, Homo sapiens
  misc_feature: GYAE6OF01B51LE.17.39.D06.1.454.CMB.1.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (303)..(303): a, c, t, g, unknown or other
  misc_feature (303)..(303): n is a, c, g, or t
  modified_base (424)..(424): a, c, t, g, unknown or other
  misc_feature (424)..(424): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaancgccaccctntcctgcagggccagtcagagtgttggcagcaacttgcctggtatcagcaagaacctggccaggctcccaggcctcctcatgtatggtnctatcctaccgagggccctagttggtctcccaggccctaagggtttcaaggttcggacgtagggttcggggtctggggactaggtagtttcctcgtctcgatcagtcagtcacgcctgacngtctagtaagtagttttcggtacggttttatacgtgtcagtctagttatatcgagtcgccgtcgtggtaccgtcggaccgtaagggaccaagggtcgaaacgtccgaaaacgtcgtagtagcgtgcgtacg

SEQ ID NO: 75609 - DNA, 577 bp, Homo sapiens
  misc_feature: GYAE6OF01B9076.17.39.D06.1.454.CMB.1.raw
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttggcagcaacttgcctggtatcagcaagaacctggccaggcctccgaggcctcctcatgtatggtncatctaccgagggcctacgtggtctcccgagccgtaggttcaggtggcaggtcgggtctgggactaggtgttctctctcatcatcagcagcctgacgtagtcgtaggaagttgttttcggtacggtttttattacgtgtacctaggtactaagttaacttacgtcgtacggttccggcccgttacggtcgggtaccggttccgggaaccgtaacggggaccgtaaagggtcgaaacttacgaaaacgtcgtgggtaccgcgtgccctaacg

SEQ ID NO: 75610 - DNA, 707 bp, Homo sapiens
  misc_feature: GYAE6OF01BMAVR.17.39.D06.1.454.CMB.1.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
tcagcgtagactagcacgaccggtgctcgatttagtgacatctcgcagttctttgggggaggaactgctcaagttaggacccagacggaaccatggaagccccagcgcagcttctcttcctcctgctactctggcctcccagataccactggagaagtagtgatgacgcagtctccagccaccctgtctgtgtctcaggggaaangccacctntcctgcagggccagtcagagtgttggcagctaacttagcctggtatcgagcagaaacctggccacggcctccccgaggcctccctcactcgtattgggtcgcctactccgtacccgacggggtccctaacgttcgggtacgtccccgagccccgtagggtttcgacggtggcgtaggtcgggtcgtcgggacaggttacgtttcctacgtccttacgactctactccgaagtccgaacggtccttaggccgtacggtctaggtaaagtttacgtttttgggtaccgtttttaatttaccgttggttaaccgtagtaccgttaagttaaacgttaacttaccgtagggttccggttcccgttacccgggttacgggtacccgggtttaccgggaacccggtaaacgggggtaacccgtaaaaggggttacgggtaaaaactacccggtaaaaaccggtaacgttcgggtacggtactcgggtaaccctaaacccg

SEQ ID NO: 75611 - DNA, 735 bp, Homo sapiens
  misc_feature: GYAE6OF01AYHFL.17.39.D06.1.454.CMB.1.raw
tcagcgtagactagcacgaccggtgctcgatttagtgacatctcgtcgtagggttctttggggaggaacctgctcgagttaggacccagacggaaccgatggaagcccgacgcgcagcttctcgtcctcctgctactctggctcccacgatacccactggagaagtagtgactagacgccagtctccagcccaccctgtctgtcgtctccgaaggggtaaagagacccacccgtctccctacgcacgggcctaggtccgagagttcgtggcagcaacgttgccttggttatccaggtcaacgaaacctggaccaacggccgtccccgagggcccctaccgtactagttcggttaagtggttagccgttactccttaacccgacggggtacctacgtttgggtaccgtaccccggaggtcccctaagggtttcccaaggttcggacgtagggtcgggtacgtgggactaggtcgttcgtactcgtactatccatccgaagtcacgtcctgccgtagttccgtagaacgttacttttacgggtacgttttatttaacgtcgtaacttacgtacttaaggttaacttaactacggttaacgttacggtcccgttaccgggttacggtcccgggtttaccgggacccggtaaaccggggtaccggtaaacgggttaacggaaaccttacccggtaaaacggtaacccgttagggtaccggtacctacggcctaacccgg

SEQ ID NO: 75612 - DNA, 548 bp, Homo sapiens
  misc_feature: GYAE6OF01CP89A.17.39.D06.1.454.CMB.1.raw
  modified_base (208)..(208): a, c, t, g, unknown or other
  misc_feature (208)..(208): n is a, c, g, or t
  modified_base (307)..(307): a, c, t, g, unknown or other
  misc_feature (307)..(307): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtgtctccgaagggggaaanacgcccaaccctctcctgcagggccagtcagagtgtggcagcaacttagcctggtatcagcagaacctggccaggctcccaggctcctcatgtatggtncatctaccagggccacgtgtcgtcccagccaggttcagtggcaggtgggtctgggacaggagtttctctctcatcatcagcagcctgctagtctagaagtatttttggacggttttattaccgtggttcaaggtctaagtactaatcgaaggttcgaccttccggtggtaccggttcggaccgaacgggaaccgaagggtacggaaaactacaaacggtaacgttggtaggctggcaaccg

SEQ ID NO: 75613 - DNA, 553 bp, Homo sapiens
  misc_feature: GYAE6OF01EC9WI.17.39.D06.1.454.CMB.1.raw
  modified_base (206)..(206): a, c, t, g, unknown or other
  misc_feature (206)..(206): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgccaccctctcctgcagggccagtcagagtgttggcagcaacttagcctggtatcagcaagaaacctggccaggctcccgaggctcctcatgtatggtgcatctaccgagggccacgtggtctcccagcccgtagggttccagtggcgtaggtgggtcgtgggacaggtagttctctctacatcatcgagcagtcctgcagtcctagtaagtatttggtcgttttatactgtacagtctaagtataactgtaagtcgtaccgtcggtcggtacgttccggacgaacgggtaaccgaagggtaacgaaacgttacaaaacggtcgttaggagtctggacctaaccg

SEQ ID NO: 75614 - DNA, 484 bp, Homo sapiens
  misc_feature: GYAE6OF01E2A8V.17.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (300)..(300): a, c, t, g, unknown or other
  misc_feature (300)..(300): n is a, c, g, or t
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttggcagcaacttagcctggtatcagcagaacctggccaggctcccaggctcctcatgtatggtncatctaccagggccacgtggtcgtcccagccaggttcagtggcaggtgggtctgggacngagttctctctcatcatcagcagcctgcagtctgaagtnttttgcggttttatactgtcagcagtatatcagtggcctcgtgccgtcgacgaggacaggtgaatacaacgtactgtagctgctac

SEQ ID NO: 75615 - DNA, 653 bp, Homo sapiens
  misc_feature: GYAE6OF01BJ1HC.17.39.D06.1.454.CMB.1.raw
  modified_base (305)..(305): a, c, t, g, unknown or other
  misc_feature (305)..(305): n is a, c, g, or t
  modified_base (382)..(382): a, c, t, g, unknown or other
  misc_feature (382)..(382): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctcccagataccactggagaagtagtgatgacgcagtctccagccaccctgtctgtgtctccgaggggaaagagccaccctctcctgcagggccagtcagagtgttggcagcaacttagcctggtatcagcaagaacctgccaggctcccgaggctcctacatgtatggtncactctacgacggctacgtggtctccagcaggttcaggtgctaggtggtcgtacgggactaggtagttctcgtctanactcgaatccaagcacgtcctgcctagttctaggaagtttgttttcggcggtttttaactgttacggtactaaggtccgtaaagttacgtaacgtttcgggaacggttccgggacccctttaccgggggtacgggtttacccgggtttacccggggaaacggtaaaccgggggtaaaccgtaacgggggtttaaacgggaaaaacccttacccgggttaaaaaccggtccggtttaaggggtacccgacggttaacccgtaacccgtaacg

SEQ ID NO: 75616 - DNA, 652 bp, Homo sapiens
  misc_feature: GYAE6OF01AHI4J.17.39.D06.1.454.CMB.1.raw
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtcgtccccgaggggaagacgccaccctctcctgcacgggccagtcagagtgttggcagcaacttagcctggtatcagcaagaacctggccaggcctcccgaggcctcctcatcgtatggtgcatctaccgacgggccacgtggtcgcccagtcctaggttcgaggtcggcgtaggttcgggtcgtaggggactaggttacggtttcctccgtctactacttaccacgtaccgacgtccgtacgtcccgttcggaccgttacggtccgtaaggtaacggtttagttttcgggttacggtttttactttaacgtcgttacgtaacgtacgtaagttacgttaacgtccggttaggtccggtaccgtaccgggttgggtaccggttaccggaccggtaacggggaaccctaagggtacggtaaactaacgaaaccgtacgtcggtacggacctcggacctacgtacg

SEQ ID NO: 75617 - DNA, 897 bp, Homo sapiens
  misc_feature: GYAE6OF01DC7HI.17.39.D06.1.454.CMB.1.raw
  modified_base (208)..(208): a, c, t, g, unknown or other
  misc_feature (208)..(208): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtcgtctaccgaaggggaaancgcccaccctctcctgcagggccagtcagagtgtggcagcaacttagccttaggtactcgagaccaacgaaacctgggacccaagggcctccccgaggtcctcccgtctaagttcgtagtcgggtacacctacgttaccgtaacccgacggggacccctaacggttcgggtcgtaccccaggcccgttaaggggtttaccagggttcgggtaccgtaggggtttcgggggttaccgtaggggggtaaacctaacggttacggttttcctaccgtttaccgtaaccggtaacttacccgtaaccgttaccggaaccggtaccccgtaacggtccccgttaacgggtacccgtaacgggtttacgttaacggggttaaaacgtttttacggttttttttaccggggtaaccggttttttttaaacctttaccgggtttaacggttaccgtaaacggttacccgttaaagggtttaaacctttaacgttaccggttaacggggttcccggttaccccggtttaccgggttaccgggggtaaaccccgggtttccggggaaaccccgggttaaaaccgggggtaacccgggtaaaaacggggtttacgggaaaaacccgttaaacccggaaaaaacccggtttcggtacggggttaacgggtacccgtaaccggttacccgttaaaaccccgg

SEQ ID NO: 75618 - DNA, 707 bp, Homo sapiens
  misc_feature: GYAE6OF01ANIHU.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagtcccagcgcagcttctcttcctcctgctactctggctcccagataccactggagaagtagtgatgacgcagtctccagccaccctgtctgtgtctccgaggggaaancgcccaccctctcctgcagggccagtcagagtgtggcagcaacttgcctggtatcagcaagaacctggaccaggcctcccgaggcctcctacagtgtagtggtacgctacgtccgtacccgaggggcccctacgttcgggtccgtccccgaaggtccccgtaagggtttcaaggttcgggacgtaggggttggggttaccgtgggggaacctaggttacgtttccttaccgttctcgtaactccgtaattccgaagtccctacgccgttcggacctacggttcgtaaggttaacgtttacgtttttcgggttaaccggtttttattacgttcggttacgtaacggtacgtaacgtttaataactacggtaggttccggtacccggtttcgggtacggtaacccggttccgggaaacccggtaaaggggtacccgtaaaggggttaacgaaaacgttaacgtaaacggtaaccggttggtaccggacgttcggccctaaccgg

SEQ ID NO: 75619 - DNA, 727 bp, Homo sapiens
  misc_feature: GYAE6OF01DLLHE.17.39.D06.1.454.CMB.1.raw
  modified_base (504)..(504): a, c, t, g, unknown or other
  misc_feature (504)..(504): n is a, c, g, or t
tcagcgtagactagcacgaccggtgctcgatttagtgacatctcgcagtttcgtttgggggaggaactgctcagttaggacccagacggaaccatggaagccccagcgcagcttctcttcctcctgctactctggctcccagataccactggagaagtagtgatagaagcagtctccagccaccctgtctgtgtctccgaagggaagacgccacctctccgtgcgacggccagtcaggtagtggtggcagcctaacttgccgttagtactcgaagacgaacgaaaccgtcggaccacggccctcccgacggcccttaccgtactaagttcgttagtcgggtacacgtacttaccgaccgtacgggccctacggtcggtcgtcccgagtccgtacggtcgaggtcggcgtaagggtcggtcggtacgggactacgggttacttccgtcgtacgtacgtaacgttcgtactaccgacggtcctacgtccgttacgagtaaccggtnttaaggtaaagttttcgtttttacgggttaacggtttttaactacgttcggttaagaagttacctaagtttaaactaacttcgggtaacggtccggttaccgttaccgggtgggttaaacccggtcgggtaaacccggaacgggtaacgtaaaacggggttacgaaaactttaaacccgggaaaacgtccggttacggtacggtaccgcgttaacccctaacg

SEQ ID NO: 75620 - DNA, 855 bp, Homo sapiens
  misc_feature: GYAE6OF01CEEXG.17.39.D06.1.454.CMB.1.raw
  modified_base (171)..(171): a, c, t, g, unknown or other
  misc_feature (171)..(171): n is a, c, g, or t
  modified_base (205)..(205): a, c, t, g, unknown or other
  misc_feature (205)..(205): n is a, c, g, or t
  modified_base (355)..(355): a, c, t, g, unknown or other
  misc_feature (355)..(355): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctccagataccactggagaagtagtgatgacgcagtcnccagccaccctgtctgtcgtctccgaaggggaanacgccaccctctcctggccgaacgggccagtcgaggtagttggttaggacacggactaaacgttggcccgttagggtactcgaacggaccgaaacggaaaaccgttcgggacccgaacgggcccttaccccggaacgggtcctacccgtntacgttggttagtcgggtcacctaacgttaccgtaacccggacggggtaccctacgggttcgggtaccggtacccccgtaaggtccccggttaagggtttcccggaggggtccgggtacggttaacggggtttcgggggttaccgagggggtaaacctacggggttacccgttttacgtcccgttaccgttacgttaacctacgtaccttaccggacgttaacccgccggtccgtttacggacgttacgggtaccgtttagggtaaacgtttttgtttttacgggttaacgtttttaactttacggtacttacgtaacggttactaaaggtttaataaccgtttacggtaaccgggttccggtaccgttaccggggttgggttaacccgggtttaccgggaaccggtaaaccggggtaaacggttaaagggtaaaccggttaaaccgaaagggtaaaccgtaaacggtcgggtaaccgtcggtaaccgaccgttaacccg

SEQ ID NO: 75621 - DNA, 721 bp, Homo sapiens
  misc_feature: GYAE6OF01BC7FP.17.39.D06.1.454.CMB.1.raw
  modified_base (205)..(205): a, c, t, g, unknown or other
  misc_feature (205)..(205): n is a, c, g, or t
  modified_base (243)..(243): a, c, t, g, unknown or other
  misc_feature (243)..(243): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaanacgccaccctctcctgcagggccagtcagagtgtggcngcaacttagcctggtatcagcagaacctggaccaggcctccccgaggtcctccgtcatgtagtggtcactacgtccgtaccgagggtcccctacggttcggtccgtccccgaaggtccccgtagggtttaccgaggtcgggtaccgtaggggttcggggtccgtacggggaaacctagggttacctttccgttaccgttaccgttacgtactttaccggaacttaccgaacggtcccgacgtacccgttgaaccgttacgtaccgttagtaaaggttttcgttttacggttaccgtttttaattaccgttaggtctaagttacgtaagtttaactaggttaccttacggtccggtacccgttcgggtacggttacccgggtacccgggaaaccgtaacggggtaaccggaaagggttacccggtaaactaacccggaaaacgggttacttacgggacgtcgtaccgtaccgtaacccg

SEQ ID NO: 75622 - DNA, 664 bp, Homo sapiens
  misc_feature: GYAE6OF01C2CLT.17.39.D06.1.454.CMB.1.raw
  modified_base (204)..(204): a, c, t, g, unknown or other
  misc_feature (204)..(204): n is a, c, g, or t
  modified_base (649)..(649): a, c, t, g, unknown or other
  misc_feature (649)..(649): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctccagataccactggagaagtagtgatgacgcagtctccagccaccctgtctgtgtctccgaggggaaancgccaccctctcctgcaggccagtcagagtgtgcagcaacttgcctggtatcagacgaagaaccgtggccaggcctaccccaggtcctcctacacgtgtacgtggtcgcgtacttaccgtaacccggacgggaccctacgttcggtcgtaccccgagtaccccgtagggtttcgaacggttcggcgtaagggttcggggttcgtacggggtaactaaggtacgttttcccgtacgttaccgtactaactcctaacgttaccgacggccgtaccggtccttacgcgttacgtacgttaggtaacgtttagttttcggttacggttttatacgttagtaccgaagtactagttaactaagtcgttagggtccgtccgtcggtacggaccggttcgggaaccgtaacggggtacgaagggtagaaaacgtacgtaaacgcgttacggngacctagccgtaacg

SEQ ID NO: 75623 - DNA, 782 bp, Homo sapiens
  misc_feature: GYAE6OF01A44EJ.17.39.D06.1.454.CMB.1.raw
  modified_base (205)..(205): a, c, t, g, unknown or other
  misc_feature (205)..(205): n is a, c, g, or t
  modified_base (325)..(325): a, c, t, g, unknown or other
  misc_feature (325)..(325): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctcccagataccactggagaagtagtgatgacgcagtctccagccacctgtctgtgtctccgaggggaaancgcccaccctctcctgcagggccagtcagagtgttggcagcaacttgcctggtatcgagcaagaacctggccaggcctccgagcctcctcattcgtagtggtcactactaccgtaaccgngggtccctaggttcggtcccgtacccgaaggtcccgtaacgggttcaagggttcgggaccgtagggttccggggtaccgtacgggggtaacttacgggttacggtttccttacccgttacgttacctaacgtttaccctaacgtacccgtaacggtaccctaaccggttcccgttaggaccgttaccggtttaccgttaaagggtaacgtttttacgtttttaacgggttaccggttttttaacttacggttcgtaaccgtaaggttaacctaagtttaaacgttaacgttccgtacgggtttaccgggtaccccgttcccggggttaaggtaccccgggtttaccgggaaaccggtaacgggggtaaacccttaaagggggtacgtaaaaacccgttaggaaaaccggttaacgggttcgggttaaccgaccggttaaccgcccgttaaaacccgg

SEQ ID NO: 75624 - DNA, 390 bp, Homo sapiens
  misc_feature: GYAE6OF01ENQWR.17.39.D06.1.454.CMB.1.raw
  modified_base (295)..(295): a, c, t, g, unknown or other
  misc_feature (295)..(295): n is a, c, g, or t
  modified_base (381)..(390): a, c, t, g, unknown or other
  misc_feature (381)..(390): n is a, c, g, or t
tcagcgtagactagcacgaccggtgctcgatttagtgacatctcgcagttctttgggggcagaggcagggctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagacctgttctgaattctaaactctggaggggtcgatgacgtggcctattcttgacctaaagctattgatttacngacaaggactgtgctgcacatctgtcttcattcctcccgctatctagactagtctacgctgacgcggctggacaaggcgcagtagnnnnnnnnnn

SEQ ID NO: 75625 - DNA, 697 bp, Homo sapiens
  misc_feature: GYAE6OF01D2SM2.17.39.D06.1.454.CMB.1.raw
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtcctccgaaggggaaancgcccaccctncctgcagggccagtcagcgtgtgcagcaactgctggtatcagcacgaaaccgtcggcctacggcctcccgacggtctcctntagtgtactggtnctactccgaccgagggcctacgtggtcgccgacgccgtaggttccaggtcgggcgtagggtcggtacgtagggactaggtacgtttcctactcgtactaacttcaacgtccaaggcctaacgccgttgacctaacgttcgttacgtaacggtttagtttttaccgggtacgtttttaacttacgtagtaaccgtaaggttactaaaggttaacttaagttacgttacggtaccggttacccgttcggttaccgggttaccggtaacccggggtacccggtaaaaccggggtaacgtaaacggggtaaaccggttaaaacggttaaacccgaaaacgggttaccggttaacggtacggttacccgtaaccgtcccgtaaaacccgg

SEQ ID NO: 75626 - DNA, 621 bp, Homo sapiens
  misc_feature: GYAE6OF01DKB3K.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcacgggccagtcagagtgttggcagcaacttagcctaggtactcagacaagaaacctggccaaggcctccccgaggccttcctacagttgtagtgggtgctactccgtaccgagggcccacgtggtcgtcccagccgtagggttccaggtcggcgtagggtcgggtcgtgggactaggtacgtttctcgttctacgtatcatcagcacgtccgtgccgtagttcgtaggtaacgttgtttttacggtacgttttattacgttgtactagtactaagttataagtcgtaggtccgtccgttaccggtgggtaccggttcggaccggtaaacggggaccgtaaagggtacgaaaactaccgaaaacggtacgttacggtacgggtacctgtaccgtaaccg

SEQ ID NO: 75627 - DNA, 787 bp, Homo sapiens
  misc_feature: GYAE6OF01D0HDC.17.39.D06.1.454.CMB.1.raw
  modified_base (206)..(206): a, c, t, g, unknown or other
  misc_feature (206)..(206): n is a, c, g, or t
  modified_base (316)..(316): a, c, t, g, unknown or other
  misc_feature (316)..(316): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgcccaccctctcctgccagggccagtcagagtgtggcagcaacttgcctggtatcagcaagaacctggcccaggtcctcccgaggtcctcctacagtcgtaagtgggtnctatccgtaaccgagggtcccagtgggtctccccgagtccgtaggttcagggtcggacgtaggtggggtacctggggaacctaggtacgtttcctaccgttctacgtacttacctaacgtaccgaacggtccacggtccccttaggacccgtaaggtttaccgttaagggttaaacgtttacggtttttttcggggtaaccgggtttttttaattaaccggttggttaaccgtaaggtaccgttaaaggtttaacttaaacgtttcggtaaacgggtttcccggggtacccggtttacccggggtttacggggttaaacccccgggtttaccggggtaaaccccgggttaaaacggggggtaaaccccggttaaaagggggttaaccggggtaaaaaaaccgttcccggtaaaaaaacgggttaaccggttacgggttacgggtacccgttacggacccgttaaaccccgg

SEQ ID NO: 75628 - DNA, 903 bp, Homo sapiens
  misc_feature: GYAE6OF01CFGLD.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagcccagcgcagcttctcttcctcctgctactctggctccagataccactggagaagtagtgatgacgcagtctccagccacctgtctgtcgtctaccgaaggggaancgccaccctctccgtgcgagggccagtcagtagtgtggacagtctaacgttagccgttaggtactcgaagacgaaggtaaccgtggaccgtacggccttaccccgacggtcctaccccgtagtaagttcggtaacggttccgggttacgaaccttaaccgtttaaccccgtaaccggacccgggggtaccccttaaacggggtttccggtacccggttaaccccgacggttacccgtaaggggtttaccgagggtttccgggacggtaacgggttcggggacccgttaggggaaccttaacgggttacgttcctaccttcgtaaccgtacttcgaaccgttcgaaccgggtacaccgttcccgtaggtaacctagggtttaccgtaaaggttaaacggtttttcggttttttagggtaaacccggttttttataaccgttaccgggttctaacgggttacggtttaaagtttaaaccgtttaacgtccggttaaaccggggtttccccggttaacccgggttccgggttttaccggggtaaaacccgggttacccggtaaaacccggggggtaaacccgggttaaaccggggttaaacggggttaaaccgggtaaaaaccgttaaacccgggaaaaccgttttaaccggggggtcttaacccgggtacccgttaacgggaaaccccgttttaaacccgg

SEQ ID NO: 75629 - DNA, 709 bp, Homo sapiens
  misc_feature: GYAE6OF01B0T19.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccacctctcctgcagggccagtcagagtgtgcagcaacttgcctggtatcagcaagaacctggacccaggcctaccccgaggcctccgtacagttgttagtggtcgctaactccgtaaccgacgggccctacggttcggtcgtccccgagcccgtagggttcaggtcggcgtaggtcgggtcctggggactaggtacgttcgtctactcgattacactcgacgccgtacgtcccgtggacgtacggttcctaagggttaaacgtttacgtttttacgggttaacccggttttttaatccggttacgtaccgtacgtactaaagggtttaacttaacgtcgttaacgggttccggtacccgttacccggggtttacggacccgggtttaccgggggaaaccccggtaaacgggggtaaacccggttaaaggggttaaccgggtaaaaacgtacccggtaaaacggtacggttacgggttaacgccggttaccgaacccttaccg

SEQ ID NO: 75630 - DNA, 764 bp, Homo sapiens
  misc_feature: GYAE6OF01B6XWU.17.39.D06.1.454.CMB.1.raw
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtcctccgaaggggaaacacgcccaccctctcctgcgagggccagtcagagtgtggacagcaactagctaggtatcagcaacgaacctggaccgaggtcctcccgaggtcctacctcgaagttcgtagtcggttcgactaacgttccgtaaccgacggggtaccctaacggttcgggtccgttaccccgaaggtccccgttaagggttccgtaaggttcgggacgtacgggttcggggtaccgtaggggaacctaggttacggttcctaccttaccgtctacgttaccgaactttacgaacgtacgaacgggtcccgttacggtaccgtaacgggttaccgtaagggttaaacgttttagtttttacgggttacgggttttaactttaaccgttaggtaccgtaaggttaccttaagggttaaactaacggttacgtaacggtcccgggttacccggttcgggtaaccggttaccgggttaccggaaccgggtaaaacggtaaccgggtaacgggtaaaggtaaaaccgtaacgaaaaccggtacgtacggttacggacgttcggtacctaaccg

SEQ ID NO: 75631 - DNA, 731 bp, Homo sapiens
  misc_feature: GYAE6OF01AHMU9.17.39.D06.1.454.CMB.1.raw
  modified_base (334)..(334): a, c, t, g, unknown or other
  misc_feature (334)..(334): n is a, c, g, or t
  modified_base (348)..(348): a, c, t, g, unknown or other
  misc_feature (348)..(348): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaacgagcccaccctctcctgcagggccagtcagagtgttggcagctaacgttagcctaggtactcgagacgaacgaaccgtcggaccacggcctaccccgacgggcccttcctactagtgtacgtcgggtcncctagtcctaccgngggaccctacgtcggtcgtacccgagtcccgtaagggtttcacggttcggaccgtagggttcgggtaccgtaggggaacctaggtacgtttcccgtacttaccgtatactactaacgttccaaggtcccgtaacggtccccgttagtaccgtacggtttacggtaacggttaagtttacggtttttacggttccggtttttaaacgttaccgttcgttacccgtaaggttaccgtaaagttaccgttaattcggtacggtccggtaccccgttacgggtccggtaaaccggttccgggaccggtaacgggtaaccgtaacgggttaacgggaaacctaaccggaaaacggttacgacgggttacgacgttccgaacgtacccg

SEQ ID NO: 75632 - DNA, 540 bp, Homo sapiens
  misc_feature: GYAE6OF01EIBY3.17.39.D06.1.454.CMB.1.raw
  modified_base (234)..(234): a, c, t, g, unknown or other
  misc_feature (234)..(234): n is a, c, g, or t
  modified_base (317)..(317): a, c, t, g, unknown or other
  misc_feature (317)..(317): n is a, c, g, or t
tcagcgtagactagcacgaccggtgctcgatttagtgacatctcgcagtttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagngtgttggcagcaacttagcctggtatcagcagaaacctggccaggctcccaggctcctcatgtatggtgcatcaccagggccncgtggcgtcccagccaggttcagtggcaggtgggtctgggacaggtagttctctctcatcatcagcagctgcagtctagaacgtattttgcggttttattaccgtgtcgtagctagtactaatcgtagtcggtcccttcggtcgggtaccggtccggaccgtaacgggaaccgaagggtacggaaacgtaacaacgtaacgtacggtaggtcgtggctaaccg

SEQ ID NO: 75633 - DNA, 739 bp, Homo sapiens
  misc_feature: GYAE6OF01A1FJB.17.39.D06.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (286)..(286): a, c, t, g, unknown or other
  misc_feature (286)..(286): n is a, c, g, or t
  modified_base (297)..(297): a, c, t, g, unknown or other
  misc_feature (297)..(297): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctcgaggggaanagccacctntcctgcaggccagtcagngtgttggcagtaactgcctggtatcagcagaacctggccaggctccaggcctcctnagtgtatggtnacacttcaccgaggaccctagtcggtcgtacccgagtccctagggttcagggttcggactaagggttcgggacgttcggggaacctagggttaccgtttcctacgttaccgttactacgttccgaacttcgaacgtccgtaacgtcccgttaggacctaacgggttcgtaaggtaacgtttacggtttttacggtaccggtttttaatttaccgtacggttacgaacgttacgttaaggtttaaccttaaggtaccgttacgggtttacccggtacccggtttaccgggttacgggttaacccgggtttcccgggtaaaccggtaaacgggggttaaccccgttaaaggggttaacgggtaaaaaccgttacccggtaaaaaagggttaccggttaccgggttaaagggtacccgtttaaccggcgttaaacccggttaacg

SEQ ID NO: 75634 - DNA, 835 bp, Homo sapiens
  misc_feature: GYAE6OF01EXAQS.17.39.D06.1.454.CMB.1.raw
  modified_base (203)..(203): a, c, t, g, unknown or other
  misc_feature (203)..(203): n is a, c, g, or t
  modified_base (304)..(304): a, c, t, g, unknown or other
  misc_feature (304)..(304): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgagggaancgcccaccctctccgtgcgagggccagtcagtgtgtgcagctaacttgcctggtactcagacaacgaacctggaccgacggcctacccgaggtcctccgtnacgttggtagtcggtcgacctacgttaccgtaaccggacgggtcccctaacgggttcgggttacccgtccccgtaacggtccccgttaaagggtttccgagggttcgggtaccggttaacggggttcggggttaccgtagggggtaacccttaagggtttaccgttttcccgtaccgttaccttacgtaaccgttacgtaaccgtcgtaacgggtcccgtaaccggtcccgttaggtaccgttacgggtttaccgttaaagggttaaacgtttttacgggtttttaccgggttacgttttttaaaccgttacgttacggtttaccgaaacgttaccgtttaaaggttaaccgtttaaacggtttccggttaacgggttcccggttaccccgggttacggggttaccgggttacccggttaccggggtaacccgggtaaaacggggtaaccggttaaacggggttaaacgtaaacgtaaaccggaaaaccggttacgggttacggtacgggtacctgaaacccgttaacccg

SEQ ID NO: 75635 - DNA, 745 bp, Homo sapiens
  misc_feature: GYAE6OF01EQEDP.17.39.D06.1.454.CMB.1.raw
  modified_base (152)..(152): a, c, t, g, unknown or other
  misc_feature (152)..(152): n is a, c, g, or t
  modified_base (205)..(205): a, c, t, g, unknown or other
  misc_feature (205)..(205): n is a, c, g, or t
tcagcgtagactagcacgaccggtgctcgatttagtgacatctcgcagtttctttgggggaggaactgctcagttaggacccagacggaaccatggaagccccagcgcagcttctcttcctcctgctactctggctcccagataccatgganaagtgtgatgacgcagtctccagcccaccctgtctgtgtctaccgagggaaancgcccaccctctcctagccaggccagtcagtagtgtggcagctaacttagccgtgtatcagacagaaaccgtgaccgaggtcctacccgaggcctcctactagtgttagtggtcgactactccgtaccgacgggtaccctacgttcgggtccgtacccgaacggtacccgtagggtttcccgaaggtccgggtacgtacggggttcggggttaccggtacggggtaacctaaggggtaccggttttaccgtccgtttaccgttactaacgttaccgtacgtaccgacggtaccgtaaccggtcctagggtaacccttagttaccggttagttaaggtttacgtttttggtaaccgggtttttacttaccggttacgtacgtagtacgtaacggttaataacgttcgtaacggttccggtacccggttcggtacgggttacccggttaccggtaaccgaaacggggttaacccgtaagggttaacgtaaaccgtaacgaaaccggttaacgttcgggtagaccgttgaacccgttaacccg

SEQ ID NO: 75636 - DNA, 586 bp, Homo sapiens
  misc_feature: GYAE6OF01BK2HA.17.39.D06.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaaacctggaccaggctcccaggctcctcatgtatggtncatctaccgagggccctacgtggtcgtcccagtccgtaggttcaggtcgggcgtagggtcgggtcgtggggaactaggtacgttctcttctacatcatcagcacgtccctgactagtcgtagtaacgttagttttggtacggttttattacgtgttacgtagacgtagttaataacttcgaagtcgtcccgttcggtcggtaccggttccggaacgaacggggtaaccgtaagggtacgtaaaacgtacgtaaacggtacgttgggtacgctcggacgtaaccg

SEQ ID NO: 75637 - DNA, 832 bp, Homo sapiens
  misc_feature: GYAE6OF01EI843.17.39.D06.1.454.CMB.1.raw
  modified_base (216)..(216): a, c, t, g, unknown or other
  misc_feature (216)..(216): n is a, c, g, or t
  modified_base (232)..(232): a, c, t, g, unknown or other
  misc_feature (232)..(232): n is a, c, g, or t
tcagcgtagactagcacgaccggtgctcgatttagtgacatctcgcagttcgtttgggggaggaactgctcagttaggacccagacggaaccatggaacgccccagcgcagcttctcttcctcctgctactctggcctcccagactaccactggaagaagtagtgatgacgcagtcctccagcccaccgtgtctgtgtccgtccgaaggggaaacnccgcccaccctctcgngccgaggccagtcaggtgtgtggacacgacgtaactcgtccgtaggtactacgagaccgaaagtaaccgtcggaccgtaacggcccctaccccggaggtccctccgtacgtacgtttaggtacgttcgggtactaccgtaccgttaccgtaaccggaccgggtcccctaaccgggttccgggttacccggtaccccgaaccggtaccggttaacgggtttccggaacggttcgggtacggtaacggggtttcgggtacgggttacgggggtaacttaacgggttcgtttccgttaccttcgttaacctagtaccgtacgtacgacgtacccgtacgtaccgtcgaccgtacggttacggtaaagttaacgttttcgttttacgggtttacgttttacgttacgttacggtaccgttaattacggtaagttaaccgttacgttacgtacggttacccgggttacccggttccgggtacgggttacccggtaacccgggtaacgggtaaacgggtaacccggttaaagggtaccgtaaaaaccggttaacgaaacccgggttaacggttacgggtaccggtaacgtccggtaacgtaacccg

SEQ ID NO: 75638 - DNA, 852 bp, Homo sapiens
  misc_feature: GYAE6OF01EO3CK.17.39.D06.1.454.CMB.1.raw
  modified_base (348)..(348): a, c, t, g, unknown or other
  misc_feature (348)..(348): n is a, c, g, or t
tcagcgtagactagcacgaccggtgctcgatttagtgacatctcgcagttcgtttgggggaggaactgctcagttaggacccagacggaccatggaacgccccagcgcacgcttctcttcctcctgctacgtctggctccaggataccactggagaagtgtgatgacgcagtctccagccaccctgtctgtcgtctccgagggggaagcgcccaccctctcctgcaggggccagtccaggagttgggtggctagactaacgttagccttggtactcacgacgaacgtaacccgtcgccgtacggtcccctccccgagggtcctcccgtctacgttcgttacgtcgggnttacggtccaaacggtccgtaacccctaggggtccccaacggtccggtacgttccccgaaggttccaaggggtttcgaacggtagggtccgaaacggttgggggtacctaggggttaccgttacgtacggtttcctacgttaacgtcccgtaagttcccgaaacgtccctaagggacccttaaggcccttaaggtacccgtaggtttaacggttacttaacgggtttaccgttttaacggttaccggtttaacggttttaacggttacccgttaacgggtttacccgtaaagggtttaccgtaaagggtttaaccgttaacggttaccggtaccgggtttaccgggttcccggttacccgggttaaccggggaacccggtttaccgggtaaacccgggttaaaacggggttaacccggttaaacggggtaaaaccgggttaaaaccggaaacggttttaaccggaaacggttaacccgggttaaggtaacccgggttaacccgg

SEQ ID NO: 75639 - DNA, 758 bp, Homo sapiens
  misc_feature: GYAE6OF01B4990.17.39.D06.1.454.CMB.1.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (312)..(312): a, c, t, g, unknown or other
  misc_feature (312)..(312): n is a, c, g, or t
tcagcgtagactagcacgaccggtgctcgatttagtgacatctcgcagtttctttgggggaggaactgctcagttaggacccagacggaaccatggaagccccagcgcagcttctcttcctcctgctactctggctccagataccactggagaagtagtgatgacgcagtctccagccaccctgtctgtgtctccgaggggaanacgccacctcnctgcgagggccagtcagagtgtggcagcaattagctggtatcagacagaaacctcggccacgggcctcccgaggtcctcctacgatgtatgggtacncactccgtaaccgacgggtccctacggttcggtccgttaccccgaacggtcccgtaacggggtttccgaggttcgggacgtaagggttcggggtacgtacggggaactacgggttacgtttccgtccttaccgttacgaactttcgaaacgttccgagggtaccccttacgggcccctttaggaacccgttaggtttaccgttaacgggttaaagtttttacggtttttttaccgggttaaccgggtttttttaactacccgttttacgggtaaccctaagggttaccgttaaagtttaaacgtaacgttcggtaacgggtttccgtaccccggttacgggttacgggttacccggttaccgggaaaccgggtaaacggggtacgtaaacggggttacgaaaaccgttaacgaaacgggtaactgggtacgcgtaccgcttaaccg

SEQ ID NO: 75640 - DNA, 621 bp, Homo sapiens
  misc_feature: GYAE6OF01CIJX7.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctccagataccactggagaagtagtgatgacgcagtctccagccaccctgtctgtgtctccgaggggaaanacgcccaccctctcctgcgagggccagtcagagtgtgcagcaattgcctgtactcagcaagaacctggaccacggcctacccgaggcctcctcacgtgtagtggtgctactccgtaccgacgggccctagttcgggtctcccgagtcccgtaggtttccgaggttcgggctaaggggttcgggtccgaggggacctaggttagtttccctacgttcctacgtactcaactcgaagcctacgcctagcgttagtcgttagtaacgtttacgttttcggtcgttttaattacgtgtacagtactaagttatactcgtacgtcggtacctcgggtacgtccggttaccggaaccggaacgggtaccgtaaagggtacgtaaaacgtacgaaacgtcgtaggtcgtcgtacgcgtaaccg

SEQ ID NO: 75641 - DNA, 714 bp, Homo sapiens
  misc_feature: GYAE6OF01AWFD0.17.39.D06.1.454.CMB.1.raw
  modified_base (350)..(350): a, c, t, g, unknown or other
  misc_feature (350)..(350): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctcgagggaagacgccaccctctcctgcgaggccagtcagagtgttgcagcaagtcgctggtatcgagcaacgaacctcggccgaggcctacccgaggtcctccctacagttcgtacggttggtacgctagtaccgtaccgacggcctacgtgggtccncccgagccgtacggtcaggtggcgaggtcggtcgtgggacgtaggtacgttctcgtcacgtatacgtcgtcgacgtcgtacggtccgtcgacgtacggttacgtaaggtacgtttacggttttacggtttaccggtttttaattaccggtttacgggttctaacgggttaaccgtaacgtttaacgtttaacgttacccggtaagggttaccccgggtaccccgtttaccggggttaccgggttacccgggttaaccggggtaacccgggtaaacccgggtaacgggttaaccgggttaaaggggtaaaccgtaaccgtaaaccgggtacggtaacgggttccggtaacgtacgaacgtacccg

SEQ ID NO: 75642 - DNA, 885 bp, Homo sapiens
  misc_feature: GYAE6OF01EYBP5.17.39.D06.1.454.CMB.1.raw
tcagcgtagactagcacgaccggtgctcgatttagtgacatctcgcagtttcgtttgggggaggaactgctcagttacggacccagacggaaccagtggaacgcccagcgcagcttctcttcctcctgctactctggcctccagactaccacgtggaagaagtagtgagtcgacgcacgtcctccacgccctaccgtgtctgtcgtccgtaccggaaaggggaaacgaccgcccctaacccttccgtccgtacggccgacgggtacctaacggtacgaagggtacggttggttcgggacctaacgtaaccgttaaacgttacggtacccgttagggttaacctcgaacggaccgaaaccggtaaacccgtcggacccgtaccgggtccctaccccggacggtccctaccgtacgtaagtttcggtacgtcggtcgtacctacgttacccgtaaccggcgggtacctacgggttccggtacccgtacccgaacggtcccggttaaggttccggacggtacgggtacgtacgggttcggggtatacgggactaggttaccgtttccgtctcgtacgtacctacgtacgaccgtacgtacccgtcgttccgacgtaccgttagttaccggttaagtttaaggttttactttttacgggttacccgtttaactttgacggttaaccgttaggtaacgttaacgtttaacggttaaccgtacggggttacgttaccgggttaccccgtaacgggggttcggttaaaccccggggtaccggaaaaccggggtaaaccgggttaaacggggtaacggttaaaaccggtaaaaccgttaaccggaaacggtttacggggcgtaacggtttcccggtaacgcccggtttaaacg

SEQ ID NO: 75643 - DNA, 709 bp, Homo sapiens
  misc_feature: GYAE6OF01DB1UX.17.39.D06.1.454.CMB.1.raw
  modified_base (206)..(206): a, c, t, g, unknown or other
  misc_feature (206)..(206): n is a, c, g, or t
  modified_base (337)..(337): a, c, t, g, unknown or other
  misc_feature (337)..(337): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaaggggaaanacgcccaccctcgtcctgcgacgggccagtcaggtagtggttggcagctaaacgttagccttaggtatcgaagcaagaaacctgggacccaggcctccccgaaggtccctcctcgaagttcgtagtggtcncctaagttccgtaaccgacggggtcccctaacggtcggtccgtacccaggtccccgtagggtttccaagggttcggacgtagggtcgggtacgtaggggtacctaggtaccgtttctcgttctactaactcgtaactcaagtcgacgtcctagacctagtcgtaaggtaacgtttacgtttttacggtaccggtttttaattaccgttacgttacgaacgtcgttaaagttaactaacgtcttacgggtcgtcccgtttacggtacgggtaccggttacccggaacgggttaaacggggaacccgtaaaggggtaccgtaaaacgtaaacgtaaaaccggtcgttaggtacggacttaccgacgttaacccg

SEQ ID NO: 75644 - DNA, 780 bp, Homo sapiens
  misc_feature: GYAE6OF01DY91F.17.39.D06.1.454.CMB.1.raw
  modified_base (147)..(147): a, c, t, g, unknown or other
  misc_feature (147)..(147): n is a, c, g, or t
tcagcgtagactagcacgaccggtgctcgatttagtgacatctcgcagttctttgggggaggaactgctcagttaggacccagacggaaccatggaagccccagcgcagcttctcttccctcctgctactctggcctccagataccnctggagaagtagtgatgacgcagtctccagtccacctgtctgtcgtctaccgaaggggaacacgcccaccctctccgtgcgacgggccagtcagtgtgtggacagctaaacgttcgccgtaggtactcgacgacgaacgtaaaccgtcggaccgtaacggtccctccccggaaggtccttcccgtcgtagtttcggtacgttcggggtacgacctacgttaccgtaacccggaacggggtccctaaccggttgggtacccgtacccgtaacggtccccgtaaggggttacgacggttcggggtacgtaacggggtttcgggtccggtaggggtaacccgtaggtttaacccgttttccgtaccgtttaccgtaaccgtacttacccgtaaacggttccgaaaccgtccgtaacggtcccttggaccgtaccgttagttaggtaaccgttttggttttacgttacggttttacttaccgttcgaagtacgtacctaagttaacgtagttacccgtagggtcccgaccggttaccgggttaggacccggttacgggaaaccggaacgggtaaacccgtaaaggggtaacgtaaacctaggaaaacccgttcgttaggccgacgtacgcgtaaccg

SEQ ID NO: 75645 - DNA, 731 bp, Homo sapiens
  misc_feature: GYAE6OF01DV6HQ.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccaccctctcctgcagggccagtcagagtgttgcagactaactgccgtaggtatcagacaacggaaacctcggccaggcctcccgacggcctcctcagttcgtagtggtcactactccgtaccggaggtcctacggtcggtaccgtcccgagtacccgtaggttcgagtcgggctagggtgggtacgtgggacaggtcttacgtcttctctactcgtacgtctacggccgtacgtccgtgaccgtagttaccgtaaggttaacgtttagtttttcggttaacggtttttaacgttaccggtttagttaacctacgggttaacttaaaggtttaacgttaacgttacggttaacggttccgggtaacccgtttcccgggttaacgggttacccgggtttacccgggaaccggtaaaccggggtaaacccgggtaaaggggttaaaccggtaaaacgttaaacccgggtaaaaccggtaacggttacgggtacgggttaaccgttccggtaaccgttaaacccg

SEQ ID NO: 75646 - DNA, 630 bp, Homo sapiens
  misc_feature: GYAE6OF01EL9W3.17.39.D06.1.454.CMB.1.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (219)..(219): a, c, t, g, unknown or other
  misc_feature (219)..(219): n is a, c, g, or t
  modified_base (366)..(366): a, c, t, g, unknown or other
  misc_feature (366)..(366): n is a, c, g, or t
  modified_base (457)..(457): a, c, t, g, unknown or other
  misc_feature (457)..(457): n is a, c, g, or t
tcagcgtagactagcacgaccggtgctcgatttagtgacatctcgcagttctttgggggaggaactgctcagttaggacccagacggaaccatggaagccccagcgcagcttctccttcctcctgctactctggcctcccagataccactggagaagtagtgatgacgcagtctccagccaccctgtctgtgtcncgaaggggaancgcccacctctcngcgaggccagtcaggtagtgtggcacgactaacgttgcctggtatccgaagcctaagaaaccgtggaccacgggccctacccgacggtcctccgtactaggtgtagtggtcgctactcgtaccgagggcctacggtcggtctcccgngtaccgtagtcgaggtgcgtagggttggtacgtgggaactggtacgtttcctctcgtacatcacgtcacggcgtacgcctagactacggtntaggttaagttgttttcggtacggttttatacgttcgaactagtacggtaattattacgtcgaggttccggtaccgttacggtacggggtccgttaccggacgggtaaacggaccggttaaagggataaaccgaacgtaaacggtcggtgggtacgccggttcgaccgtaacg

SEQ ID NO: 75647 - DNA, 726 bp, Homo sapiens
  misc_feature: GYAE6OF01BLY6C.17.39.D06.1.454.CMB.1.raw
  modified_base (376)..(376): a, c, t, g, unknown or other
  misc_feature (376)..(376): n is a, c, g, or t
  modified_base (501)..(501): a, c, t, g, unknown or other
  misc_feature (501)..(501): n is a, c, g, or t
tcagcgtagactagcacgaccggtgctcgatttagtgacatctcgcagttctttgggggaggaactgctcagttaggacccagacggaaccatggaacgccccagcgcagcttctcttcctctgctactctggcctccagactaccacgtggagaagtagtgatgacgctagtctccacgcctacctgtctgtgtcgtaccggaaggggaacgacgccctacccgtctaccgcggcgaccgggtccacggtcacggtacgttggttcggactaacggtcctaaacgtttcgccgttagtaacgtacgagacgtaaacgaaccgtcggaccgtacggcctcccgaggtcctaccgtacgtagtcggttagtcggtancgtactaccgtacgacggtccaacggttcggtccgtaccgacggtaccgttacggtcgcggttcggacggttagggttcgggtaccgtgggacgttacggtcgttacctcgtactactacgttanacgttaccagtccgacgtccgtagtaaccgtagtaccgtagggtttaactttcggtttacgttaacgtttcttaccgtagtaccgtaagtacgtaagtttactaacgtcgggtaccgtcggtaccgtttacgggtgttaaacccgggtcggaaacggtacgggaagttaagggaattaaccgtaaaggaacggttacggtacggtacgtacctaggtccttacgg

SEQ ID NO: 75648 - DNA, 910 bp, Homo sapiens
  misc_feature: GYAE6OF01EVLO7.17.39.D06.1.454.CMB.1.raw
  modified_base (221)..(221): a, c, t, g, unknown or other
  misc_feature (221)..(221): n is a, c, g, or t
tcagcgtagactagcacgaccggtgctcgatttagtgacatctcgcagtttcgtttgggggaggaactgctcagttaggacccagacggaaccatggaacgccccagcgcagcttctcttcctcctgctactctggcctcccagactaccacgtaggaagaagtagtgactgacgcagtcctccacgccctacctgtctgtgtccgtacggaaggggaacnccgacccacccttctccgtcggacgacgggacctagtaccgaggtacgttggttacggacaacgtaaccgtaaccgttacgacccgttaggtaactaccgaacgtaccgaaacggtaaaccgtcgggacccgacggtccccgtaccgaccggtcctaccgtcgtagttacggtagttcggtataccgtacgtaccgtaccggacgggtacccttacgggttccgggttaccgaccccgtacggtacccggttaagggttcggaaccgggttcgggtaacggttacggggttaccgggggtaacggtaaccgggggaaccgtttaggttaccgtttacccgttcgttacccgtaccgtaacgttaccgtaacgtaccgtaccgtacggaccgttaccgtcgttaaccgtacgtttacgttaacgggtttaacggttttcggttttaaccggtttaacgtttttacgtacccgtaaggttaaccggtacgtaacgttttaaaccgtaaagtttaccggttaccggtaacggggttcccggttacccggtttaccgggggaaccgggttttaccccgggaaaccggtaacgggttaaaacccgggtaaagggttaaaggtaaacccgggtaaaacgttaaacggtaaacccggttacggtacggtaaccgtcgttacccggaaccttaacgg

SEQ ID NO: 75649 - DNA, 724 bp, Homo sapiens
  misc_feature: GYAE6OF01B4974.17.39.D06.1.454.CMB.1.raw
  modified_base (183)..(183): a, c, t, g, unknown or other
  misc_feature (183)..(183): n is a, c, g, or t
  modified_base (214)..(214): a, c, t, g, unknown or other
  misc_feature (214)..(214): n is a, c, g, or t
tcagcgtagactagcacgaccggtgctcgatttagtgacatctcgcagttcttgggggagaactgctcagttaggacccagacggaaccatggaacgccccagcgcagtcttctcttcctctgctactcgtggcctaccagataccacgtggaagaagtagtgatgacgctagtcctccgacnccctacctgtctgtcgtctacggaagggaancgccctaccgtctccgtgcgacggccagtcgaaggtggttggttcggacaacggtaccttaacgttacggtccgttaggtacacgaacgacaacggtaaacccgtcggaccgtacggccctaccggacggtcctccgtactagttacgtcgtggtctactacgtaccgtaaccggaccgggtacccttaacgggttccggtacttacccccggaaggtccccggttaaggttaccgaggttcggacggtacgggttcggtacggtaggacgtaagttcgttctacctgttcacttcatcgactcgtacgtccgagtacgtagttcgaaggtttaccgttttagtttacgggtttacctttagtaccgttagtacgtaggtaacttaagttacgttaacgttcgggaacggttcccgtacggttacgggtccggtaaccggttacggaacccggtaggaggtaacggtaacgaaactaacggaaacgtcgtaggacctacacgtaccgtac

SEQ ID NO: 75650 - DNA, 939 bp, Homo sapiens
  misc_feature: GYAE6OF01BX7XR.17.39.D06.1.454.CMB.1.raw
tcagcgtagactagcacgaccggtgctcgatttagtgacatctcgcagttctttgggggaggaactgctcagttaggacccagacggaaccatggaagccccagcgcagcttctcttcctcctgctactctggctcccagactaccactggagaagtagtgatgacgcagtctccagcccaccctgtctgtcgtcctccgaaggggaaacgacgcccaccctcctcctggaccgacgggtaccaggtaccgaggtagttggttggaccaggtacctaaacgtttacggccgttagggttaaactccgaaggtccgaaacggtaaaacccgtcgggaccccgacgggtaccccgttaccccggacggtcccctcccgttactagttaggttacgttcggggtacgtccgtaaccgttaccctaacccgggtaacggggtacccctaccggtttccgggttcccgtaccccggaacggtaccccggttaggttacccggagggttcgtaacgggtcgggttacggggtcgtacggggtaacgtacggttaacgttcccttcgtactcttacgttaccgacgtaccgacgtacccgtacgttacccgtggaaccgttaacggttactttaaacgggggtaacgttttttacgggtttttacgggtttaacccggttttttaaacgttttacccgggtttcgggtaaccttaaggtaacccggtttaagttaaaacggtttaccgttaccggttacgggtttcccggtaacccggtttacggggtttacccgggttaaccgggttaccccggggaaaacgggttaaccccgggggtaaacgtaaacggggggttaaacggtaaaaaccccgtttaaaccgggaaaaccgggttaaccgggttcgggtaaaccggggttccgtaacccggttacccgggtaaac

SEQ ID NO: 75651 - DNA, 771 bp, Homo sapiens
  misc_feature: GYAE6OF01C246G.17.39.D06.1.454.CMB.1.raw
  modified_base (202)..(202): a, c, t, g, unknown or other
  misc_feature (202)..(202): n is a, c, g, or t
  modified_base (329)..(329): a, c, t, g, unknown or other
  misc_feature (329)..(329): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctccagataccatggagaagtagtgatgacgcagtctccgagccacctgtctgtgtctacgagggaancgcctacctctccagcgacggccagtacagagtgttcggactagactaacttagccgtaggtagtacaagacgaacgtaaaccgtggacccaggcctacccgaggtacctcctacgtacttgtacgnggtcactagtacctaccgacgggacctacgtcggtcctacccgtagtaccgtacggtcgtaaggtcggtacgacgggttcggtacgtaggggaacctaggttacgtttccctattccgtacgtacgtaccgtaagttaccgaagtcccgtacgtccgtacggtacgtaccgttacgttaaagggttaaccgtttacggtttttaagggtttcgttttaaaccgtttaggttacgttaccaacggtttaaaccgtttaagtttaaccggttaaacgttaccgttaaccggggttccgttacccgggtttacccgttacggggtacccggtttaacccgggaaaccgggtaaacccggggtaagttaaaacgggggttaaactaaaccggttaaaccggtaaaaaccggttcgtaacggtcggtaccgaacgtcccggttaacc

SEQ ID NO: 75652 - DNA, 777 bp, Homo sapiens
  misc_feature: GYAE6OF01DOF5G.17.39.D06.1.454.CMB.1.raw
  modified_base (124)..(124): a, c, t, g, unknown or other
  misc_feature (124)..(124): n is a, c, g, or t
  modified_base (347)..(347): a, c, t, g, unknown or other
  misc_feature (347)..(347): n is a, c, g, or t
tcagcgtagactagcacgaccggtgctcgatttagtgacatctcgcagttctttgggggaggaactgctcagttaggacccagacggaaccatggaacgccccagcgcagcttctcttcctctnctactctggctccagactaccactggagaagtagtgatgacgcagtcctccacgccctacctgtctgtcgtcctacgaaggggaacacgccctaccctcctccgtgccgacgggccagtcgaggtacggttggtacggaccagtccctaaacgtttcgcgttaggtactacaacggaccaacggtaaccgtcggaccgacggtcctcccgaggtcctccgtanacggttggtacgtgggtacacctaacgtacccggtaaccggccgggtacctacgttccggtaccgtcccgacggtaccggttaggttacgacgggtcggtaacgtacgggggtacggggttacgtacgggggtaactacggtttacgtttcccgttagttaccttacctacgtacctacgtacgtaccggtactacgtccgttacggaccgttacggttacgttaagggttaacgttttaggtttttacggttacggtttttaacttacggttcgacgtaggtaacttaagttacttacgttcgtacggtcggaccggttaccgggtccggtaaccgggttcggaacccggtaaacgggtaaccggtaaagggtaccgtaaaacgttaccgaaaacggttccggtaggtacgtacggacgtcccgtaacg

SEQ ID NO: 75653 - DNA, 924 bp, Homo sapiens
  misc_feature: GYAE6OF01AF55M.17.39.D06.1.454.CMB.1.raw
  modified_base (203)..(203): a, c, t, g, unknown or other
  misc_feature (203)..(203): n is a, c, g, or t
  modified_base (313)..(313): a, c, t, g, unknown or other
  misc_feature (313)..(313): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccacctgtctgtgtctccgaggggaancgccaccctctcctgcgaggccagtcagtagtgttggcagcaacttagcctggtatcagcaagaacctggccaggtcctccgaggcctccgtacagttcgtagtgggtcnctaacgttccgtaccggacgggcccctacggttcgggtccgttaccccgacggtaccgtaacggtttcgaggttcggggacctaggggttcggggttaccgggtacggggtaaaccgtaggtttaccgggtttccctttacccgttaccgttaacccgttacgttacccggttaacgttaccccgaaaggggttccccgtaaaccgggttccccggttaaccgggtaccgtttaaaccggggttttccgttaagggtttaaaacggttttccgggtttttttttaaccggggtttaacgggttttttttaaactttaccccgggttaacggtttccgtaaaaaccgggtttccggttaaaagttttaaaccgtttaaaccgtttccgggttaaaccggggttttcccgggtaacccccggttttaccgggggtaccggggtttaaaccccggttaacccgggggaaacccggttaaaaccggggttaaacccgggttaaaggggggttaacggtaaaaaaccccgttaaacggttaaaaaaccccggggttcccgggtttaacggggtaacccggggtttacccttaaccggggtaccttaaacccccggg

SEQ ID NO: 75654 - DNA, 800 bp, Homo sapiens
  misc_feature: GYAE6OF01CYJMK.17.39.D06.1.454.CMB.1.raw
  modified_base (512)..(512): a, c, t, g, unknown or other
  misc_feature (512)..(512): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtcctccagccctaccctgtcttggtcgttccgaccgaagggggaaacgaccgccccaccccttcttcccgacggccgacggggacctagtaccgaggtagttggttcgggacaggtacctaaacgttagccgttaggtactcaagaccaacggtaaaccgtcggacctacggtacccgtccccgaacgggtccccttacccttacgagtttaggttacttcgggtacgacctaccgttaccggtaacccggacggggtcccttaacggttccgggttaccgtaccccgaggttacccggtaagggtttacgagggtacggcggttacggggtcgggttacggngggtaacgtacggtttacggtttacctccgttaccgtactacgtaccgttataccgacgtaccgtacctcgtacgacgttcgtaaggttaacgttaagtttacgtttttcggttacgtttttacgttaccgtgtaaccgtagtaacgttaattaacgttagtcggtaacggttccgtaccggttcgggttaacgtaccgggtaccggaccgggtaacgggtaacggtaaacgggtacgtaaaccgtaacgtacggtaacgggtcgacggtaacgtgtaaacccgtacg

SEQ ID NO: 75655 - DNA, 778 bp, Homo sapiens
  misc_feature: GYAE6OF01BXLNX.17.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctccagataccacgtggagaagtagtgatggacgcagtctccagccacctgtctgtcgtctcgaggggaancgccacctntcctgcgaggccagtcagngtgtggcagactaactcgcgtaggtactcagactacgaaaccgtcggaccaggtccctacccgaggtccctaccgtacgtagttggttacgtgggttaacgcctaacgttcccgtaaccggacgggtaccccgtacgttcggggtaccgttaccccgaacggtaccgtagggtttaccgacgggttcgggacgttaacgggttcggggttacgacgggggttaacaacgggttacgttacccttcggtttacctaacgtcgtttaccaagtcccgaacggtacccgacgttaccgtcgaccggtaacgtttacggtaacggttaaagttttacgtttacggttaacgtttacgtttttaacgtttacccgtggttaacccttaaggttacctaaggttttaacgttaacgtagttacggtccccggtaaccgttacgggttcggggaacccgttaccgggaacgtaaaccggggtacggtaaacgggttacgaaaaacgttaacggtaaccgggttaacgcgggttacgtacggtacccgtaaccg

SEQ ID NO: 75656 - DNA, 786 bp, Homo sapiens
  misc_feature: GYAE6OF01B8MER.17.39.D06.1.454.CMB.1.raw
  modified_base (219)..(219): a, c, t, g, unknown or other
  misc_feature (219)..(219): n is a, c, g, or t
  modified_base (286)..(286): a, c, t, g, unknown or other
  misc_feature (286)..(286): n is a, c, g, or t
  modified_base (385)..(385): a, c, t, g, unknown or other
  misc_feature (385)..(385): n is a, c, g, or t
tcagcgtagactagcacgaccggtgctcgatttagtgacatctcgcagttctttgggggaggaactgctcagttaggacccagacggaaccatggaagccccagcgcagcttctctttcctcctgctactctggcctcccagactaccacgtggagaagtagtgatgacgcacgtctccacgcccacccgtgtctgtcggtcctacggaaggggaaacncgccctaccctctccgtgcgaggccagtcagtgttgtgactagctaacgttgccgttagtacacganacgtagaaccgtcggacctacggccctacgacggtcctacctatacgttcgtagtggtacactacgtccgaccggcggtaccacggttcggtccaccgnggtaccggtaaggttcgacggtggccgttaaggggtcggtacggtaagggactaggtttaccttctcggttacctcgtaacttcgaccttacgacgtccgtaacgtccggtctacgtacgtagttaaggttaaagggtttttcctttaacggggtcctttttaagtttaccgttacggtaaaccgtagttaacccggtttaaaaggttcgtaaaaccgggttcggttacggtaccccgggtaacccgttcgggggttacccggttaaaccgggttacccgggaaacggggaaaccggttaaccggggttaaaagtaccccgggttaaaaaacgtaacgggttaaaccgggtaaccgttttcggggaaaccgtttaaacccgccggtttaaataaccccggg

SEQ ID NO: 75657 - DNA, 722 bp, Homo sapiens
  misc_feature: GYAE6OF01CY3S3.17.39.D06.1.454.CMB.1.raw
  modified_base (242)..(242): a, c, t, g, unknown or other
  misc_feature (242)..(242): n is a, c, g, or t
tcagcgtagactagcacgaccggtgctcgatttagtgacatctcgcagttctttggggggaggaactgctcagttaggacccagacggaaccatggaagccccagcgcagcttctcttcctcctgctactctggctcccagataccactggagaagtagtgatgacgcagtctccagcccaccctgtctgtcgtctccgaggggaaacgcgcccaccctctcctgcgagggcccagtcaggngttgtggcagacaacttagcctggtatcagcaagaaccgtggccaggcctcccgaggcctcctgattgtagtggcacactccgaccgagggtcctacggtcggtccgtacccaggtcccgtagggttcaaggttcgggactagggtcggggttaccagggggtaacctaggggttaccttttccgctttcctacgtactacgtaactcgaacgctacgtccgtagtccgtacggttcttaaggttaacggtttacgtttttacgggttacggttttaacttaccttaggttactaaggtaccttaaggtttaactacgttacgttaacgggttccggtacccgtttcgggggtaaccggtaccgggtttacccgggaaaccggtaaacgggggtaacccgtaaacgggggttaaaggaaaacccgtttaacggaaaaacccggttacggtacggttacggaccgtcgtaacccgtaaccg

SEQ ID NO: 75658 - DNA, 798 bp, Homo sapiens
  misc_feature: GYAE6OF01CPBU7.17.39.D06.1.454.CMB.1.raw
  modified_base (280)..(280): a, c, t, g, unknown or other
  misc_feature (280)..(280): n is a, c, g, or t
  modified_base (557)..(557): a, c, t, g, unknown or other
  misc_feature (557)..(557): n is a, c, g, or t
  modified_base (580)..(580): a, c, t, g, unknown or other
  misc_feature (580)..(580): n is a, c, g, or t
  modified_base (590)..(590): a, c, t, g, unknown or other
  misc_feature (590)..(590): n is a, c, g, or t
  modified_base (646)..(646): a, c, t, g, unknown or other
  misc_feature (646)..(646): n is a, c, g, or t
tcagcgtagactagcacgaccggtgctcgatttagtgacatctcgcagttcgtttgggggagaactgctcagttacggacccagacggaaccagtggaacgccccagcgcagtcttctccttcctcctgctactcgtcggcctcccagactaccgagtggaagtaaggttgtggatcggaccgcgtacgttcctaccgacgacccctacccgttggttaccgttcggtcggttacccgtaccgggaaagggggaaactccgccccctaaccttcgtccgnggccggacggtccagtacgaggtagttgtacgacgactacgttaacgttcgtccgtagtaactccgaagaccgaaccgtaaccgtcggaccgtcggccctaccggaggttcctacctagttacgtggttacgcggtaccgctacgttaccgacccggaggtcccctaagttccggtaccaccgagtaccggttagtccgaggttcggacgtacggtcggtacgacggtacttaccggttcttacctcttacgtaccgtaacggtacctgttaaccgnggtaccccgttagtacccgttanacccggtttntaacggtttaacgttagtttacggttttacgttaacgttttcctagtaccggtaanaacggttacctttaagttacacggtttcggtaacggttccgtacccgggttggttaccgtacccgggaaggtaacccggaaggttaacccgggttaaagtaaccgaaaacgtaccagggtttcaacggtaccgccgtaaacgcccgtttagg

SEQ ID NO: 75659 - DNA, 719 bp, Homo sapiens
  misc_feature: GYAE6OF01CBC6P.17.39.D06.1.454.CMB.1.raw
  modified_base (205)..(205): a, c, t, g, unknown or other
  misc_feature (205)..(205): n is a, c, g, or t
  modified_base (283)..(283): a, c, t, g, unknown or other
  misc_feature (283)..(283): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaanacgcccacctctccgtgcgacgggccagtcagagtgtggcagcaagttacgcgtaggtactcgacgacaagaaaccgnggtaccacggtccctaccccgaaggtcccttaccgtacgtagttgtaacgtgggtcgtaccacgttaccgtaaccggtacggacctacggttcggtaccgttacccgacgaccgtaggttaccgaggtacggtacgtacgggtcgggtaccggtagggaaccgtaaggttccgttctacgttacctcgtaactctaacgctagtccgacgaccgttgcgttacgtacgtaaggttaacgtttcgttttaggtaccgttttaacgttagtccgttacgtaacgtaccgtaaatttacgaagttccgtacgggtcccgtaccgtcgggttacggtaccggtaccggtaaccggaacgggtaacggtaaagggttacgaaaaccgtaaacccggtaaacggtacgttacgggtaacggtcctaaggaccccgttaaacg

SEQ ID NO: 75660 - DNA, 720 bp, Homo sapiens
  misc_feature: GYAE6OF01AXRSN.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccatggagaagtagtgatgacgcagtctccagccacctgtctgtgtctaccgaaggggaancgccaccctctcctggcagggccagtcaggtgtgtgcaggctaacgttgccgttggtatcgagaccgaacggtaaacctcggaccgacggtccctaccgaggtcctcctcagtgtagtggtacgctacgtccgtaccgacgggtcctacggttcggtccgtccgaacgtccgtaggttcacgggtcggcgtaagggttcgggtacgtacgggtactacggttacgttcctacgtctactacttaccgagttaccgacggtcctaccggtcctacggtaccgtacgttacgtaggttaacgttttacggttttcggttaacgtttttaactcgttcgtaccgtaagtaacgttaagttaacttacggtacgttacggtaccgggttccgttacgggtacgggttaccggtaaccggtaccgggtaaacgggtaaacccggttaaggggtaaacccggaaacgttaaacccggaaacggttacgggtacgggttacgaccggtaccgtaacgtacccg

SEQ ID NO: 75661 - DNA, 661 bp, Homo sapiens
  misc_feature: GYAE6OF01EALC3.17.39.D06.1.454.CMB.1.raw
  modified_base (320)..(320): a, c, t, g, unknown or other
  misc_feature (320)..(320): n is a, c, g, or t
  modified_base (397)..(397): a, c, t, g, unknown or other
  misc_feature (397)..(397): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctcccagactaccactggagaagtagtgatgacgcagtcctcagcccaccctgtcctgtcgtcctaccggaaggggaaactcgcccctaccctctccgtgacgaggcccagtcaggtagttcggtggacagcaacttgcctggtatcagacagaaccgtggaccaggccctaccgaggtcctcctnacgttgtacgtgcgtcactaccgacgacgggcctacgtcggtcctccgagtccgtagttcgagtcgcgtagggtcgngacgggataggtccttctcgtctgtactcgtaatcgacgacgtacgtccttagacgtcgtagtaaggttaacgtttgtttttaccggtcgttttaacgtacgtgtaacgtacgtactaggttaactacgttacggcggttacccggtccggttaccggtacgtaccggtaccgggaaccggaacgggtaaaggttaacgggtaacggtaaaccgtaaaccgaaacgggttacggtacggtggtaactccggtacccgtaaaccg

SEQ ID NO: 75662 - DNA, 750 bp, Homo sapiens
  misc_feature: GYAE6OF01AMR9T.17.39.D06.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (462)..(462): a, c, t, g, unknown or other
  misc_feature (462)..(462): n is a, c, g, or t
tcagcgtagactagcacgaccggtgctcgatttagtgacatctcgcagttctttgggggagaactgctcagttaggacccagacggaaccatggaacgccccagcgcagcttctcttcctcctgctactctggcctacccagtactacccagtggaagtaaggttgagatcgaacgctacgtcctccacgccctacctgttactggtcgtacctacggaagggaaacnccgccctacccgtctccgnggccgacgggaccagtacgagtgttggtcggcagtactaacgtcgtccgtggtacacgacgtacgaactaccggcgccgacgtcccgcctacgtcctacctcgtagtcggtacgtcgactctaaccgtcgaccgacggtctacggttcgacctccggagtacggtaacgtgacggtggcggtacggtcggttcggaacggtcgtacgttaccttntaccgtacgtacttctaccgactcgaaccgttcccgacgttcgtacggtaacgtacggttacgttaacggttcgtttaacggtttcgggttttaacgttaccgttagttacgtaacgtacggttaattaacggtagttaaaccggttcgttaccgggtcccgtaccgggtttacccggtaccgggttacccggtaaaccggggaacgtaaccggggttaagtaaacggtaaccgtaaaccggtaaaccttacggtacggtacgtacccgtaacggtcgtaaccgtccg

SEQ ID NO: 75663 - DNA, 801 bp, Homo sapiens
  misc_feature: GYAE6OF01E5PIK.17.39.D06.1.454.CMB.1.raw
  modified_base (122)..(122): a, c, t, g, unknown or other
  misc_feature (122)..(122): n is a, c, g, or t
  modified_base (214)..(214): a, c, t, g, unknown or other
  misc_feature (214)..(214): n is a, c, g, or t
  modified_base (337)..(337): a, c, t, g, unknown or other
  misc_feature (337)..(337): n is a, c, g, or t
tcagcgtagactagcacgaccggtgctcgatttagtgacatctcgcagttcgtttgggggaggaactgctcagttaggacccagacggaaccatggaacgccccagcgcagcttctcttccncctgctactctggcctcccagactaccactggagaagtagtgatgacgcagtcctccagcccaccgtgtctgtcgtcctacggaagggaacncgcccaccctctccgtgcgacggccagtcaggtgttgtcggacacgtactaacgttcgccgttaggtactacgacgaccaacggaaccgtcggaccgacggtcctaccgacggtcctaccgtntacgtggtagtcggtcactacttccgaccggacggtcctaggtcggtacctacccgagtccgtaaggttcgaggtcggacggtacgggtcgggtcgtaacgggactcggttaccgttctcgtaccttacacttaccgtacgtcgtaacgctaccggtcctagtaccgtacggttacgtaaggtttaacgttttacgtttaccggtttacgttttaactacgtacggttaaccgtaacgttaacgttaattaaccggttaacgttaccgggtaccggggtttacccggtaccccgggtttacgggttacccggggttacccggtaaaccccggggtaaaccgggtaaaaccggggttaacccgggttaaaaacgggttaaccggtaaaaacccggttaaacccggtaaaccggtacgggtttacccggggtaacgccccgttaaccgaaccccggttttaaaccg

SEQ ID NO: 75664 - DNA, 757 bp, Homo sapiens
  misc_feature: GYAE6OF01CT2NS.17.39.D06.1.454.CMB.1.raw
  modified_base (208)..(208): a, c, t, g, unknown or other
  misc_feature (208)..(208): n is a, c, g, or t
  modified_base (330)..(330): a, c, t, g, unknown or other
  misc_feature (330)..(330): n is a, c, g, or t
tcagcgtagactagcacgaccggtgctcgatttagtgacatctcgcagttctttgggggaggaactgctcagttaggacccagacggaaccatggaagccccagcgcagcttctccttcctcctgctactctggctcccagactaccactggagaagtagtgatgacgcagtcctccagccaccctgtctgtgtctaccgaggggaanacgcccaccctctccgtgcgacgggccagtcgagaggtgttcggacagctaacgttcgtaccgtaggtactacgacgacaaacggaaccgtcggaccgacggtcctacccgaggtcctcctntagttaggtagtcggtcgactaccttaccgtacccggaacgggtccctacggtccggtacctccccgacggtaccggttaacgggtttcgagggtcggtcggtacgggtcggggtaccggtcgggaccggtaggtttcgtttccgtaccttctaacgtaccttacgacgttaccacggtcctaacggcgttaccgacgtttacggtacgtaagttaggtttacgtttttacggtttcgttttaacgtccgttacgtactacgttaaccgttaagttacgttaactcggttaccggtacggttcccgtaccgggttacggttacccgggtacccggaaccgggtaaccggggaaacgttaacgggggtaaccgtaaaacgtaccggtaaaccggtaacggtcggtacgccggttaccacgttaacccg

SEQ ID NO: 75665 - DNA, 757 bp, Homo sapiens
  misc_feature: GYAE6OF01BOZ7A.17.39.D06.1.454.CMB.1.raw
  modified_base (207)..(207): a, c, t, g, unknown or other
  misc_feature (207)..(207): n is a, c, g, or t
tcagcgtagactagcacgaccggtgctcgatttagtgacatctcgcagtttctttgggggaggaactgctcagttaggacccagacggaaccatggaagccccagcgcagcttctcttcctcctgctactctggctcccagataccactggagaagtagtgatgacgcagtctccagcccaccctgtctgtgtctccgaggggaaancgccaccctctcctgccgagggccagtcagagtgtggcagctaacttagccgtggtatcgagcaacgaaccgtggccaggcctaccccgaggtcctccgtacagttcggtagtggtcgctactaccgtaccggacggggtccctacgttcgggttaccgtacccccgaacggtcccgtaacgggtttcgtacgggttcgggtaccgtaaggggttcggggttccggtagggggtaactaacggttacggttttcccgttcgttaccgtttactaacgttaccgtaaacttccgaacgtacccgtaacggtcccgttaggtccgtaacggtttcggttaaaggtaaagtttttacgtttttcgggttaacggttttttactaccggtttagtacctaggtacttaagttaacttaacgttccgtaaggttccggtcccgttaccgggtacgggtaccggttacccgggaacggtaaccgggtaaccgtaaggggttaaccgaaaacgtaccggaaaacgtcgtacgggtacgtcgtaccgaccgtaacccg

SEQ ID NO: 75666 - DNA, 766 bp, Homo sapiens
  misc_feature: GYAE6OF01CLOR2.17.39.D06.1.454.CMB.1.raw
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccgaggggaaangccaccctctcctgcagggccagtcagagtgttggcagcaacttgcctggtatcagcaagaaacctggccaggcctccaggcctcctcatgtatggtgctatccgtaaccgaggggccctacgttcgggtcgtccccgaaggtcccctaaggggtttccaaggttcgggcctaaggggttcggggtccgttagggggaaccctaaggtacggttttcctccttccttaccaattccgaacttcccgaaaggcccaacggtcccctaggaccgttaacggtaccgttaggtaaaaggtttcgtttttttacggggacccgggttttttttaattaacccgttttggtaacccgttaacggttacccggtaaaggttttaacttaaaaccgtttcggtaacggggttccgggtacccccgtttccggggttacggggttaacccccggttttaccggggaaccccggtaaaaccggggggaacccgttaaagggggttaaccggaaaacgttaaccccgaaaacggttaaccgtgggtaaccggcgttacgcccgtaaacccg

SEQ ID NO: 75667 - DNA, 654 bp, Homo sapiens
  misc_feature: GYAE6OF01B093V.17.39.D06.1.454.CMB.1.raw
  modified_base (172)..(172): a, c, t, g, unknown or other
  misc_feature (172)..(172): n is a, c, g, or t
  modified_base (205)..(205): a, c, t, g, unknown or other
  misc_feature (205)..(205): n is a, c, g, or t
tcagcgtagactagcacgaccggtgctcgatttagtgacatctcgcagttctttgggggaggaactgctcagttaggacccagacggaaccatggaagcccagcgcagcttctcttcctcctgctactctggcctccagataccacgtggagaagtagtgatgacgcagtcnccagcccacctgtctgtgtctaccgagggaaancgccacctctccgtgcgaggccagtcgaagtagtgtcggcacgactaactagcgtggtactcacgacgaacgaaaccgtcggaccgtacggtcccgtacccgtacggtccttccgtacgtagttcgttacgttcggtcgtacgtactaccgtaccggacggtccgtacgttcggtcccgtaccgacggtccgtacgggtcgtaggtcggacggtagggtcggtacggtacggacgtagtcgtttacgtcgttctactcgtacacgtacgacgtctacgtacgtgtacgtatcgtagttaagttacgtttagttacgtttacgtacgtcgtacgtacgtacgtagttacgttactcgtgtaccggtcgttacggtacggtaccggtacggacgaacgggtaagaacggtaacgaacgtaacgaacgtacgtacgtagggctaggcctacg

SEQ ID NO: 75668 - DNA, 884 bp, Homo sapiens
  misc_feature: GYAE6OF01AMOZO.17.39.D06.1.454.CMB.1.raw
  modified_base (147)..(147): a, c, t, g, unknown or other
  misc_feature (147)..(147): n is a, c, g, or t
tcagcgtagactagcacgaccggtgctcgatttagtgacatctcgcagttctttgggggaggaactgctcagttaggacccagacggaaccatggaacgccccagcgcagcttctcttcctcctgctactctggctccagactaccntggagaagtgtgatgacgtcagttcctcagcccacccgtgtcgttgtcgtaccgtaccggaagggggaaacaccggtcccctaaccccgttcgtcccgttaggacccggtaacggggtcccaaggttaccgaagggttaacggtttcgggtttacgggaaccgtaacggtacccgttaaaaccgtttacgggtcccgtaaggggttaaccttaccggaaaccgggtaaccggtaaaaccggtaaaaccccgttcggggaacccccggtaggggttaccccctaacccccggtaggttcccccttaccgttacgtacgtacggtttaggtccgggtactacctaccggttaccgaaccggtcgggtcccctacggtttccgggaccgttccccggaacggttccgtaacggttcggtaacggtcgggtaccggtgggttcgggtacgggtaccgggaacgttacggtactttccgtaccgtacgtacgttatccgtaagcctacggactcgtccaggtactcgttaggtagtacggttttacgttaggtttacgtttaatccgttagtacctaggttactaagttcgttaaacggtcgttaccggtaccgggttcgttcccgggaaggttacccgggtaccggaaaccgggtaaggggtaaccgttaacgggtaaacggttaaacccaacgggtaacgttacgggttacggtacccggaactttcggaacccgttacg

SEQ ID NO: 75669 - DNA, 710 bp, Homo sapiens
  misc_feature: GYAE6OF01D18VR.17.39.D06.1.454.CMB.1.raw
  modified_base (130)..(130): a, c, t, g, unknown or other
  misc_feature (130)..(130): n is a, c, g, or t
  modified_base (213)..(213): a, c, t, g, unknown or other
  misc_feature (213)..(213): n is a, c, g, or t
  modified_base (701)..(701): a, c, t, g, unknown or other
  misc_feature (701)..(701): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactntggctcccagataccactggagaagtagtgatgacgcagtctccagcccaccctggtctgtcgtcctaccgaagggggaaacncgccccacccgtcttcccgtgcgagggccaaggtcaaggtgtcggtggcagcctaacttacgccttggtactcgagactaacgaaaccgtggaccgacggtccctcccgacggtccctacctactaacgtttggacgttgggtcactacttccgtaccgaacgggcctaacgtcgggttaccgacccgacggtcgtaacggtttcacgggttcgacggttggtcgggtcgttacggggactaggtacgtttcccttacgcgttacctacgttacctacgcccgttaacgggaccctacgtccgtaacggtcccgtaaggttccgttaacggttagtttaccgtttttgggttacccggtttttattacgttggttaaccgacgtactaagtttaaccaacgttgtacgggtcgtaccggttcggtacgggtacccgtcgggaacgacgggtacgaagggtgaaacgtcgaaacgtcgtacgtagtcgngccgtaacg

SEQ ID NO: 75670 - DNA, 735 bp, Homo sapiens
  misc_feature: GYAE6OF01A2VOG.17.39.D06.1.454.CMB.1.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
  modified_base (446)..(446): a, c, t, g, unknown or other
  misc_feature (446)..(446): n is a, c, g, or t
tcagcgtagactagcacgaccggtgctcgatttagtgacatctcgcagtttctttggggggaggaactgctcagttacggacccagacggaaccatggaacgccccagcgcagcttctcttcctcctgctactctggctcccagactaccacgtggagtaagtagtgatggaccgctacgtcctacccagcccctaccgttgttctgtcgtcctacggaaggggaaacncgccctaccctcgtccgtgcgcgggacctagtcgaggtgtgtacggctagactacgtgccgttaggtacncgagacgaacgtaacccgtcggaccgcggtccctacccgacgtccctacctatagttacgtagttcggtcacaccgttccgtaacccggcgggtaccctaccggttacggtcccgaccgtacgtcccggtagtacgtacgggtcggnggttagggttcgggtaacgtgggtaacgtacgttacgttcccgttacctctacgcttaaccgcgttaccaggttacccgtacgtcgtacgtacgtaacggtttgtaaggtttaacgttagtttttaacgggtattacgttcgatacgtaagtcttaaggtactacggttacttagggcccgtacgtccggtagggacccgtaaggtaccgggtaacgtaaccggggtaagttaaccgaaaaccggtaagtaaccgggtagttacggtacccgtatacccggccgttaag

SEQ ID NO: 75671 - DNA, 749 bp, Homo sapiens
  misc_feature: GYAE6OF01EIHRN.17.39.D06.1.454.CMB.1.raw
tcagcgtagactagcacgaccggtgctcgatttagtgacatctcgcagttcgtttgggggaggaactgctcagttaggacccagacggaaccatggaagccccagcgcagcttctcttcctctgctactctggctcccagataccactggagaagtagtgatgacgcagtcctccagccacctgtctgtcgtactccgaaggggaacacgcccaccctctccgtgaccgacgggccagtccgaaggtaggttgtcgggacacgtactaacgtttcgccgttaggtactcgaacgaccgaacggaacctcgggaccgtacggccctacccggaggtccttaccgtacgagttcggttaacggttcgggtactacctaacttacccggtaaacccgggaccgggtaccccttaacgggttccggggttacccgtttaacccccggagggtaccccggtttaacggggtttacgaacggggtttcgggaaccgtttaagggggtttcgggtaccgggtacggggaacttaggttaccgtttcctacgtttaccgtactacgttccaacgtcgacgcgtacgtcctgacctcggtacgtaagtacgtttgttcggtttacgtttactcgtagttacgacgtacgttacgtaattacgtacgtacgtcgtaccgtacgggtcgtaccggtcgaaccgggtacggaagtaacggtaacgaacgtaccgaaacggtcgtacgagtactcgacgtac

SEQ ID NO: 75672 - DNA, 729 bp, Homo sapiens
  misc_feature: GYAE6OF01B4RDH.17.39.D06.1.454.CMB.1.raw
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
tcagcgtagactagcacgaccggtgctcgatttagtgacatctcgcagtttcgtttgggggaggaactgctcagttaggacccagacggaaccatggaagccccagcgcagcttctcttcctcctgctactctggcctccagactaccacgtggagaagtagtgagtgacgcagtcctccgacgcccacccgtgtctgtcgtccgtacggaagggaagccgcccacccgtctccgtgcgacggccngtcagtgtgtgacagactaacgtcgcgtaggtanccgtagacgaacggtaaccgtcggaccgacggtacccctccggacgtcctccgtactagtcgtacgtggacctactaccgtaccgtaaccggacggtcccgtaggttccggtccacccgacggtaccgttaggttaggacggcggtacggtacggggtttcggacgttacgggacttacggttacgttccgtccgtacgttacgaagtcgtaacgtcgaacgcgtacgtccgagtaccgttaaggtccttaaagggttaactttcgtttttagggccgttttaattaccgaggttacaaccggttaattaacgttagaaccggttcggtaacctccgggtaacccgttgggtaaccgggttacccgtaggaaaacccgggtaggaaaccggttaagggaaacttaaccggaaacgtaacggttcgaggttaccgacctagaccgtaacg

SEQ ID NO: 75673 - DNA, 800 bp, Homo sapiens
  misc_feature: GYAE6OF01E2EIG.17.39.D06.1.454.CMB.1.raw
  modified_base (222)..(222): a, c, t, g, unknown or other
  misc_feature (222)..(222): n is a, c, g, or t
  modified_base (348)..(348): a, c, t, g, unknown or other
  misc_feature (348)..(348): n is a, c, g, or t
  modified_base (628)..(628): a, c, t, g, unknown or other
  misc_feature (628)..(628): n is a, c, g, or t
  modified_base (680)..(680): a, c, t, g, unknown or other
  misc_feature (680)..(680): n is a, c, g, or t
  modified_base (779)..(779): a, c, t, g, unknown or other
  misc_feature (779)..(779): n is a, c, g, or t
tcagcgtagactagcacgaccggtgctcgatttagtgacatctcgcagttctttggggaggaactgctcagttaggacccagacggaaccagtggaagccccagcgctagcttctcttcctcctgctactctggctcccagactaccactggagtaagtcgtgatgacgcagtcctcaagtcccaccgttgttcctgtcgtacctaccggaaggggtaaacncgcccaacccgtctcctagccagggccagtctaggagttgtcggctacggtactaacgttaggcccttaggtactcgagcgaaacgtaacctcggactaacgggcctaccccaaggcctaccggtnaagttcgtatcgggtatacgtaactctaaccggacggtaccttacgtcggtaccgaccgtaagtacccggttagtacccgtagggtaccggtacgtaacggggtttcggtacccgggagggtaacgtaaccggttacgttccttaacccggttagttacccgtaactttaccggaaattcccggaacgtacccggttaccgaaccgtttgaacccgttagggttaacccttaagggtaacgtttacccggtttttgggtaaccgttttttacgtaaccgnggtttaccaagggttaacctaagtttaaccgttacgttaaacgcggggtttnaacccccggttgggacgttttaccgggaccgtaaacggggtaaccgacgggttaacggtaaggtaaaccctaaacggaaaccgttacggacggggttanacggtccgttaaacgacccgg

SEQ ID NO: 75674 - DNA, 742 bp, Homo sapiens
  misc_feature: GYAE6OF01AV4XL.17.39.D06.1.454.CMB.1.raw
tcagcgtagactagcacgaccggtgctcgatttagtgacatctcgcagtttctttgggggaggaactgctcagttaggacccagacggaaccatggaagccccagcgcagcttctccttcctcctgctactcgtggcctcccagactacccagtggaagaaggtagtgatgacgcagtctccagcccaccctgtctgtcgtctaccgaaggggaaagccgcccaccctctccctggccgacggggccagtaccgaggaggttgtcgggcagacctaacgttcgcctggtactcaggacaacgaacccgtggacccgacggtccctaccccgaggtcccttaccctcaagtgttaacgtcgggtctaccgtaacgttcccgtaacccggacggggcccctaacggttcggtcctaccccgtaaggcccgttaaggttcgaggttcggacggtagggttcgggtacgagggaactacggttaccgttctaccgtcctacgtactcgacgtacgacgtactccggtcgtaccgaggttaccgtttcgtaaggttaagttttacggtttttacggttaccgttttagttaaccgttgtaccgtaaggctttaaagttactaacgttcggtaccggtccgtccggttccggtacgggtacccgttacggaaccggggtaacgtacccgggaaaggttcgaaaaccggtaccgaaacgttacggtcgggtacgccgtagcccgttacg

SEQ ID NO: 75675 - DNA, 778 bp, Homo sapiens
  misc_feature: GYAE6OF01DDUF9.17.39.D06.1.454.CMB.1.raw
  modified_base (589)..(589): a, c, t, g, unknown or other
  misc_feature (589)..(589): n is a, c, g, or t
tcagcgtagactagcacgaccggtgctcgatttagtgacatctcgcagttcgtttgggggagaactgctcagttacggacccagacggaaccagtggaacgccccagcgcagtcttctccttcctcctgcctactctggcctccaagactaccacgtggaagtaagtagtgatcggacgctacgtcctaccgacgcctacccgtgttctgtcgtccgtaaccggaaggggaaacgccgcccctaccctcctacccgtcggaccggtacgggcctaaggtcgtaaggtacggttggtccggactaacgtacgttaaaccgttacggtaccgttaggtaacctacggaaccgtaaccggtaaaaccggtaaacccggtcgggaacccccggtacggttacccccgttccccggtaaccggttccctttacccgtacgttaggtttacggttacggtcggtacctacgtaaccgttacccggtaacccggtacgggtcccctacgggtaccgtaccgaccgtacgtacggttaacggtacggcggtgtcggtacgggtcggtcgtacggtacgtgttacctttacgcccttnaaccgtactctaacagactccgcgtaccgagtcgtagttacgtacgttagtttgtttaccgttagttctagtcaactaggtataacgtatgttacggcgtccgtcgggtactaggtaccggtacgaaccgtaagggtaacccgaaggtaaacaaaccgtacgaacgtcggtagtctaacgcgtccgtac

SEQ ID NO: 75676 - DNA, 746 bp, Homo sapiens
  misc_feature: GYAE6OF01CSEBE.17.39.D06.1.454.CMB.1.raw
  modified_base (217)..(217): a, c, t, g, unknown or other
  misc_feature (217)..(217): n is a, c, g, or t
  modified_base (394)..(394): a, c, t, g, unknown or other
  misc_feature (394)..(394): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctcccagactaccactggaagaacgtagtcgatgaaccgcagtctccagcccacctgtctgtcgtcctaccgaaggggaaacncgcccaccctctccgtgcgacgggccagtcagtgttggtcggcagtaccaattacgccgtaggttactcgaacgtcgaaacgtaaccgtggacccaggtccctaccggcggtaccctccgtatagtacgttgttacggcactacgtccgaacggacgggccctacggtcgggtaccnccccgtagaccgtaggttccgaaggttcggacgtgggtcgggtttacgcggggtaactaggtcgtttcccattaccgtactaacgttctaacggtcgacgtaccgtcggtacctggtaaccttacgttacgtaaggtttaaacgtttgtttttccgggtaacgtttttaccgtaacgtttcgggaaacctcggttaacgtaacgtttaaacgttacgtcgtaaccgggttccggttaacccgtaacggggttcggtaccggttaacccggaacggtaaacgggtaacggtaaacggttaacgaaaccggttacaaacggttacggtacgccggtactccggcccttaaacgg

SEQ ID NO: 75677 - DNA, 833 bp, Homo sapiens
  misc_feature: GYAE6OF01EF4R6.17.39.D06.1.454.CMB.1.raw
  modified_base (210)..(210): a, c, t, g, unknown or other
  misc_feature (210)..(210): n is a, c, g, or t
tcagcgtagactagcacgaccggtgctcgatttagtgacatctcgcagttctttgggggaggactgctcagttaggacccagacggaaccatggaacgcccagcgcagcttctcttcctctgctactctggcctccagataccactggagaagtagtgatgacgcagtctcacgcccacctgtctcgtcgtcctacgaaggggaaacgcnccctacccttcctaccgtgaccgagggacccagtaccgaaggtcggttcggttacgggacgacgtacgaacgtttacgccttaggtacttcgagacgtaacgaaaccgtcggaccgacggtccacccggtcgtaccgtcctactacgtcgtaggttcggtctaccgacctttaccgaaccggacggtccgaacggtttcgggacccgtccgacggtccgtacgggttacgagggtcgggtacgttacgggtgggttacggtacggggtaactacggttacgttccttactacgtaaccgtacgtaacctacgttaccggaacgttccgtaaacgggtccttacggtaccggttacgttaccgttaaggttaacggtttttagggttttaaccgttttaacgggttttaacccgtttaagttacgggtaccgttaaaggtaccgttaaacgggtttaaaccgttacggttacgtaccgggggttccgttaaccgttacccgggggttacggttaccgtacccgggggttaaacccggtaaacggggttaacgggttaaacgggtaaacgtaacggttaaacggaaacgttacgggtacgggtaccggtctcccgtacgtaaccg

SEQ ID NO: 75678 - DNA, 799 bp, Homo sapiens
  misc_feature: GYAE6OF01AGNWJ.17.39.D06.1.454.CMB.1.raw
  modified_base (750)..(750): a, c, t, g, unknown or other
  misc_feature (750)..(750): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctccagactaccacgtggagaagtagtgatgacgctagtctccacgcccacccgtgtctgtacgtctacggaaggggaacacgcccaccctcctccgtaggcgacgggaccagtcgaggagttggttcggacacggtactaacgttacgcgtaggtactacaggacgtaacggtaaccgtcggaccgaaccggtcctacccggtacggtcctccgtacgtaatacggttacgttcgggtacacgtacttaccgaaccggacgggtacctaggtcggtaccggtaccctacgtaccgtacggtttacgacggttacggacgttacgggtcgggttaccgtagggtaacgtaccggttaagtttcctaccgttaccgttaccagttaacccgacgtaagtccgtaaaccgtccggtaccgttacggacgttaccgtttacgtaggttaaacgtttcggttttacggttttaacgtttaactttacgggacgttacctaaggttaccgttaagtttaaccacggttaccgggtacgtttacccggtaccgggttacggttaccccggttaacgggaacgggtacccggtaaaagtaccggggtaaaggtacccgtaaaanaaccggttaaagggacccttgggtaaacccgcgtttaaacggcgttaac

SEQ ID NO: 75679 - DNA, 843 bp, Homo sapiens
  misc_feature: GYAE6OF01BMUCU.17.39.D06.1.454.CMB.1.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (294)..(294): a, c, t, g, unknown or other
  misc_feature (294)..(294): n is a, c, g, or t
tcagcgtagactagcacgaccggtgctcgatttagtgacatctcgcagttctttgggggagaactgctcagttacggaccagacggaaccagtggaacgcccagccgcagcttctcttcctccgtgctactctggcctccagactaccacgtggagaagtacgtgagtcgacgtcagtcctaccacgcctaccgtgtctgtcgtcctacggaaggggaaacncgacccaccttcctcgngacgacggacctagtcaggtgttgtcggacacgtactaacgtcgtcgtaggtacncgacgacgtaacggaaaccgtcggaccgacggtccaccgtcggtacctaccgtacctagttacgtaggttcggtactacctaacgttaccgtaaccggtaacggggtaccctcgggttaccgggtaccgtacccgtacggtaccggtacggtttacgacggtcgggacgttacgggtcgggtacggtacgggacgtaacggtttccgttctaccgttacgtaactcgttaacgtacgttaccgacggactaaccgtccgtacgggtacgttacggtttaaccgtaggtttaacggttttacggttttacggttaacgttttttacgttacgttaacggttaaccggtaacgttaacgttaacggtttaacctaaccggttacgggtccgggtttaaccggttaccggtcgggggttaaccgttaccgggggtttaaacccgaacccggggttaaaggtaaaccggggttaaaaccggtaaagttaaaacggtaacccggttaaacggggttaaaccgttcgggaaggtaaccctcgtaaacccgtacgg

SEQ ID NO: 75680 - DNA, 791 bp, Homo sapiens
  misc_feature: GYAE6OF01AV31Q.17.39.D06.1.454.CMB.1.raw
  modified_base (215)..(215): a, c, t, g, unknown or other
  misc_feature (215)..(215): n is a, c, g, or t
  modified_base (283)..(283): a, c, t, g, unknown or other
  misc_feature (283)..(283): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggcctccagactaccactggagaagtagtgatgacgcagtcctccacgccacccgtgtcgtgtcgtaccgtccgaaggggaaanacgcccacccgtcctcgtgacgacggccagtcagtacgtgtgcgacgactaacgttacgcgtaggtanacagaccgaacgaaccgtcggaccaggtcctccgacgcctcctgtacgttggtacgtcggtagtaccacggttacctaccgggacggtacccctagtcgggttacccgtccgaacggtcccggtaagttccgaaggtggtaccggtagggttccggtccggtaaggggtactagggttacgtttccttacgtaccgtacgttacgtaccgtaacgtacccggacgtacccggtaccggttaccgtacggtaacgttaaccgggttcgttaaacgggttaacggtttaacgggtttttaacgggtttaaccggtttttaagttaacccgtttaggttaaccttaacgggtaaccgtttaaccgttaaaggttaaccgttacggtacggttaccccggttaccggttacccgggttacgggtacccgggttaaccggaaccggtaacgggtaacggtaacgggtaacgtaaaccgtacgaaacgtcggacggtacgtacgcgtacgtacg

SEQ ID NO: 75681 - DNA, 495 bp, Homo sapiens
  misc_feature: GYAE6OF02IK037.17.39.D06.1.454.CMB.1.raw
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagcccaggttcagtggcagtgggtctggggacaggagttctctctcatcatcagcagcctgcagtctgaagtattttgcggttttattactgtcagctagtataatcagtggcctcgtggacgttcggccgaagggaccaagggtgaatcgaacgactgtggctgcac

SEQ ID NO: 75682 - DNA, 494 bp, Homo sapiens
  misc_feature: GYAE6OF02F9PUG.17.39.D06.1.454.CMB.1.raw
  modified_base (204)..(204): a, c, t, g, unknown or other
  misc_feature (204)..(204): n is a, c, g, or t
  modified_base (400)..(400): a, c, t, g, unknown or other
  misc_feature (400)..(400): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaaacctggccaggctcccaggctcctcatgtatggtgcatctaccagggccactggtgtcccagcccaggttcagtggcaggtgggtctggggacaggagttctctctcatcatcagcagcctgcagtctgaagtnttttgcgtttatactgtcagcagtataatcagtggctcgtggacgttcggccgaagggaccaagggtgaactcgaaacgactgtggctgcaccg

SEQ ID NO: 75683 - DNA, 509 bp, Homo sapiens
  misc_feature: GYAE6OF02H9ENH.17.39.D06.1.454.CMB.1.raw
  modified_base (301)..(301): a, c, t, g, unknown or other
  misc_feature (301)..(301): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaacctggccaggctcccagcctcctcatgtatggtncatctaccagggccagtggtcgtcccagcccaggttcagtggcaggtgggtctgggacagagttctctctcatcatcagcagcctgctagtctgaagtattttgcgtttatactgtcagtcagtatatcagtcgcctcgtggacgttcggaccgaagggaccaagggtcgaaactacgaaacgtacgtggtacggctacggctaaccg

SEQ ID NO: 75684 - DNA, 647 bp, Homo sapiens
  misc_feature: GYAE6OF02GYEZW.17.39.D06.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (225)..(225): a, c, t, g, unknown or other
  misc_feature (225)..(225): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
tcagcgtagactagcacgaccggtgctcgatttagtgacatctcgcagttcttggggagaactgctcagttaggacccagacggaaccatggaagccccagcgcagcttctcttcctcctgctactctggctcccagataccactggagaagtagtgatgacgcagtctccagccacctgtctgtgtctccaggggaangccacctntcctgcaggccagtcagngtgtgcagcaacttgcctggtatcagcagaacctggccaggcctcccgaggcctccgtnacgttgtagtcgggtcnctagtcctaaccgagggtcctaacgtggtctacccgagtccgtaggttcaggtcggctaggttcgggtctaggggacctaggtacgtttcctacgtcgtacgtacgtcgagttacgacgtctacgtccgttacgaccgtacggttcgtacggtaacgttcgttttacggtacggttttataccgttcgttaccgtaggtcctaagttactaacgttcgtacggttcggtacccgttacggttacggtaccgttccgggtaaccgtaacggggttacctaaagggttacggtaaaccgttccggtaaaccgtcgttacggtacggtacgttacggacccgtaaccgg

SEQ ID NO: 75685 - DNA, 541 bp, Homo sapiens
  misc_feature: GYAE6OF02JIHQC.17.39.D06.1.454.CMB.1.raw
  modified_base (203)..(203): a, c, t, g, unknown or other
  misc_feature (203)..(203): n is a, c, g, or t
  modified_base (412)..(412): a, c, t, g, unknown or other
  misc_feature (412)..(412): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaanagccaccctctcctgcagggccagtcagagtgttggcagcaacttagcctggtatcagcaagaacctggccaggctcccaggctcctcatgtatggtgcatcctacgagggccacgtggtcgtcccagcccgaggttcaggtggcgaggtcgggtctggggacaggtacgttctctctcactcatcagcagcctgctagtctagtaatntttgacgtttatacgtgtcagctagtatatcgtagtcgtccgttcgtggtacgttccggaccgtaacgggacgtaagggttaggaaactaccgaaacggtaccgtaggtacggtacgtacgacctaacg

SEQ ID NO: 75686 - DNA, 524 bp, Homo sapiens
  misc_feature: GYAE6OF02IUMLV.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaaacctggccaggctcccaggctcctcatgtatggtgcatctaccagggccacgtggtcgtcccagccaggttcagtggcaggtggtctgggacaggtgttctctctcatcatcagcagcctgctagtctagaagttgtttgtacgttttatacgtgtcagctaagttatatcagtcgccgttcgtggtacgttcggaccgaacgggaccgtaaggtagaaacgtacgtaaacgtacgtggtacggcgtacgactaaccg

SEQ ID NO: 75687 - DNA, 505 bp, Homo sapiens
  misc_feature: GYAE6OF02ID6SV.17.39.D06.1.454.CMB.1.raw
  modified_base (204)..(204): a, c, t, g, unknown or other
  misc_feature (204)..(204): n is a, c, g, or t
  modified_base (322)..(322): a, c, t, g, unknown or other
  misc_feature (322)..(322): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccacctctcctgcagggccagtcagagtgttggcagcaacttagcctggtatcagcagaaacctggccaggctcccaggctcctcatgtatggtgcatctaccagggccactggtntcccagccaggttcagtggcaggtggtctgggacagagttctctctcatcatcagcagcctgccagtcctagaagtattttgcggttttatactgtcagcagtataatcagtcggtcctccgtggtacgttcggaccgaagggacctaagggtaggaatacgaaacgactggtgcgtgctacg

SEQ ID NO: 75688 - DNA, 527 bp, Homo sapiens
  misc_feature: GYAE6OF02I7XC1.17.39.D06.1.454.CMB.1.raw
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaacctggccaggctcccaggctcctcatgtatggtgcatctaccgagggccacgtggtcgtccccagcccagggttccaggtggcaggtgggtctggggacaggtagtttctctctcatcatcagcagcctgcagtctagtagtattttgacggttttatacgtgtcagtctagttataatcagtcgcctcggtgacgttcggacgtaacgggaaccaagggtacgaaactacgaaacggtcgtaggtcggctcgactaccg

SEQ ID NO: 75689 - DNA, 489 bp, Homo sapiens
  misc_feature: GYAE6OF02GGTOB.17.39.D06.1.454.CMB.1.raw
  modified_base (204)..(204): a, c, t, g, unknown or other
  misc_feature (204)..(204): n is a, c, g, or t
  modified_base (399)..(399): a, c, t, g, unknown or other
  misc_feature (399)..(399): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaaacctggccaggctcccaggctcctcatgtatggtgcatctaccagggccactggtgtcccagccaggttcagtggcaggtgggtctgggacaggagttctctctcatcatcagcagcctgcagtctgaagtnttttgcgtttatactgtcagcagtatatcagtgcctcgtgacgttcggaccgaagggaccaaggtgaatcgaaacgactgtaggctgcac

SEQ ID NO: 75690 - DNA, 950 bp, Homo sapiens
  misc_feature: GYAE6OF02GZHF1.17.39.D06.1.454.CMB.1.raw
  modified_base (170)..(170): a, c, t, g, unknown or other
  misc_feature (170)..(170): n is a, c, g, or t
  modified_base (208)..(208): a, c, t, g, unknown or other
  misc_feature (208)..(208): n is a, c, g, or t
tcagcgtagactagcacgaccggtgctcgatttagtgacatctcggcagttctttggggaggaactgctcagttaggacccagacggaaccatgggaacgccccagcgcagcgttctcttcctcctgctactctggctcccagataccactggagaagtagtgatgacgnagtctccagccaccctgtctgtgtctccgaggggaaangccaccctctcctgcagggccagtcagagtgttggcagcaacgttagcctggtatcgagcaagaaaccgtggcccaagggccttaccccgaggtccttaccccgtcaagttggttaagtcggggttcacctaagtttcccgtaaacccggacgggggtaccccctaacggtttacgggttccggttacccccgaagggtccccgtaaggggttttccgaaggggtttcggggtacccgtaaggggtttcggggggttaccttacgggggggtaacccttaacggggttaacgggtttttcccttacccgttaccgtttacccggtaacgtttcccaaacgtttcccgaaacggtcccgtaaaccgggtccccgttagggtacccgttaacgggtttccgttaaacgggttaaacggttttaaacgtttttttttccgggtacccggggttttttttttaaacttaacccggtttttgggttaacccgttaaacgggttacccgtttaaagggttttaaaccttttaaacgtttcccgggttaacggggtttacccgggttacccccgttttacgggggttaccgggtttaacccggggtttaccggggaacccggttaaaaccggggggtaaaccccggtttaaagggggtaacccgggttaaaacgttaacccggtaaaacccgggttaacggtttaccggggtacccgggttaccgttaaccgggtacccttaaccccgg

SEQ ID NO: 75691 - DNA, 523 bp, Homo sapiens
  misc_feature: GYAE6OF02G1U59.17.39.D06.1.454.CMB.1.raw
  modified_base (204)..(204): a, c, t, g, unknown or other
  misc_feature (204)..(204): n is a, c, g, or t
  modified_base (213)..(213): a, c, t, g, unknown or other
  misc_feature (213)..(213): n is a, c, g, or t
  modified_base (324)..(324): a, c, t, g, unknown or other
  misc_feature (324)..(324): n is a, c, g, or t
  modified_base (402)..(402): a, c, t, g, unknown or other
  misc_feature (402)..(402): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctntcctgcagggccagtcagagtgttggcagcaacttagcctggtatcagcagaaacctggccaggctcccaggctcctcatgtatggtgcatctaccgagggccacgtggtntcccagccaggttcagtggcaggtgggtctggggacaggagttctctctcatcatcagcagcctgcagtctagaagtnttttgcggttttattacgtgtcagtctagttataatctagtcgtcctcggtggtacgttcggaccgtaagggaccaagggtcgaaatccgaaacggtactggtaggacttggacctaaccg

SEQ ID NO: 75692 - DNA, 518 bp, Homo sapiens
  misc_feature: GYAE6OF02IZLH7.17.39.D06.1.454.CMB.1.raw
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaacctggccaggctcccaggcctcctcatgtatggtgcatctacccgagggccatggtctcccagccaggttcaggtggcaggtgggtctggggacaggtagttctctctcatcatcagcagcctgccagtctagaagttgttttgacgttttatacgtgtcagctagtatatctagtcgcctcggtgtacgttcggaccgaagggtaccaagggtaggaactacgaaacgacgtggtacggctagacctacg

SEQ ID NO: 75693 - DNA, 523 bp, Homo sapiens
  misc_feature: GYAE6OF02GCKNP.17.39.D06.1.454.CMB.1.raw
  modified_base (402)..(402): a, c, t, g, unknown or other
  misc_feature (402)..(402): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagcccaccctctcctgcagggccagtcagagtgttggcagcaacttagcctggtatcagcagaaacctggccaggctcccaggctcctcatgtatggtgcatctaccgagggccagtggtctcccagccaggttcagtggcaggtgggtctggggacagagttctctctcatcatcagcagcctgcagtctagaagtnttttgcgttttattacgtgtcagctagtatatcagtcgccttcgtggtacgttcggaccgtaacgggacctaagggtaggtaaactcgaaaacggtacgtggtaggacttcgacctaaccg

SEQ ID NO: 75694 - DNA, 721 bp, Homo sapiens
  misc_feature: GYAE6OF02J2TMK.17.39.D06.1.454.CMB.1.raw
tcagcgtagactagcacgaccggtgctcgatttagtgacatctcgcagttctttgggggaggaactgctcagttaggaccagacggaaccatggaagccccagcgcagcttctcttcctcctgctactctggctcccagataccactggagaagtagtgatgacgcagtctccagcccaccctgtctgtgtctaccgaggggaaagcgcccaccctctccctgaccgagggcccagtcaggagttggttggcagccaaacgtttagccgtggtatccaagcaaggaacctggcccaggcctacccagggccttcctcagttcgtatgggtcgccaattccgaaccgaggggccctacggttgggtccgtaccccaggtcccctaaggggttttccaagggttgggaccctaggggttcggggttacctgggggaaccctaggggtacgtttttcctcctcgttacctaatcccgtaatcgtaacggcaccgggtccctggccctaagggttccttaggtaaacggtttctttttcgggaccgggtttttaaattccggttacggttccaaggtccttaaggtttataacgttcgtcggttcgggacccctttcgggtacggttaccgggttccggaccggtaaacggggtacccgaaagggttaacggtaaaccgttacggaaaccgtacggttcgggtacggtactacggacccgtaacc

SEQ ID NO: 75695 - DNA, 493 bp, Homo sapiens
  misc_feature: GYAE6OF02HYE2N.17.39.D06.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (324)..(324): a, c, t, g, unknown or other
  misc_feature (324)..(324): n is a, c, g, or t
  modified_base (397)..(397): a, c, t, g, unknown or other
  misc_feature (397)..(397): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaangccaccctctcctgcagggccagtcagagtgttggcagcaacttagcctggtatcagcagaacctggccaggcctcccgaggctcctcatgtatggtncatctacgagggccagtggtcnccagccaggttcagtgcagtgggtctgggacagtgttctctctcatcatcagcagcctgcagtctagtaagtnttttgcgttttatactgtcagtctagtataatcagtcgcctcgtgacgttcggacgaagggaccaaggtcgaatacgaacgactggcgctgacacg

SEQ ID NO: 75696 - DNA, 552 bp, Homo sapiens
  misc_feature: GYAE6OF02F3TPO.17.39.D06.1.454.CMB.1.raw
  modified_base (204)..(204): a, c, t, g, unknown or other
  misc_feature (204)..(204): n is a, c, g, or t
tcagcgtagactagcacgaccggtgctcgatttagtgacatctcgcagttctttgggggaggaactgctcagttaggacccagacggaaccatggaagccccagcgcagcttctcttcctcctgctactctggctcccagataccactggagaagtagtgatgacgcagtctccagccaccctgtctgtgtctccaggggaaanagccaccctctcctgcagggccagtcagagtgttggcagcaacttagcctggtatcagcagaaacctggccaggctcccaggctcctcatgtatggtgcatctaccaggggccacgtggtcgtcccagcccaggttcagtggcagtgggtctgggacagtagttctcgtctcatcatcagcagcctgcagtctgtaagtattttgcggtttattactgtcagtcagttataattcgaagtcgcccgttcgtcggtaccgttcgggacccgtaaaggggaccctaaaggggtacggtaaacgtacgtaaaccggtaacgttaggtacgggaccttacggacctaacccg
